United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 13

SEQ ID NO: 65692 - DNA, 201 bp, Homo sapiens
agcacgcagtgtctgttccatctcccagtattaggagagctgagcacagcacacacgtgcccccaggtctcgtcacacatgcgcacaccgtgccccagggsctcccctgggagtccccgtctctttattcaggataaggcctggttgctccacaaggtgtggcccacgctttcatcccccacgggcttccccactgcccag

SEQ ID NO: 65693 - DNA, 201 bp, Homo sapiens
gaagcgatgaaggaatggggagcggggacggaggttggctggcctccagctctgctctgggagcctgagctcagtggggtgggagcagttcttgcaggcckgggtctggcaggaggaggggcacacaggttgtgcggtgagagacgggactgaggcggatgggggccgtgggtggggggtgggggcacctgtggggaacac

SEQ ID NO: 65694 - DNA, 201 bp, Homo sapiens; identical to SEQ ID NO: 20952

SEQ ID NO: 65695 - DNA, 201 bp, Homo sapiens; identical to SEQ ID NO: 20953

SEQ ID NO: 65696 - DNA, 201 bp, Homo sapiens; identical to SEQ ID NO: 20956

SEQ ID NO: 65697 - DNA, 201 bp, Homo sapiens; identical to SEQ ID NO: 20957

SEQ ID NO: 65698 - DNA, 201 bp, Homo sapiens
cctgcttcggcctcccaaagtgctgggatcgtaggtgtgagccactgaggctcaccaacagtgatatttatggaaacgtgtccattttcttgtaacgttcmaagactctggtcttctttaaaccttacgtttgagctggtttttgatagcgcgctggtggaggagggggtgctggctcaagataaggaggcagaagtccag

SEQ ID NO: 65699 - DNA, 201 bp, Homo sapiens; identical to SEQ ID NO: 20959

SEQ ID NO: 65700 - DNA, 201 bp, Homo sapiens
ttcgcacagccccccgcacagctcctcacgggccccacacagctgtcgcacagccccgcacaagcccgcacagcaccagcagacaggtagcccccacaggyaacagcgcccacctcgccgcgcccagaccccggatcgccgacgcggacgccaggcgcctgggcacacggcgcctgcgcagacaacaccacgccccaggcc

SEQ ID NO: 65701 - DNA, 201 bp, Homo sapiens; identical to SEQ ID NO: 20960

SEQ ID NO: 65702 - DNA, 201 bp, Homo sapiens; identical to SEQ ID NO: 20961

SEQ ID NO: 65703 - DNA, 201 bp, Homo sapiens; identical to SEQ ID NO: 20963

SEQ ID NO: 65704 - DNA, 201 bp, Homo sapiens; identical to SEQ ID NO: 20965

SEQ ID NO: 65705 - DNA, 201 bp, Homo sapiens; identical to SEQ ID NO: 20969

SEQ ID NO: 65706 - DNA, 201 bp, Homo sapiens; identical to SEQ ID NO: 20968

SEQ ID NO: 65707 - DNA, 201 bp, Homo sapiens
tctggtaatagaagtaggtggctaggcagagtggacacttcacactgcatactcccatattttccgaaatctgagcttttttttttttttttttttttttyttttttttgagatggagtcttgctctgtcaccctggctggagtacagcagcaccatctcggctcactgcaacttccgcctcctgagttcaagcaattgtc

SEQ ID NO: 65708 - DNA, 201 bp, Homo sapiens; identical to SEQ ID NO: 20977

SEQ ID NO: 65709 - DNA, 201 bp, Homo sapiens; identical to SEQ ID NO: 20980

SEQ ID NO: 65710 - DNA, 201 bp, Homo sapiens; identical to SEQ ID NO: 2236

SEQ ID NO: 65711 - DNA, 201 bp, Homo sapiens; identical to SEQ ID NO: 20982

SEQ ID NO: 65712 - DNA, 201 bp, Homo sapiens; identical to SEQ ID NO: 20983

SEQ ID NO: 65713 - DNA, 201 bp, Homo sapiens
ggattaataaagggagaccactgtgggggaaaaaaaataaaagaaaataaaattttagctgaagaatgcaagcccctttaaattatcaggcccagagaggyattagaatgaaaaaacagtcccgtctcactcccggtctgagctggataattatctcttaaagcccacctgctatatgggctctagactggaaccaagaag

SEQ ID NO: 65714 - DNA, 201 bp, Homo sapiens
attatagtatataaatcttggtaaagaaaagtgaacaatttctctacctaagaattattaatacaagtttaatgactattaaatattaggacttaaaagamcttggaattaatttaatcccttagttttccattttgtgacatacatcatgtagctcaaattgttcatagttactagaatacgctaagtaaacagaattta

SEQ ID NO: 65715 - DNA, 201 bp, Homo sapiens
ataaactccaaaaattagttgtgtattatttggactactatttcaatcattcagaaatttgttttaaaaaatccttgcagtcttgctgctgacttcatagygtgcagtagtgtgatatggagatgatgcactgtctttcagaagccttggctctatgccttctagctgggcctggggcaagtcatttagcctctgtggacc

SEQ ID NO: 65716 - DNA, 201 bp, Homo sapiens
aggtagtgtaataaagttatttctgtaggaaactgggaattcattggctatttgactctgaatgtaacctctttaaagctgatgaacgagtggccccttakatttgaagtggtaaggtagtcataagttaggctcccagacactggcattcaacgtgattttgaagtgtgatagaccatgtatacacttgattgtgcacca

SEQ ID NO: 65717 - DNA, 201 bp, Homo sapiens
aagcaaatttcccatcataaaagacttaacaaaacactggaacatgaagatcaaaaggactgaatgaaaaggctggccctcagttttgtgcatttggaagktcaggtttttttttagctaagaagactttgatgaaggaagaagtaaaaaagaaaaagaaaaaaagaaactcggttttgttagttcattctgagtgaattc

SEQ ID NO: 65718 - DNA, 201 bp, Homo sapiens
tcaccatgttagccaggctggtctcgaactcctgacctcaagtgatccacccacctcgggcttccaaagttctgggattacctgcgtgagccactgtgccyagccaaggatatttttcttgtagtatctccattatcaaaacgtgctggaaaggatgttttacttgtttatcaatatggtgatgcctcaggagcttttaag

SEQ ID NO: 65719 - DNA, 201 bp, Homo sapiens
tttatgttcttaccagctttcaccctaattaaatggggcactacaccgcagagtttagcctgtggtgtagcagagcccaggtcatctgtcacagagaatcrtaatcttacattctctctctcctctgaacaatagaattttgaggtgggggagaatcttagtttataatgaggcaactctagttttatcacactcagaaac

SEQ ID NO: 65720 - DNA, 201 bp, Homo sapiens
cacttttttcctactggtaattcctgtttttctaattacacaaaatgtttaacttaaactattctttgcaatgagttttagctttcctcctctatcctaayttcaaaacctttaatttaagaaccatttaaaattaatccagtggtaaccagaagaatattttaggtatcatgaccacttaatcttgtgcctgattttagt

SEQ ID NO: 65721 - DNA, 201 bp, Homo sapiens
cattctgttaggttaccagtattttactgtcatgcacccatgggtagtagaaacaaaataaaaataaatataaatgtttaactttaggtgttggcaccaayatagattatgcataaactgttgcaataaaagatactcattgtgcctgtacctgaaaaatttaccttaggttttctctggccttttttgtttaggcctgca

SEQ ID NO: 65722 - DNA, 201 bp, Homo sapiens
gaaattatacatccttcgctttccccacaaaatgaattcagaatcgacattcaagtttataattttaagctgctaattataaaaatatattaataccttakggattgaagattacatgaaataagaactacaaaagaatgctaattaataacataactccatatgctatcaaacttctgatagcactgagtttcttataaa

SEQ ID NO: 65723 - DNA, 201 bp, Homo sapiens
gtgagaacattcccgccgcccggtcctcattcccatcttcccacctgtccagtcccctcgcactcccgctgcaccccacgcgccgggcttcagtcagagaktgcactgaggaagagcggagaccccctcttcccctcagcaggctgtgccgggggaggcggggtccaccgcccgccccccgccgtcgctctccccgcctcc

SEQ ID NO: 65724 - DNA, 201 bp, Homo sapiens
tatattcttctcttggtgagtaaaattatattttccttggcatcaatgcattgagatctgaatatacctgtatctatcaatccttattacacatttcttaygcagtagcttcaaataggccaaaattggcctagacacaactaaaaattgagggtttgttacatgctttctaacagaaaggttttcaacgagattaattat

SEQ ID NO: 65725 - DNA, 201 bp, Homo sapiens
cgccgcccggtcctcattcccatcttcccacctgtccagtcccctcgcactcccgctgcaccccacgcgccgggcttcagtcagagagtgcactgaggaasagcggagaccccctcttcccctcagcaggctgtgccgggggaggcggggtccaccgcccgccccccgccgtcgctctccccgcctccccttccctcccct

SEQ ID NO: 65726 - DNA, 201 bp, Homo sapiens
tactacaaaaacagttgaggaataaggaataaatctcttatgttacacctcagaataaaggcattcggtgaaagaaatgaactgaagttcatcatgaatgyaaggcctcagtacttgacattcctccacggaagggaagacaagtatcaacaccactggcatcatttccaaactgatcttatgttgaataatttccaccac

SEQ ID NO: 65727 - DNA, 201 bp, Homo sapiens
cccgcagcggccgcaggaggggcggctgcggtgggcgccgcgggcgatgcccctgcccggctgctccggcggggggcagtgcgagcggcggcggcgggggrggaggcggggggcggcggctgcggcggctgcagcagaggggccgagagctggcggtggcggcggcggtggtcgtgaagggcatcggcggcggcggtgatg

SEQ ID NO: 65728 - DNA, 201 bp, Homo sapiens
ataaatttcaatgcagtttgtctggcttccaaaatcatgtttaggtaggatctatagaaactagacctatcagaactggaaataagtaagttgagaagatmaaaaatgtgccaatccagtctattacagtgcctttattgtaatttattaataaggttttatcacctggttgagccgggagataacacttgcacgaaagca

SEQ ID NO: 65729 - DNA, 201 bp, Homo sapiens
gtctgtttgttacttgcagctgaagatggaaagagccaggcgaaggggaggcggcggcggccgcggccgcggaggcaagaatgtagggggctctggcctargcaagagtagactctatccccaggcccagcactcccactacccccactacgcggcctcagccacccctaatcaggccgggggcgcagccgaaatccagga

SEQ ID NO: 65730 - DNA, 201 bp, Homo sapiens
ccacttctcatatatgaaaatagggacaaaaaaattaattttgaattttccaggacaaactgacatcatatgccagaatgtcatagtagataaactcatgrcaatggttttattggatttttatcttctgcatctatattaaatcacaacagaaggccaagtgaacctgctaatatcttcatgagggcagagggctgtttc

SEQ ID NO: 65731 - DNA, 201 bp, Homo sapiens
agcaaggctccagaaggaggcagaagcactcggcaccctccccaccagtctcggtggggtccgaagagcatcctcacagtgtcctgaaaacagactatatmgagagggacaataggaaatattacctagacctaaaggaaaatcagcggggtcgcttcctacggattagacaaaccatgatgcgggggactggcatgatag

SEQ ID NO: 65732 - DNA, 201 bp, Homo sapiens
atgataggttattttggccacagtttgggccaagaacagactattgtcctcccagcacaaggaatgattgagtttcgtgatgccttggttcagctgattgmagactatggcgaaggagacatagaagaacgaagaggtggagacgatgacccgcttgaactcccagaggggacttctttcagagtggacaataaaaggttc

SEQ ID NO: 65733 - DNA, 201 bp, Homo sapiens
tcccagcacaaggaatgattgagtttcgtgatgccttggttcagctgattgaagactatggcgaaggagacatagaagaacgaagaggtggagacgatgayccgcttgaactcccagaggggacttctttcagagtggacaataaaaggttctactttgatgtgggctctaataaatatggaattttcctgaaggtaagtg

SEQ ID NO: 65734 - DNA, 201 bp, Homo sapiens
ataaatatctttaactcattgtatataaacattattaaatttagttttccattaattatttaagtaaagaattagttaagcagccagattttctactttgkatgtatacttcaaagtttttaccatctcaaagctgcagattaaatagatgcatatatactggcaattgagtatactctaaaattattaagccttctgcca

SEQ ID NO: 65735 - DNA, 201 bp, Homo sapiens
gttagaagcagactttttcagaaacctgtttgaaaggaatgatccaggttttatgaaatcaactcaagaacccactgttcttcatctgcatcagtaccatsattacagttgttgacagtgaaggccctagagcactgcagtattctcatttgtgcatgcaaaatttaatcacatttattatgttgtatttattaaagcaga

SEQ ID NO: 65736 - DNA, 201 bp, Homo sapiens
tctttaggctcaattctgcactcagtaaactcttggttttggccctggcagaaggcctagcaactcattggtgctcatgtctgtgcaccagctgcttgccracctcagcctctgcctcaaactctgagcctttgtcctctgtgcttaagactccctgcctgagcttcccaccttagctaaccttccagaacttgacgtttc

SEQ ID NO: 65737 - DNA, 201 bp, Homo sapiens
cgagcatgattgacaggtaatttcagaaatgaatttaggctgggtgtggtggctcatgcctgtaatcccagcactttgggaggccaaggcgggcggatcayttaagttcaggagttcaagaccagcctgaccaacatggttaaactccgtctctactaaaaataccaaaattagccaggcatggtggcacgctcctgtaat

SEQ ID NO: 65738 - DNA, 201 bp, Homo sapiens
tttaggtgtagcagctgcaagggaattgggctgcttataatctcataaaactgttttcagtcaaatataaaagtgcacaattgtgcaggcaaaaatttctygcacaggaaacaaaaagcactaactataagagaaaaaaacaatacattagactccatcaaaattaaaatttcctactcatccaaagacaccattaagaaa

SEQ ID NO: 65739 - DNA, 201 bp, Homo sapiens
ccacgtactacttcagtttttatgttccaagtttttcagtgatgcatgttaacagttaggtcctaaaattctgtggtgctaattctcccatacccaatggygcttttgtggatgctaactgcacacatgctgaacaaagcttgaagtttaaaactttcctcccttcctctgtttatatgaagtaaaatgaaataacttgaa

SEQ ID NO: 65740 - DNA, 201 bp, Homo sapiens
tcaaaaaacagaaagttaaatgccttcaggtacataaggctgttaacgaaatgtcacataatcaaagcatttaacaaatattagttaacatcattattaaktcttcccaacccacgaaatggatggttccctggaaagtataacaacattatgcaaagttcaaagggagcctccttttaccataggaacctttaggtgtag

SEQ ID NO: 65741 - DNA, 201 bp, Homo sapiens
ggtcttgaactcctgacctcaagtgatccacccattttgacctcccaaagtgctgggattacaagtgtgagccactgcacctgtccgaattattctgtttstgtatttatggccacagaagtttcatattggctaaatctgcacaaattatcatatagttataaatataaaagtcagatcaatatggctaagattatcaca

SEQ ID NO: 65742 - DNA, 201 bp, Homo sapiens
cagctaatttgggtttcaccatgttagccaggctggtctcgaactcctgacctcaagtgatccacccacctcgggcttccaaagttctgggattacctgcrtgagccactgtgcccagccaaggatatttttcttgtagtatctccattatcaaaacgtgctggaaaggatgttttacttgtttatcaatatggtgatgcc

SEQ ID NO: 65743 - DNA, 201 bp, Homo sapiens
taatagagatttagggaacatccaaattcagcagaagtgactaatgaaagatcaagatgttcctcctttaaccctcatggtagaccttgccaataaacgayagcaactgggagcagctcacacctgtaatcccagcattttaggaggccgaagcaggcggattgcttgagcccaggagttagagaccagcctaggcaacat

SEQ ID NO: 65744 - DNA, 201 bp, Homo sapiens
cagttctctgtcttcacattttaccctcttaaacttaatttttgcaaaaaatttttctattcggttttcattttcctagggaaagggaaaaattgtccctratgaaaagtgtttatagtatttaaaagagttgctcaaagtgtaagactggggaaaaaaagcttatgttgttttttttgtctttatcaaaataatggtata

SEQ ID NO: 65745 - DNA, 201 bp, Homo sapiens
gatatacaaataaccaacaagtatatgaaacattgctcatcaataaccatcagggaaatgtaaatcaaaatcacaatgagatatcacctcacacctgttaraatggctattaccaaaaagacaaaagataagtgttggcgaggatgtggagaaaagggaactccttcctcgctgttggtgggaatgtaaattattactaac

SEQ ID NO: 65746 - DNA, 201 bp, Homo sapiens
gcgatttttttcttccagagttttgtcccccaatacctttacgtgaggtcactaagaaaacttgatggtatgaattaaaaaaattaatttcattggtttakgttacttaagaacaagcaatcagtaaccccgacatatatactagtgttggtttgcagattgtatttcacatttcctctagtagcgtgaaggaatctcatt

SEQ ID NO: 65747 - DNA, 201 bp, Homo sapiens
agtgaagaaaacccacaaaatgggagaaattatttgcaaatcatacacccaataagggtttaatattcagaatatataaagatctcccacaattcaacagaaaaaaaaactcaattaaaaaatgggcaaaggacttaatagacagttcccaaagaagacatataatggccaataagcacattaaaagatgctcaacatcat

SEQ ID NO: 65748 - DNA, 201 bp, Homo sapiens
tggttttctgaaaataattttttcataagtgtgagctttttttccttcttatctccaaatgtttttcattggaatatttatgaaatcctattcaaagcttkatgtaaggggtttgcttagtcaccacttagtttgaagtctgtctttactaaaacaccaaacatctttgacaacatacaaagaggagttaacattgattct

SEQ ID NO: 65749 - DNA, 201 bp, Homo sapiens
agtacagatgggtagagggtgaaaagtagcaaccaatgttagcaatttcttgtgtatccttctagagttactctgcatatacaagtatatgtgtatgtatrtatatatatatatatatatatattctttttaaaacatacagatgaaaacatattatatatactatcttgtacctagtagattcaatttcagatctgtcat

SEQ ID NO: 65750 - DNA, 201 bp, Homo sapiens
gtctgtggcagcggagctgaaggactgtctaggggacttcatcgagcactatgcccacctgggcctgaaaggccaccggcaagagcatggccacagcaaaragcaaggctccagaaggaggcagaagcactcggcaccctccccaccagtctcggtggggtccgaagagcatcctcacagtgtcctgaaaacagactatat

SEQ ID NO: 65751 - DNA, 201 bp, Homo sapiens
attggtatttacttaaagtgcaaatatatgtgtattttaaatatacaaatattcagttcatcctactagtttcctttctctcttcctagccatcttgcctycctgtattcccctcacaaatatattggtctttttcctgaagtagtgcacttcaggagtgccaggatattaaataatttaaccaagtgttatcttaaaccg

SEQ ID NO: 65752 - DNA, 201 bp, Homo sapiens
aacaatgcaaaaaaatgtcagttttataatatgtatgtatttctttagccacacaaaataaaattttgtttctagtccttattaagaccaagttgttgtayactaactacgtaactatcctaaactttaattttttaaaaggaatatttttaaatattgattatttcccatctccttattatatcaaatatctcattattt

SEQ ID NO: 65753 - DNA, 201 bp, Homo sapiens
tatatttttgtaactaccttaactgtattccattttatgaaaactggtaaataataaatgtactacaaattaattgcacattttcttttggaagaaaaatmtgtttaatctacatgaaaatatctctaattttacacccacagtcaaccagatttctgtattaattttcatcattgtcccatcaaaaagattatcctgaaa

SEQ ID NO: 65754 - DNA, 201 bp, Homo sapiens
tgaagcaaaagtggaccagcacagctttttgtgggggttagtggtaggagagtgttatagtgaagttctttgttctgttttctcagtctcatttctcattsattcattaaatcaatagatatttattttgcctgtggtatgagctaaccatttctctgggtctggataatatagcagacaacaagatccagtctttggccc

SEQ ID NO: 65755 - DNA, 201 bp, Homo sapiens
gagaccagcctaggcaacatggtgaaaccccatctctagaaaaaatacaaaaattagctgggcttggtggcatgcacctgtagtcccagctactcaggacrctgaggctggaggatcacttgagcccaggaggtcgaggcttcagtgggctgtgatcatgctactgcactccagcctgggcgacagagcaagaccctgtct

SEQ ID NO: 65756 - DNA, 201 bp, Homo sapiens
tgggtggagacttagagctgttcagtgcccataggagtctgtggtggctatgaaaatgcatctctcaaatttccttctaccgggagcataactgactcacragctatttctgtattctgtgatgctagtctttggatggtgtggttttcatgttctacttacaccatccacctcctttgctgtgaagtggtcccttagttg

SEQ ID NO: 65757 - DNA, 201 bp, Homo sapiens
ctggtggacattaacatgtgatacaaaactcttcacagtctgggctgggtgtggtggctcacatctgtaatcatagcactttgggaggccaaggcaggtgkatcacttgaggctgggagttggagaccagcctgggcaacatggtaaaaccccatctctactaaaaatacaacaacaaaaattagccaggcgtggtggcgc

SEQ ID NO: 65758 - DNA, 201 bp, Homo sapiens
ctcattctgatacaagtggtctggaagccactctttgtcattcacttagactgtggacttgcgttctttctttttttttttttttttttttttttttttgkttcttgttagacttgcattctttcttccatatcgtttttccagcacaaattgcttaagttttaaatactgtcagtcatgacaccatggaatgatgatttt

SEQ ID NO: 65759 - DNA, 201 bp, Homo sapiens
acaacaaaaattagccaggcgtggtggcgcatgtctgtaatcccagctacttgggaggctgaggcaagagaatcgcttgaatccaagaggcagaggttgcrgtgaatcaagattgcaccactgcactccagcctgggttacagagtaagactccatctcaaaaaaaaaaaaaagttttcacagtctgtgcctgctcccata

SEQ ID NO: 65760 - DNA, 201 bp, Homo sapiens
tgatacaagtggtctggaagccactctttgtcattcacttagactgtggacttgcgttctttctttttttttttttttttttttttttttttggttcttgktagacttgcattctttcttccatatcgtttttccagcacaaattgcttaagttttaaatactgtcagtcatgacaccatggaatgatgatttttttggtt

SEQ ID NO: 65761 - DNA, 201 bp, Homo sapiens
actacgcggcctcagccacccctaatcaggccgggggcgcagccgaaatccaggagctggcctccaaacgagtggacatccagaaaaagaggttttacctrgacgtgaagcaaagctcccggggccgcttcctaaagatagccgaagtctggatagggagaggccggcaggacaacatcagaaagagtaaactgaccctct

SEQ ID NO: 65762 - DNA, 201 bp, Homo sapiens
tacaagtggtctggaagccactctttgtcattcacttagactgtggacttgcgttctttctttttttttttttttttttttttttttttggttcttgttaracttgcattctttcttccatatcgtttttccagcacaaattgcttaagttttaaatactgtcagtcatgacaccatggaatgatgatttttttggttaca

SEQ ID NO: 65763 - DNA, 201 bp, Homo sapiens
gtgcacaattgtgcaggcaaaaatttcttgcacaggaaacaaaaagcactaactataagagaaaaaaacaatacattagactccatcaaaattaaaatttsctactcatccaaagacaccattaagaaaatgaataaactatccacagactggaaaataattgaagcatagatttattcctggaggaaatcagaacagctt

SEQ ID NO: 65764 - DNA, 201 bp, Homo sapiens
agtatgtgtaatatatattaaacatacatatattgcacatgcatatatatacaattttttacatatatatgtaaaaatttttaaaagagatcccaatcctrttcacctttttcttgtccctggagaagtagtggtaaatgggtttcatctcgcttgtatttgcaattgattggctgccctaaagtgctgtgtttgtatcta

SEQ ID NO: 65765 - DNA, 201 bp, Homo sapiens
ctactgtccttttgtcattatattatctctgaacatttccatttagtgtttctatttagagtaaagaaatagaagcatgaaaattaataacccatgcatcrtattttttgctggactttataggaatgaccagctaaggctagaaacctcagtgtttaatactgttttcaaaatttgattgttacatatattgtcatttca

SEQ ID NO: 65766 - DNA, 201 bp, Homo sapiens
caaaagagccaagaacccacaatggggaaaggtcaggctcttcaataaacggtgttgggaaaactgataaccatatgcaaaagaatgaaagtagtcaattmtctctcaccacatacagcatcaactcaaaatggactaaagacttaaatgtaagaccccaaaccatgaaaccacttgaagaaaacacaggaaaaaagctcc

SEQ ID NO: 65767 - DNA, 201 bp, Homo sapiens
actcttggataatgataactaagtcttcgtttcatgaatttaacaatttgtatcagtgctaccttatgagtttttcagaaaaatgctatttgtattgaacyattttaaataattccataatctggaataattcagatttttttaatgatctgctgcaacatattggtattattgaatctcattttttctttgatttccatt

SEQ ID NO: 65768 - DNA, 201 bp, Homo sapiens
ttgctgtaatcacttagctgcctaataaaaataccagggttttaacaagcccactgctcattgaagccttttatattaataataacatagaaatttaaagrggtaaacttgaaatcaaaatttggcaaaattaagcatatatgtttatagctcatttaaagagtttttttgaaatgcattctaggtattttgttgctttca

SEQ ID NO: 65769 - DNA, 201 bp, Homo sapiens
tcttttccctgcattccattttttattatttttttattttttattttttcaagacagggtcttgctttgtcacccaggccggagtgcagtggtgcagtgayggctcactgcagccttgacttctggggcttaagtgatcctcccgcctcagactcctgagtagctggtactacaggcatgcaccaccatgcccagctattt

SEQ ID NO: 65770 - DNA, 201 bp, Homo sapiens
tcattcccatcttcccacctgtccagtcccctcgcactcccgctgcaccccacgcgccgggcttcagtcagagagtgcactgaggaagagcggagaccccstcttcccctcagcaggctgtgccgggggaggcggggtccaccgcccgccccccgccgtcgctctccccgcctccccttccctcccctcctggcgggtgcg

SEQ ID NO: 65771 - DNA, 201 bp, Homo sapiens
ccttaagaaacgtcaaaggatggtgattggaaaagagaagaagcagcacacaagggttttgtcttagaagcatttattttatttatttatttattattacttttttttttttttgagatgcagtctcactctatcgcccaggctggaatgcagagaagcatgtatttaagcaccccagtcctcagctatgcagtgccccgc

SEQ ID NO: 65772 - DNA, 201 bp, Homo sapiens
acatgcagactgaattattctggtggtttttgttgttttgttttgttttgttttgttttgagacagagtcttactctgtcacccaggctagagtgcagtgrcacgatctcagctcactgcaacctccacctcccgggttcaagtacttctcccaccctagccccccgagtagctgggactacaggtgtatgtcaccacgcc

SEQ ID NO: 65773 - DNA, 201 bp, Homo sapiens
ttctcagcgaggacgtccctgaccacttattgtaaaactgcagctccctacagccccccacccacaacacacacacacactcttcatccccctttcctttytaatctctattttcaccttctgtcatcctataattttactttttgcctgtctctttccactaaaatgtaagctccaaaaggagagagatgtttgtctgtt

SEQ ID NO: 65774 - DNA, 201 bp, Homo sapiens
catgcagactgaattattctggtggtttttgttgttttgttttgttttgttttgttttgagacagagtcttactctgtcacccaggctagagtgcagtggmacgatctcagctcactgcaacctccacctcccgggttcaagtacttctcccaccctagccccccgagtagctgggactacaggtgtatgtcaccacgccc

SEQ ID NO: 65775 - DNA, 201 bp, Homo sapiens
gaggccttggtgggcctcacttgaggtcaggcattcaagaccagcctggccaacatggtgaaaccccatctttactaaaaatacaaaaattaaccaggcgkggtggcacgcagctgtaatcccagctactcgggaggctgagtcaggagaatcgcttgaacccaggaggcggaggttgcagtggcagcgagccgagatcat

SEQ ID NO: 65776 - DNA, 201 bp, Homo sapiens
atgggctctagactggaaccaagaagccataaaatgccatatgctggacacgataactcataccctatgagttacagtgtacagccaatcactaagcaatsgtatctctgtaaaccaataacaattcctgaccaactttgtctcagcccactcttccccttcgcctttaaaaacctgcttgtaaccaaggctgaaggagca

SEQ ID NO: 65777 - DNA, 201 bp, Homo sapiens
ttgaactatatttttttctataatctagctcttagaactctattttcctttgatactaatgattcctcttgccctcagaaatgtttacatgaaacagcacrtgactgtcctttttgttgatcccaaaactttttattgttcattctagagaggcaaataatgtccttcagtgtcactaattgagtttttaaaaggaagatt

SEQ ID NO: 65778 - DNA, 201 bp, Homo sapiens
actcataccctatgagttacagtgtacagccaatcactaagcaatggtatctctgtaaaccaataacaattcctgaccaactttgtctcagcccactcttycccttcgcctttaaaaacctgcttgtaaccaaggctgaaggagcactccccaaggcaactgggaaatgagtcctgggcagctgtcctcattttggctgaa

SEQ ID NO: 65779 - DNA, 201 bp, Homo sapiens
agcaaccactgatcagatgtctatcaccacagattagttttgtgtattctggaatcccctgttaattgcatgtatttttcttttcttttcttttcttttctttttttttttgttttggtgacaggatctcactctgttacccaggctggagtgcagtgtcacaatctcagctcgctgcaacccccacctcccagctttaag

SEQ ID NO: 65780 - DNA, 201 bp, Homo sapiens
cctctgcctccctggttcaagcaattctcttgcctcagcctccctagtagctggcacctgccaccatgcccagctaatttgggtttcaccatgttagccaggctggtctcgaactcctgacctcaagtgatccacccacctcgggcttccaaagttctgggattacctgcgtgagccactgtgcccagccaaggatatttt

SEQ ID NO: 65781 - DNA, 201 bp, Homo sapiens
ctaacctaagctggacactaatattttgccagtaggaaccttttattttttgagacagtttcgctcttgttgcccaggctggagtgcagtggcgcgacctyggctcactgcaacctccgcctcctgggttcaagtgattctcctgcttcagcctcctgaataactgggattacaggcgcccgccaccatgcctggctaatt

SEQ ID NO: 65782 - DNA, 201 bp, Homo sapiens
cctatgaagctgatccttccaactctaataaagcacagtctacccccagccgccactatacatctgcctcagcttacttggaattattttatccaaaaccrtcccctatatgtgggactagtctcaccaaagagacacttggcttatatgaggattccattggttaaagttggtgctaataaatacaagttatttgatctt

SEQ ID NO: 65783 - DNA, 201 bp, Homo sapiens
ccagggccacagattagtaccagtccatggcctgttaggaaccaggccacaaagcagtaggtgagcagcaggcaagcaagcgaagcttcatttttctttayagctgctccccattcctcacgttaccacctgagctccacctcctgacacatcaacggtggcattagattctcatagcagcgcaaaacctactgtgaattg

SEQ ID NO: 65784 - DNA, 201 bp, Homo sapiens
caattaactgatataaaaatatacctgtaataatatattttagtagcacttttgcaattgctacccttaaaaccatgtcaacacttccaatataatcctgwattttacaggtgttttaattctggagggggtggggattttttttttctaaaaataatttagaatacaaatttccagtctgagaaaaatattatttgaaga

SEQ ID NO: 65785 - DNA, 201 bp, Homo sapiens
ctcccgggttcaagtacttctcccaccctagccccccgagtagctgggactacaggtgtatgtcaccacgcccagctaatttttgtattctttggaagagwtggggtttcactgtgttggccagactggtcttgaactcctgacctcaagtgatccacccattttgacctcccaaagtgctgggattacaagtgtgagcca

SEQ ID NO: 65786 - DNA, 201 bp, Homo sapiens
gtaagaccccaaaccatgaaaccacttgaagaaaacacaggaaaaaagctccctaacattggtcagggctagaggttcccaaccccagggccacagattaktaccagtccatggcctgttaggaaccaggccacaaagcagtaggtgagcagcaggcaagcaagcgaagcttcatttttctttacagctgctccccattcc

SEQ ID NO: 65787 - DNA, 201 bp, Homo sapiens
gtgagattatatagacgtcattcagaatatttgtttttatccttcaactcgaagagttttctcacctctttattttcaagttgaaaacattattataagaktatgttagcgggtcatttgactctgaaaaaaatagctttttaaaggttgatcacactttaatcttcaatttcaggatagtaaagaaccattataatttag

SEQ ID NO: 65788 - DNA, 201 bp, Homo sapiens
tattttcttctgaatgaaattattgtcttttatcttggctttattcacctcccacacaataagtccatctaatcatatttaagagccagaacactgatttyaacccccaaatatcactctcattgatgagagctggctgcatggattcaaatcagaatgtagctcttcttttatatgctaaaagtaatttaaaattatatc

SEQ ID NO: 65789 - DNA, 201 bp, Homo sapiens
tttttaaaaaaaactaagtatgtgcctatgcttttcctttttaaccatattgaatgtgtaatgttgagttagaagacactgtgtgaggtaagaaatggcarttcaaggggaacaagaacattcgtttattcagtcaacaaatatggattgagttcctcccataggcccagcattgtactagggaaattgctcactattttt

SEQ ID NO: 65790 - DNA, 201 bp, Homo sapiens
ttttaaccatattgaatgtgtaatgttgagttagaagacactgtgtgaggtaagaaatggcagttcaaggggaacaagaacattcgtttattcagtcaacmaatatggattgagttcctcccataggcccagcattgtactagggaaattgctcactatttttatttttcccctctaacctaaggtggagatgataatgaa

SEQ ID NO: 65791 - DNA, 201 bp, Homo sapiens
accctattatccccattttcatatgattttccagaggtttataaactggttcagaatatcagaactaatgtatttgaacccaaatttacaccaaagccaamgattgtgcccgttcagttaggccaaactgcctttcagatttcctatgaagctgatccttccaactctaataaagcacagtctacccccagccgccactat

SEQ ID NO: 65792 - DNA, 201 bp, Homo sapiens
tcaagagtgcattttgatatgacttttctattgaccaccaagaaaaaattatctgaaaaatgaaagatcccatacttgagtcctgaaagatgctatctaaytatgaattaaagcaaccagagtaaaagatccaatacaattgtaaatatctttaaaaatgtgggttgaggaagaagaattttttcatggattggtatccgt

SEQ ID NO: 65793 - DNA, 201 bp, Homo sapiens
ggtgtttttgtttttgtttttgtttttgttttgagacggagctattctcttgcctcagtctcccgagtagccgggaccacaggcgcccaccaccacgcctygctaatttttatatttctagtagagacggggtttcaccatgttggccatggctcgtctcaatctcctgaccttgtgatccaccctcctcgccctctcaaa

SEQ ID NO: 65794 - DNA, 201 bp, Homo sapiens
tctttctgactttacacaagactcacccatttacctgtattaaaaattactttccaggaagtgccacagcaatttttcaacacctaagcaattttttaaayaagtggatatagtgttatatgtgtaccaacccatcctgtattaattgactgaaattacatctattcagctatattttcttctgaatgaaattattgtctt

SEQ ID NO: 65795 - DNA, 201 bp, Homo sapiens
atttacttaaaactccaatagaaaaagtaaaactataaaactattaaaagaaaacataacagaaaatcttcatggcattggatttgggaattaggtatgaygccaaaagcataggtaataaaagaaaaaacagataaactggactctataaaaatttaaaagtgaatcaaagaacaatatcaaaaagtgaagaaaacccac

SEQ ID NO: 65796 - DNA, 201 bp, Homo sapiens
aatgtatcacactaatatacaagaatttacttaaaactccaatagaaaaagtaaaactataaaactattaaaagaaaacataacagaaaatcttcatggcmttggatttgggaattaggtatgatgccaaaagcataggtaataaaagaaaaaacagataaactggactctataaaaatttaaaagtgaatcaaagaacaa

SEQ ID NO: 65797 - DNA, 201 bp, Homo sapiens
gattcaatttcagatctgtcattttaagtgacttttttttaacttagatatcatacttgagctagttaacatatcacttaatttgaaatatattaactatmccaaggaaatatcaaggaaattttgaatgaatcccattggtatttacttaaagtgcaaatatatgtgtattttaaatatacaaatattcagttcatccta

SEQ ID NO: 65798 - DNA, 201 bp, Homo sapiens
tttcaaaatttgattgttacatatattgtcatttcagtgactggagacaagatgtatatgtagacaaatagataaaaacagggtaattaaaccagtgtggtttttttttattttaaaggaaaacacatacgacttatgtacattgcatggcagagtattactaaaattcgcctaaacaaaccgtcacgatgttttcaggtt

SEQ ID NO: 65799 - DNA, 201 bp, Homo sapiens
tcaagggtaatgttaaaatttgaaaagaaaaaatcgaaacaaatgtattaaatctccttgagcaacaatcattgaccataaatagaagatgatcaaacctatatcagtcaaagaatctagcaggtatgatgactgaaatgatattcccataccactatggttctttattatataaagagtttcaggcccagtaaatttttg

SEQ ID NO: 65800 - DNA, 201 bp, Homo sapiens
caagggtaatgttaaaatttgaaaagaaaaaatcgaaacaaatgtattaaatctccttgagcaacaatcattgaccataaatagaagatgatcaaacctatatcagtcaaagaatctagcaggtatgatgactgaaatgatattcccataccactatggttctttattatataaagagtttcaggcccagtaaatttttgc

SEQ ID NO: 65801 - DNA, 201 bp, Homo sapiens
aagggtaatgttaaaatttgaaaagaaaaaatcgaaacaaatgtattaaatctccttgagcaacaatcattgaccataaatagaagatgatcaaacctatmtcagtcaaagaatctagcaggtatgatgactgaaatgatattcccataccactatggttctttattatataaagagtttcaggcccagtaaatttttgcc

SEQ ID NO: 65802 - DNA, 201 bp, Homo sapiens
ttgcacattttcttttggaagaaaaatctgtttaatctacatgaaaatatctctaattttacacccacagtcaaccagatttctgtattaattttcatcaktgtcccatcaaaaagattatcctgaaaaatgcatatcagctttcgttggtagtggtgaaattttttaaaaaacttatcagccttaaataacatgaatata

SEQ ID NO: 65803 - DNA, 201 bp, Homo sapiens
ttttgtttttgttttgagacggagctattctcttgcctcagtctcccgagtagccgggaccacaggcgcccaccaccacgcctcgctaatttttatatttytagtagagacggggtttcaccatgttggccatggctcgtctcaatctcctgaccttgtgatccaccctcctcgccctctcaaagtgctgggattacagcc

SEQ ID NO: 65804 - DNA, 201 bp, Homo sapiens
cttcagtgtgaatacaaatcatcttgatggtttgttaaaccacagattgctggccccagctcagagtttctgttcagtaggactggtgaggtggggagaaraccaagaatatgcatttctaacagtcctaaggagagtggatgctgtgatctagggggaccgcactttaagaaccacactgctgtcagctgatgagatttt

SEQ ID NO: 65805 - DNA, 201 bp, Homo sapiens
attctatgcttgacaaccttgtagatattctgtactataattaatatgttgatcaaaattaaagccatatatatatatatatatatatatatatatatatwttttttttttttttttttttttttttttttttttttgaaaaaaaatctccctctgtcacccaagctggagtgcaggggggcgaactcgggtcactggaaa

SEQ ID NO: 65806 - DNA, 201 bp, Homo sapiens
ttttgagacggagctattctcttgcctcagtctcccgagtagccgggaccacaggcgcccaccaccacgcctcgctaatttttatatttctagtagagacrgggtttcaccatgttggccatggctcgtctcaatctcctgaccttgtgatccaccctcctcgccctctcaaagtgctgggattacagccgtgagctacca

SEQ ID NO: 65807 - DNA, 201 bp, Homo sapiens
tgacagttttaattttgtagatgaatttggcatgacgtggatgaattctgtcaaggtcattattgttttcttctcaaaaccaatagaattttctcacttayttatttttagaattgtcaggtagtgtaataaagttatttctgtaggaaactgggaattcattggctatttgactctgaatgtaacctctttaaagctgat

SEQ ID NO: 65808 - DNA, 201 bp, Homo sapiens
gcaaggaacctatgaacagtcactaacacaaatatgatatctcagaattcacagaagtactaaccttccccaactaaaaagggtattgggggatttagtgbatccttccatcttaaaagcttcttaagatgtacatttgaaaactagataactgttgcttaataatactttactgagaaacactgtgtactaacaattcat

SEQ ID NO: 65809 - DNA, 201 bp, Homo sapiens
gggggcggcggagggatgcggggagcgcgggcagagccggagcggcggccgccaaccggccggcagtggctggagccccgcgctgcggcgccgggggagcygggcccggcgtgggggtcgcgggcggcggcggggcggtcaggccgaggggcgtctgcgattgttctcaacacccctcccccaccccatcccgtgtgtctg

SEQ ID NO: 65810 - DNA, 201 bp, Homo sapiens
gaccaactttgtctcagcccactcttccccttcgcctttaaaaacctgcttgtaaccaaggctgaaggagcactccccaaggcaactgggaaatgagtccygggcagctgtcctcattttggctgaagtaaacactttaaattataattttgtgccccagcctcttccttttaggtagacaccactattcaatgacatcaa

SEQ ID NO: 65811 - DNA, 201 bp, Homo sapiens
cagattgcatttttcttcttttgaaagtcctaattaaattgtttgccatgttatgcaaagattcattgagattctggggagtggcagtaaatttaagcaargattatactgtgattctggggagccatagtaaattgtgtatcaacaaatctaaagggtgaatttttactttctgcttattgtctttttcaagaaaattct

SEQ ID NO: 65812 - DNA, 201 bp, Homo sapiens
tttttcaagacagggtcttgctttgtcacccaggccggagtgcagtggtgcagtgatggctcactgcagccttgacttctggggcttaagtgatcctcccrcctcagactcctgagtagctggtactacaggcatgcaccaccatgcccagctatttttcctattttttgtggacacagggtctcactatgttccctagac

SEQ ID NO: 65813 - DNA, 201 bp, Homo sapiens
tgtctcagcccactcttccccttcgcctttaaaaacctgcttgtaaccaaggctgaaggagcactccccaaggcaactgggaaatgagtcctgggcagctktcctcattttggctgaagtaaacactttaaattataattttgtgccccagcctcttccttttaggtagacaccactattcaatgacatcaagatctgaac

SEQ ID NO: 65814 - DNA, 201 bp, Homo sapiens
tcattgagattctggggagtggcagtaaatttaagcaaagattatactgtgattctggggagccatagtaaattgtgtatcaacaaatctaaagggtgaayttttactttctgcttattgtctttttcaagaaaattctatagttaccaaaaaggtggctgaattttgacataataaaggagaaggttgagctggcctttg

SEQ ID NO: 65815 - DNA, 201 bp, Homo sapiens
ggaggatcacttgagcccaggaggtcgaggcttcagtgggctgtgatcatgctactgcactccagcctgggcgacagagcaagaccctgtcttaaaaaaaraaaaataggccatagtatttatttcaaatggccagatacagctctagagtctttctcaactcagcactctcctggcagctgctcccagttgactacactt

SEQ ID NO: 65816 - DNA, 201 bp, Homo sapiens
actttaaattataattttgtgccccagcctcttccttttaggtagacaccactattcaatgacatcaagatctgaactgtcctacttatcccaatatcccwcccctaaaaagaaatgtaccgaaccataaaaagcctgaagtactccgacttacagactcctgtattagcatcctaagaattatattaccctcttcaatag

SEQ ID NO: 65817 - DNA, 201 bp, Homo sapiens
tagccactttcttacttttacaaaaagttagtatggtgttttttttgtttttttgttttttggtttttttttgagatggagtcttgctctgtcacccaggytggattgcagtggggcgatctcgggtcattgcaacctccacttcccaggttcaagcgattcttttgcctcagcctcccaagtacctgggattacaagtgg

SEQ ID NO: 65818 - DNA, 201 bp, Homo sapiens
gattcaactaggaaaaaaagaaaagaaaatccattaaagactgagtgatttgaactcaaaaatatccatcatcacttgctaaatcatagacagcaggttayttccctcgactttgctgtgcagacctgtagtggctcaatttctgccataataaaggccgtactagaaagagcaatcctaactaagcgcgcaaggtaaaca

SEQ ID NO: 65819 - DNA, 201 bp, Homo sapiens
aatactgtacagattcccatcttatcagaggaagaaccagttagcataacatagaattttagggctagaagagactttcaacatcatcaagtcttacctckcggtattcaatagttcaatataattattatctttttacaggtcttagctttcctgccctaatttccaaaacaatgaagaactagtagtccccagatcccc

SEQ ID NO: 65820 - DNA, 201 bp, Homo sapiens
aatttctgccataataaaggccgtactagaaagagcaatcctaactaagcgcgcaaggtaaacatcaagctggggccgtcaggggcggggaaacactttckgaatggcggaagctccgagagacgcctttcccagctgctccagaggggaaaggaaaagggagaaagtctgtttttccagaatctcccaaacacagcccag

SEQ ID NO: 65821 - DNA, 201 bp, Homo sapiens
atatttattttgcctgtggtatgagctaaccatttctctgggtctggataatatagcagacaacaagatccagtctttggccccaaagagcatacagtacrggtactcacaacatggacaatgctagataactgcccagagagcagagaagctacatgagatcattataaacctgtgcacctgaaccactgcacaagcaat

SEQ ID NO: 65822 - DNA, 201 bp, Homo sapiens
ggaagtaatttttctcatcagaaattgctttgagtttgaaaatggccaataataataaaaagccaatctgcagtctacataatttcagatttgtcttcatkcgatctttttaaaaaactgttgaagtaggtgcatactgacttgcactaggactaaagttatttttcttacctcctactttatcctttatccttggcaggg

SEQ ID NO: 65823 - DNA, 201 bp, Homo sapiens
ggaagacactttaccccgagaagatccagtccaacaggtcttcttcagccggatgactgtggagcgccaccacaagcagggcctgcaacccaggcatccasgctagacaccaaatcagcaaactttattcccgcgctgccgagtacaagccggcgcctccccggcgcacacagtacacatcagctccgggagacctacccg

SEQ ID NO: 65824 - DNA, 201 bp, Homo sapiens
caggtcttcttcagccggatgactgtggagcgccaccacaagcagggcctgcaacccaggcatccaggctagacaccaaatcagcaaactttattcccgcrctgccgagtacaagccggcgcctccccggcgcacacagtacacatcagctccgggagacctacccgacccgcccctccagcgccgtccccgcccccgttc

SEQ ID NO: 65825 - DNA, 201 bp, Homo sapiens
ggatgactgtggagcgccaccacaagcagggcctgcaacccaggcatccaggctagacaccaaatcagcaaactttattcccgcgctgccgagtacaagcyggcgcctccccggcgcacacagtacacatcagctccgggagacctacccgacccgcccctccagcgccgtccccgcccccgttcctgccccacccctttc

SEQ ID NO: 65826 - DNA, 201 bp, Homo sapiens
tttcatatcaaacctagcctgagaacaactgagattcaactaggaaaaaaagaaaagaaaatccattaaagactgagtgatttgaactcaaaaatatccaycatcacttgctaaatcatagacagcaggttatttccctcgactttgctgtgcagacctgtagtggctcaatttctgccataataaaggccgtactagaaa

SEQ ID NO: 65827 - DNA, 201 bp, Homo sapiens
cagcaaactttattcccgcgctgccgagtacaagccggcgcctccccggcgcacacagtacacatcagctccgggagacctacccgacccgcccctccagsgccgtccccgcccccgttcctgccccacccctttccccgcccccggcccggctcgcctttctcgcggcgctgcaaccctcccaccacagcccatccagcc

SEQ ID NO: 65828 - DNA, 201 bp, Homo sapiens
cctttccccgcccccggcccggctcgcctttctcgcggcgctgcaaccctcccaccacagcccatccagccccgcccagcgcgccgcggtgcgcatgcgtrgaggccctcgctgccgctgagcacctcgggaagtgtagtctcttcgcaggtgcggctgggcagctagagtcctgcatcccggtggaatccggagaagtga

SEQ ID NO: 65829 - DNA, 201 bp, Homo sapiens
acatcttgaatatcagatattcaatggagaaaccaattaacttacaacaaaaaataaattggtacacccagggagtggattggaaagaagctgtgcatgasaagtgaactttgaagtttgcttttatactttttgaatattatttcatgataagcttgtattattttataatttataaagtacttttttttttaaaggaaa

SEQ ID NO: 65830 - DNA, 201 bp, Homo sapiens
gtaattaaaccagtgtggtttttttttattttaaaggaaaacacatacgacttatgtacattgcatggcagagtattactaaaattcgcctaaacaaaccrtcacgatgttttcaggttttatggtaatgctttgactatatagtatttggatttgaatcctcataatcacaaagtctcttagttgtttaaaacaaaaaac

SEQ ID NO: 65831 - DNA, 201 bp, Homo sapiens
gagccaccacacccagcttattcattttatttaacgtaagagatttttcctttttttttttttttttttttttttttgagacaaggtctcactctgttacycgggccggaatggagtggctcaatcatagctcactgaagcttcaaattcctgggctcaaacgatactcctgcctcagcctcccaagtagctgggactaca

SEQ ID NO: 65832 - DNA, 201 bp, Homo sapiens
ttgaactggggaggtggaggttgcagtgagccgagatggcaccaacggactccagcctgggtgacacagtgagattcttcctcaaaaaaaaaaaaaaaaargaaagaaaagaaaagaaaaagaaatacactacttaaaaataaaaggaaatgttatattggcatgtctagagaattgctcctttctcctcctccagggagg

SEQ ID NO: 65833 - DNA, 201 bp, Homo sapiens
aaatctgggcagtgcaataatggggcacttctatttcttccgttttctgtattttccatttccctctattttctgtattagaaatacactacttagccggrcatggtggctcatgcctgtaatcccagcactttgggaggtcaaggcgggcagatcacctgaggtcagaagttcgagaccagcctggccaacatggtgaaa

SEQ ID NO: 65834 - DNA, 201 bp, Homo sapiens
ggcacaatctaatgtctgctcttagaagacggatagctgttacgtgggaattatttgtaaagaatgtgggaaaagcagaggcaagaaaggcaggccgaagsttattgcaacagccctggcaagaaagggtagcttgaattacaacggcagtggaaatggagagaagtgaatgggtttaggatatattttggccctgaaatg

SEQ ID NO: 65835 - DNA, 201 bp, Homo sapiens
aaaaaaaaaaaaagaaagaaaagaaaagaaaaagaaatacactacttaaaaataaaaggaaatgttatattggcatgtctagagaattgctcctttctccycctccagggaggaaaacagaggaccttatatttagcaatccagcatcactctcctgacattccctctagtagagaatcatgcctaactaaagagctcaga

SEQ ID NO: 65836 - DNA, 201 bp, Homo sapiens
gtaactcctccctgctgggggcatgggaagggagaaatgaaggaacaattatttttcatttggtaccattctctgtatggcttggattttcttgctattayttttatttgttaaaatctgggcagtgcaataatggggcacttctatttcttccgttttctgtattttccatttccctctattttctgtattagaaataca

SEQ ID NO: 65837 - DNA, 201 bp, Homo sapiens
accgctagctactcgtggaacagacctaggagacgattcctcagattttcacattcctcacatttttctaacacagcatgtttcctttcccttcctttttyttttttttttttttttttgagagggagtctcgctctgtcacccaggatggagtgcaatggtgtgatctcagctcactgcaacctctgcctcccaggttca

SEQ ID NO: 65838 - DNA, 201 bp, Homo sapiens
ggctggagtgcagtggcaggatctcggctcactgcaagctccgcctcccgggctcacaccattctcctgcctcagcctcccaagtagctgggactacaggygcccgccaccacgcccggagaattttttgtatttttagtagagacggggtttcaccgtgttagccaggatggtctcgatctgctgaccttgtgatccacc

SEQ ID NO: 65839 - DNA, 201 bp, Homo sapiens
gaatcggtccaaaccgactcacagatgacctcttgaggacggggtgaccaatcctgcagttcatgatcaggacagaagcaaccggctgagggtcatcacastgaatgtttggagagggaggctgttaaaagagcagatgacattctcttaaagagccaaacaaaacaaaacaaaaacgtggtttcctcacagcaattcagc

SEQ ID NO: 65840 - DNA, 201 bp, Homo sapiens
taagtaagagggggaaacatacaaatttaaaatgtgcacataagaaacttaatagtaactcctccctgctgggggcatgggaagggagaaatgaaggaacmattatttttcatttggtaccattctctgtatggcttggattttcttgctattatttttatttgttaaaatctgggcagtgcaataatggggcacttctat

SEQ ID NO: 65841 - DNA, 201 bp, Homo sapiens
tggtttttatacttgagactctgtagtcactgtggaaagaggtgtgactgataaagaactgcctttaaatacctgagtcctcgtcagcttcttcactgctrcaacctggagacctcgtaatttggttgggacgcaaatttgcaactggtattctgctccaaagaggttctccccatgtacctgcaaattaaaatcagagta

SEQ ID NO: 65842 - DNA, 201 bp, Homo sapiens
atgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctca

SEQ ID NO: 65843 - DNA, 201 bp, Homo sapiens
cccatcaccccctactttcagagccagcttagccactgtaagcactgctggggacacactgcagtcaagcgaagcgcaaagctggaaccgagagattgagrtgagaccaagatgcagaagacgccaactgcagggtggtgagaagagcgaatcggtccaaaccgactcacagatgacctcttgaggacggggtgaccaatc

SEQ ID NO: 65844 - DNA, 201 bp, Homo sapiens
atttatgcattcctgagtactgtttaatactataactaaacactgatacagcacactaagacagttactggatacaaaaaacaatttctcacttaggtaaytcattttttatttatttatttattttttgagactgagtctcactctatcactgaggctggagtggagtggtgtgatctcggctcactgcaacctctgcct

SEQ ID NO: 65845 - DNA, 201 bp, Homo sapiens
cctggtcaacatagcaagacccctgtctctatttttttaaataaataaactacatgtgaaaacaaacgtttatatttataaaccctctttttttttttttwaattttattgagacagagtcttgctctgtcacccaggctagagtgcagtggtgcgatctcagctcactgcaacctccgcctcccgggttcaagcaattct

SEQ ID NO: 65846 - DNA, 201 bp, Homo sapiens
aactttttgtctgacacgccctccatactacccacaacttcactctgcttcacggaggtgagcaggcagttcacctagggctgtgtactggaaagctctcrtccccatcaccccctactttcagagccagcttagccactgtaagcactgctggggacacactgcagtcaagcgaagcgcaaagctggaaccgagagattg

SEQ ID NO: 65847 - DNA, 201 bp, Homo sapiens
caattatttttcatttggtaccattctctgtatggcttggattttcttgctattatttttatttgttaaaatctgggcagtgcaataatggggcacttctrtttcttccgttttctgtattttccatttccctctattttctgtattagaaatacactacttagccggacatggtggctcatgcctgtaatcccagcactt

SEQ ID NO: 65848 - DNA, 201 bp, Homo sapiens
ccaagtaggtgggattacaggcacccaccatcatgtccggctaatttttgtatttttggtagacagggtttctccatgttggccaggcttgtgttgaactyctgacctcaggtgatccacctgtctcggcctcccaaagtgctaggattacaggcgtgagccacctgcgcccagctgcgaaatttttttttttaatcaatc

SEQ ID NO: 65849 - DNA, 201 bp, Homo sapiens
cacttgaacccgggaggcggaggttgcagtgagtagagatcgtgccactgcactccagcccgggtgacagagcaagactccatctaaaaaaaaaaaaaaaraaaagaaaagaacacctgagctaaatttaagaagaaaccacctacgtcaggacctagaggaagagcagtgtcaagcaaaggaacagcaagtacaaagtct

SEQ ID NO: 65850 - DNA, 201 bp, Homo sapiens
ctggtattctgctccaaagaggttctccccatgtacctgcaaattaaaatcagagtaggaaatcaaagctggtattgctttgccatctacagctttacaawaataagtacttacatggaagaggaattctttgtggtgagaaagcccctggcctgtgttcacgtacattatggatggtctgcaattgacaggacatgcgtc

SEQ ID NO: 65851 - DNA, 201 bp, Homo sapiens
cctgtaatcccagctactcgggaggctgaggcaggagaatcacttgaacccgggaggcggaggttgcagtgagtagagatcgtgccactgcactccagccmgggtgacagagcaagactccatctaaaaaaaaaaaaaaaaaaaagaaaagaacacctgagctaaatttaagaagaaaccacctacgtcaggacctagagg

SEQ ID NO: 65852 - DNA, 201 bp, Homo sapiens
ccagctactcgggaggctgaggaagaagaatcacttgaactggggaggtggaggttgcagtgagccgagatggcaccaacggactccagcctgggtgacasagtgagattcttcctcaaaaaaaaaaaaaaaaaagaaagaaaagaaaagaaaaagaaatacactacttaaaaataaaaggaaatgttatattggcatgtc

SEQ ID NO: 65853 - DNA, 201 bp, Homo sapiens
gcctgtaatcccagctactcgggaggctgaggcaggagaatcacttgaacccgggaggcggaggttgcagtgagtagagatcgtgccactgcactccagcscgggtgacagagcaagactccatctaaaaaaaaaaaaaaaaaaaagaaaagaacacctgagctaaatttaagaagaaaccacctacgtcaggacctagag

SEQ ID NO: 65854 - DNA, 201 bp, Homo sapiens
gcgggcgatcacctgaggtcaggagttcgagaccagcctggccaacatggtgaaaccccctctctactaaaaatacaaaaattagctgggcgtggtcgccrgcgcctgtaatcccagctactcgggaggctgaggcaggagaatcacttgaacccgggaggcggaggttgcagtgagtagagatcgtgccactgcactcca

SEQ ID NO: 65855 - DNA, 201 bp, Homo sapiens
actcctggcctcaagcaatcctcccgcctcagcctcccaaagtgttgggatgacagatgtgagccaccacactcacaattctttttttttaaattatttcytgtatctgtccctttcttttccacccccattgctacttcttcagttgagacctcacaaatgtcacctggatcactgtaaaacattaaacttgatcacttg

SEQ ID NO: 65856 - DNA, 201 bp, Homo sapiens
aaagaacacctaggtcgggtgcggtggctcacgcctgtaatcccagcactttgggaggctgaggcgggcgatcacctgaggtcaggagttcgagaccagcytggccaacatggtgaaaccccctctctactaaaaatacaaaaattagctgggcgtggtcgccggcgcctgtaatcccagctactcgggaggctgaggcag

SEQ ID NO: 65857 - DNA, 201 bp, Homo sapiens
cagaatgtctgtggaggtgctcaaaggttaggcacaattttccttgggcactactcagaagccagccaggaattaccttagttctgtggttctctgcattmagtccctcatatagagatttgttgaaagatatttcaccaaggatctgcagttcagttacatcttttagtaactagaagatggggaaaggaatgagggaaa

SEQ ID NO: 65858 - DNA, 201 bp, Homo sapiens
ctgtaatcccagctacttgggaggctgaggcaggagaatcgcttgaacccgggaggcggaggttgcagtgagccgagatcgtgccattgcacaacaagagygaaactccgtcttgaaagaaagaaaagaaaagaaaagaacacctaggtcgggtgcggtggctcacgcctgtaatcccagcactttgggaggctgaggcgg

SEQ ID NO: 65859 - DNA, 201 bp, Homo sapiens
ctgtttcatccctgaaaagggaaggcacatgaagaaaaatccaacatccttttgctactgacttcttgcttcctgttttgtatcctgccatgtgaaaatayagcatttggagatgtggcaactttgtgctggccatgaaggaatgcgtcccccacacggcagagtacaaggaccaaagaagccaggccatcgccccaggcc

SEQ ID NO: 65860 - DNA, 201 bp, Homo sapiens
ttcttcaacagcagcggcagcagcgacgccagcatcggcgacccctcgcagtccgacgatcctgacgatcccgacgaccccgacttccccggcagcccggwgaggcggcggcggaggtgtcccggcggccgagtgcccaaggaccggcccagcctgaccgtgaccccaaagcgctggaagctgcgagctcgcccaagccta

SEQ ID NO: 65861 - DNA, 201 bp, Homo sapiens
acaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaag

SEQ ID NO: 65862 - DNA, 201 bp, Homo sapiens
gcaacggaaacctctctcctccattcccaccgctttaaaaagggccaaaagctgggaaaagattcgttccccacccaggacctgactcctttacagaatgyctgcttttggaccaaaaccagggcttccttcagtttccacaagaagaaaattgtgactgatgtgtcagaggtctgcagcatctataccactgccacttct

SEQ ID NO: 65863 - DNA, 201 bp, Homo sapiens
tgctctgccagcacagtctgtttaagtaagctaaatgtatcttactgccccgaaatgagaggagactggtcttgaagcctctggtgctgtttcaacctccrtccccacaggagggtggaactcccattctcacaggtttccagtcagcttttcaaacaagaattttgtttccaaatggaaactgaaatatttgttgaaatg

SEQ ID NO: 65864 - DNA, 201 bp, Homo sapiens
ttcaaacaagaattttgtttccaaatggaaactgaaatatttgttgaaatgtttaaatttgctgataacaaatgttctgaaagaagtaaactagccgggcrcagtggcgtgcgcctgtagtcccagctactcgggaggctgaggcaggaggatcgcttgagcccaagagttcatatctagcctggtcaacatagcaagacc

SEQ ID NO: 65865 - DNA, 201 bp, Homo sapiens
ggaggaaaactgacaggttgctttaagagctgagtgattgagagtccttctgaacaggacttcgggaatttactcctaatcttttcccatggttaacttgycttcactctgtttctagaactctggtttttatacttgagactctgtagtcactgtggaaagaggtgtgactgataaagaactgcctttaaatacctgagt

SEQ ID NO: 65866 - DNA, 201 bp, Homo sapiens
gagtcacaccgctgctggcctcttgggagtactcacttggacagaactgcaacgaagccatgcctgaattgaagggtgtgggtctcgttggccaaagaccrtctttcattggaactaggaataagagtgttagttcatagcacacctgctttgtacatagcaagtgcttcttaaaaagggcttcgctctgttgcccaggca

SEQ ID NO: 65867 - DNA, 201 bp, Homo sapiens
gtcccacagctgccttcttccctccacagcgtcatattaattcccttttgtagcacgactagttggcaatacacctcctttgatgaccacagtggggtttytgtgacccaaatgttagcaccctagagatcaatatcagagcctgggttctaagcaggctcctctcagaaggacagtgtccacattcatcctgaccaccag

SEQ ID NO: 65868 - DNA, 201 bp, Homo sapiens
cctcttgaggacggggtgaccaatcctgcagttcatgatcaggacagaagcaaccggctgagggtcatcacactgaatgtttggagagggaggctgttaamagagcagatgacattctcttaaagagccaaacaaaacaaaacaaaaacgtggtttcctcacagcaattcagcaaacattcactaatttttctgcctgtca

SEQ ID NO: 65869 - DNA, 201 bp, Homo sapiens
tcaagaccagcctggccaacatggtgaaatccctgtctctattaaaaattttttaaaaattagctgggcctggtggtgtccacctgtagtctcaactactygggaggctgaggcaggagaatcgcttgaacctgggcggcagaggttgcagtgagccgagatggcaccactgcactccagcctgggcgacagagtgagact

SEQ ID NO: 65870 - DNA, 201 bp, Homo sapiens
acacactgcagtcaagcgaagcgcaaagctggaaccgagagattgagatgagaccaagatgcagaagacgccaactgcagggtggtgagaagagcgaatcrgtccaaaccgactcacagatgacctcttgaggacggggtgaccaatcctgcagttcatgatcaggacagaagcaaccggctgagggtcatcacactgaat

SEQ ID NO: 65871 - DNA, 201 bp, Homo sapiens
atcaaaacaggcacagcctctggtgggcagaatcacctccctttgagaactcttcccagcagcgttccccaccttaccccccaacacagaggtcttgcagrtaacatagctatcccaagctattccaaagctgagtgaacgagaaccagaactccagggctcattccaccaggctgtaccacagttttactttgtgtgtga

SEQ ID NO: 65872 - DNA, 201 bp, Homo sapiens
caacctctgcctcctgggtttaagtgattctcctgcctaagcccccaagtagctgagattacaggcgcctgccaccacacctggctaattttcatattttyagtagagacggggtttcgccatgttagccaggctggtcttgaactcctgacctcaggtgatccacccacctcagcctcccaaagtgctgggatgacaggc

SEQ ID NO: 65873 - DNA, 201 bp, Homo sapiens
tcccaggctcaagtgatcctccacctcagcctgcgaaagtgttgggatgacaggcatgagccactacactcatccctttttttttttttttttttttgagstggagtcttgctctgttgcccaggctggagtgcagtggtgcgatctcagctcactgcaacctctgcctcctgggtttaagtgattctcctgcctaagccc

SEQ ID NO: 65874 - DNA, 201 bp, Homo sapiens
cagtttccacaagaagaaaattgtgactgatgtgtcagaggtctgcagcatctataccactgccacttctctctctggatccctcctatcagaatgttcaraccggcctgtcatgaacagaacaagtggtgctccgtcctcttggcactcctcctctatgtatttgctaagccccttaaacactctaagtatttcaaacaa

SEQ ID NO: 65875 - DNA, 201 bp, Homo sapiens
acagctttacaataataagtacttacatggaagaggaattctttgtggtgagaaagcccctggcctgtgttcacgtacattatggatggtctgcaattgasaggacatgcgtcagcccttgaggagtctttctcccttttttggagacagggtctcactctgttgcccaggctagagcacagtggaacaatcatggctcag

SEQ ID NO: 65876 - DNA, 201 bp, Homo sapiens
gagtcactgtaagtcaggggcttattgtcaggaactacttaacactttgcttaggatattggatttaaagaaaggaattttggggaatccatgctatagarataaaagtatcagtaagtaagagggggaaacatacaaatttaaaatgtgcacataagaaacttaatagtaactcctccctgctgggggcatgggaaggga

SEQ ID NO: 65877 - DNA, 201 bp, Homo sapiens
ttccctttcttgtggctgaaatgcatttggatacagtttgtttatactcatagagtcactgtaagtcaggggcttattgtcaggaactacttaacactttrcttaggatattggatttaaagaaaggaattttggggaatccatgctatagaaataaaagtatcagtaagtaagagggggaaacatacaaatttaaaatgt

SEQ ID NO: 65878 - DNA, 201 bp, Homo sapiens
aaactgtttcatccctgaaaagggaaggcacatgaagaaaaatccaacatccttttgctactgacttcttgcttcctgttttgtatcctgccatgtgaaartacagcatttggagatgtggcaactttgtgctggccatgaaggaatgcgtcccccacacggcagagtacaaggaccaaagaagccaggccatcgccccag

SEQ ID NO: 65879 - DNA, 201 bp, Homo sapiens
atcttttcccatggttaacttgtcttcactctgtttctagaactctggtttttatacttgagactctgtagtcactgtggaaagaggtgtgactgataaakaactgcctttaaatacctgagtcctcgtcagcttcttcactgctacaacctggagacctcgtaatttggttgggacgcaaatttgcaactggtattctgc

SEQ ID NO: 65880 - DNA, 201 bp, Homo sapiens
cagcagcgacgccagcatcggcgacccctcgcagtccgacgatcctgacgatcccgacgaccccgacttccccggcagcccggtgaggcggcggcggaggygtcccggcggccgagtgcccaaggaccggcccagcctgaccgtgaccccaaagcgctggaagctgcgagctcgcccaagcctaaccgtgaccccaagacg

SEQ ID NO: 65881 - DNA, 201 bp, Homo sapiens
agcaatttcagcgctcacctcggcccaagcgaagctccagcgggagcaattgagacccagggacgaagctagggagggcctggcagcccccggcactggcmggcaggggtaacccaggaaaaacagtctcctggcctctcgttacccgcttcaggccctccgccctcccctggcctctcgggacggccgcgcttacctgaa

SEQ ID NO: 65882 - DNA, 201 bp, Homo sapiens
agcctcccgagtagctggaattatgggcatgtgccaccatgccaggctaatttttgtatttttagtagagatggggttttgccatgttggccaggcttgtytcgaactcctgacctcagatgatctacccacctcggcctcccaaagtgctgggattacaggcgtgagctgccgcgcctggccttttcttcaacttctttt

SEQ ID NO: 65883 - DNA, 201 bp, Homo sapiens
taatcccagctactcgggaggctgaggaagaagaatcacttgaactggggaggtggaggttgcagtgagccgagatggcaccaacggactccagcctgggbgacacagtgagattcttcctcaaaaaaaaaaaaaaaaaagaaagaaaagaaaagaaaaagaaatacactacttaaaaataaaaggaaatgttatattggc

SEQ ID NO: 65884 - DNA, 201 bp, Homo sapiens
tcgagttccttgtactgtaactggagtatatctccctcctgagggtagctaaggaacgggttgggacagagggttggttttttgcaccaaaagatctattwtggacatggacatgttatgcaaagatgctattatctcttctaggggcgatgcccgtgagcaactggataatcaaatctggagcatttcagtctcaaacac

SEQ ID NO: 65885 - DNA, 201 bp, Homo sapiens
tccaaatggaaactgaaatatttgttgaaatgtttaaatttgctgataacaaatgttctgaaagaagtaaactagccgggcgcagtggcgtgcgcctgtartcccagctactcgggaggctgaggcaggaggatcgcttgagcccaagagttcatatctagcctggtcaacatagcaagacccctgtctctatttttttaa

SEQ ID NO: 65886 - DNA, 201 bp, Homo sapiens
ggccagatgtgagtagaagaaatgtccctatttctcaaagccacctccctttatcttcttctaaacccacagattcccaaaagtgccccaaagatgcccargtagaggttaagggagaagcaaggcaccgggtactactgtttgcagcaaacacggatgctggcctgcccaggggcccctctctcctttcggattttattc

SEQ ID NO: 65887 - DNA, 201 bp, Homo sapiens
tgcggaaagtctgaaatctttttaacacttcggacacagagcatcgtaaggtcccagaatagagggtgtgagcaatttcagcgctcacctcggcccaagcraagctccagcgggagcaattgagacccagggacgaagctagggagggcctggcagcccccggcactggccggcaggggtaacccaggaaaaacagtctcc

SEQ ID NO: 65888 - DNA, 201 bp, Homo sapiens
tcacacagagaagcagaatttatcaattttcaaagggaaaatgtctctgtctactgacaaggttttaatttttgcttttttttttttttgagatggagtckcactctgtctcccaggctggagtgcagtggcaggatctcggctcactgcaagctccgcctcccgggctcacaccattctcctgcctcagcctcccaagta

SEQ ID NO: 65889 - DNA, 201 bp, Homo sapiens
ctgaggcaaagcagagaccaaaaaagagtctcaggggagaagaagggaagctagtaagcaacttatagggggcagtgtaagaaatgtcacatgttacatcrctcacacagagaagcagaatttatcaattttcaaagggaaaatgtctctgtctactgacaaggttttaatttttgcttttttttttttttgagatggagt

SEQ ID NO: 65890 - DNA, 201 bp, Homo sapiens
caagatggtgaaaccccatctctactaaaactacaaaaattagctgggcgtggtggcgggcgcctgtaatcccagctactcgggaggctgaggcagagaaytgcttgaacctggaggcagaggttgcagtgagccgagatcacgccacagcactccagcctgggcgacagagcgagactcgtctcaaaaaataaataaata

SEQ ID NO: 65891 - DNA, 201 bp, Homo sapiens
gcctgttgcttcaggtatcaaggctagctttgggaaccagactacagatgagacaactgaaagcaaagaggctgaggcaaagcagagaccaaaaaagagtytcaggggagaagaagggaagctagtaagcaacttatagggggcagtgtaagaaatgtcacatgttacatcactcacacagagaagcagaatttatcaatt

SEQ ID NO: 65892 - DNA, 201 bp, Homo sapiens
caagtactgccttgctctggccatgaaaaaagtatggattttagtctaagtgtgctcaagcatcagttttgtttgtttgttatttttaataagcaggggartggcacaatctaatgtctgctcttagaagacggatagctgttacgtgggaattatttgtaaagaatgtgggaaaagcagaggcaagaaaggcaggccgaa

SEQ ID NO: 65893 - DNA, 201 bp, Homo sapiens
tgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagag

SEQ ID NO: 65894 - DNA, 201 bp, Homo sapiens
ctactttcagagccagcttagccactgtaagcactgctggggacacactgcagtcaagcgaagcgcaaagctggaaccgagagattgagatgagaccaagrtgcagaagacgccaactgcagggtggtgagaagagcgaatcggtccaaaccgactcacagatgacctcttgaggacggggtgaccaatcctgcagttcat

SEQ ID NO: 65895 - DNA, 201 bp, Homo sapiens
gtctcactctatcactgaggctggagtggagtggtgtgatctcggctcactgcaacctctgcctcccagattcaagcgattctcgtgcctcagcctcccargtaggtgggattacaggcacccaccatcatgtccggctaatttttgtatttttggtagacagggtttctccatgttggccaggcttgtgttgaacttctg

SEQ ID NO: 65896 - DNA, 201 bp, Homo sapiens
atggccctaacgtacacaacactacataaagttacccaaacaagacatctgcagttattcttcaacttccttttttttttttttgagatggagtttcgctytttcgcccaggctggagtgaagtggtgcgatctcggctcactgcaacctccaccccgtcaggttcaagcgattctcctgccttagcctcccgagtagctg

SEQ ID NO: 65897 - DNA, 201 bp, Homo sapiens
ggggaaaggaatgagggaaacaaaacatattttagacatgaactcactgtgtttgaacagccttcaccacctttccctttaaaggtattcctgggcttagktaatggccctaacgtacacaacactacataaagttacccaaacaagacatctgcagttattcttcaacttccttttttttttttttgagatggagtttcg

SEQ ID NO: 65898 - DNA, 201 bp, Homo sapiens
tcaccatgttggccaggctggtctcgaactcctgacctcaaatgatccacccacctcggtctcccaaagtgctgggattacaggcatgagccaccgcgccyggccccgttatttcagttaagcctcaaatacaaatatggagtaagcaaggcaggcggcctcattccccttttacaggtgaagaagccacttcagagattt

SEQ ID NO: 65899 - DNA, 201 bp, Homo sapiens
aactgcttgaacctggaggcagaggttgcagtgagccgagatcacgccacagcactccagcctgggcgacagagcgagactcgtctcaaaaaataaataaataaataaaaggctttcagagataagcaattggagttcagaattgtctctagaagaccacacttagaagaatactgattttaaaagggcttctcagcctcc

SEQ ID NO: 65900 - DNA, 201 bp, Homo sapiens
tcaaacaaaaaggcatctgatgctgaaaaggtttatggggaatgcagtcagaagggtcctgtcccctttagccattgccttcccacagaaaaactgcaackctgtgagaagattggggaaggggtgtttggcgaagtgtttcaaacaattgctgatcacacacccgtagccataaaaatcattgctattgaaggaccagat

SEQ ID NO: 65901 - DNA, 201 bp, Homo sapiens
agagaactgcttgaacctggaggcagaggttgcagtgagccgagatcacgccacagcactccagcctgggcgacagagcgagactcgtctcaaaaaataaataaataaataaaaggctttcagagataagcaattggagttcagaattgtctctagaagaccacacttagaagaatactgattttaaaagggcttctcagc

SEQ ID NO: 65902 - DNA, 201 bp, Homo sapiens
aaccagggcttccttcagtttccacaagaagaaaattgtgactgatgtgtcagaggtctgcagcatctataccactgccacttctctctctggatccctcytatcagaatgttcaaaccggcctgtcatgaacagaacaagtggtgctccgtcctcttggcactcctcctctatgtatttgctaagccccttaaacactct

SEQ ID NO: 65903 - DNA, 201 bp, Homo sapiens
tcgggaggctgaggcagagaactgcttgaacctggaggcagaggttgcagtgagccgagatcacgccacagcactccagcctgggcgacagagcgagactcgtctcaaaaaataaataaataaataaaaggctttcagagataagcaattggagttcagaattgtctctagaagaccacacttagaagaatactgatttta

SEQ ID NO: 65904 - DNA, 201 bp, Homo sapiens
agtagagatggggtttcaccatgttggccaggctggtctcgaactcctgacctcaagtgatctgcctgccttggcctcccaaagtgctgggattacaggcrtgagccactgcgcctggctatttttttaagttccagggtacatgtgcagatgtgcaggtttgttacataggtgaacgtgtgccatggtgctttgctgcag

SEQ ID NO: 65905 - DNA, 201 bp, Homo sapiens
aggaataagagtgttagttcatagcacacctgctttgtacatagcaagtgcttcttaaaaagggcttcgctctgttgcccaggcaggagtgcagtgttgcygtctcagctcactgcaacctccgccccccgggttcaagcaattctcatgcctcagcctcctgagtagctggaattacaggcgtgagccaccatacccagt

SEQ ID NO: 65906 - DNA, 201 bp, Homo sapiens
ggtggctcatgcctgtcatcccagcactttgggaggtcgaggcaggtggatcacttgaggacaggagtttgagaccagcctggccaacatggtgaaacccyatctctaccaaaaatattttaaaaattagccgggtgtagtgctgcacgcctgtaatcccagctactcaggaggctgaggaaggagaatcacttgaacccg

SEQ ID NO: 65907 - DNA, 201 bp, Homo sapiens
gcatgagccaccacacccagcttattcattttatttaacgtaagagatttttcctttttttttttttttttttttttttttgagacaaggtctcactctgwtacccgggccggaatggagtggctcaatcatagctcactgaagcttcaaattcctgggctcaaacgatactcctgcctcagcctcccaagtagctgggac

SEQ ID NO: 65908 - DNA, 201 bp, Homo sapiens
tggcagagccaagatcagaagtgttaaggctgaaaacaggaagagggcaacagaatgtctgtggaggtgctcaaaggttaggcacaattttccttgggcastactcagaagccagccaggaattaccttagttctgtggttctctgcattcagtccctcatatagagatttgttgaaagatatttcaccaaggatctgcag

SEQ ID NO: 65909 - DNA, 201 bp, Homo sapiens
atttcagtctcaaacacctcctcagagtgatcccaggagatctctgcagccacggtgacattttctttatctgaagcgatgacacagctcactgaatgccmttcttccacatgctggaaaagcgaggtctagtgaacacaattcctttccgtgcggaaagtctgaaatctttttaacacttcggacacagagcatcgtaag

SEQ ID NO: 65910 - DNA, 201 bp, Homo sapiens
aaagatgcccaagtagaggttaagggagaagcaaggcaccgggtactactgtttgcagcaaacacggatgctggcctgcccaggggcccctctctcctttyggattttattcaggaatcatcgttggtctcaggtgatcatgacacagctattctcctttgccagtgactgacatgagattcagatctcactaataagatg

SEQ ID NO: 65911 - DNA, 201 bp, Homo sapiens
ccacagtgctgagattacaggcatgagccaccacacccagcttattcattttatttaacgtaagagatttttcctttttttttttttttttttttttttttgagacaaggtctcactctgttacccgggccggaatggagtggctcaatcatagctcactgaagcttcaaattcctgggctcaaacgatactcctgcctca

SEQ ID NO: 65912 - DNA, 201 bp, Homo sapiens
actgtaactggagtatatctccctcctgagggtagctaaggaacgggttgggacagagggttggttttttgcaccaaaagatctattttggacatggacaygttatgcaaagatgctattatctcttctaggggcgatgcccgtgagcaactggataatcaaatctggagcatttcagtctcaaacacctcctcagagtga

SEQ ID NO: 65913 - DNA, 201 bp, Homo sapiens
ccacaggtgcaccccaccacactgggctaatttttgtattttttgtagagatggggttttaccatgttgcccaggctggtctcaaactcctgggctcaagyaatccacccaccttagcctcccacagtgctgagattacaggcatgagccaccacacccagcttattcattttatttaacgtaagagatttttcctttttt

SEQ ID NO: 65914 - DNA, 201 bp, Homo sapiens
atgcctgtcatcccagcactttgggaggtcgaggcaggtggatcacttgaggacaggagtttgagaccagcctggccaacatggtgaaaccccatctctaycaaaaatattttaaaaattagccgggtgtagtgctgcacgcctgtaatcccagctactcaggaggctgaggaaggagaatcacttgaacccgggaggcgg

SEQ ID NO: 65915 - DNA, 201 bp, Homo sapiens
ctttgagaactcttcccagcagcgttccccaccttaccccccaacacagaggtcttgcagataacatagctatcccaagctattccaaagctgagtgaacragaaccagaactccagggctcattccaccaggctgtaccacagttttactttgtgtgtgaacaaaagaacattttcattatctctggtaacaagaagaga

SEQ ID NO: 65916 - DNA, 201 bp, Homo sapiens
ctgatacagcacactaagacagttactggatacaaaaaacaatttctcacttaggtaattcattttttatttatttatttattttttgagactgagtctcrctctatcactgaggctggagtggagtggtgtgatctcggctcactgcaacctctgcctcccagattcaagcgattctcgtgcctcagcctcccaagtagg

SEQ ID NO: 65917 - DNA, 201 bp, Homo sapiens
gatgtcctactgaacacccccctccccaagtcatggcaatcaaaacaggcacagcctctggtgggcagaatcacctccctttgagaactcttcccagcagygttccccaccttaccccccaacacagaggtcttgcagataacatagctatcccaagctattccaaagctgagtgaacgagaaccagaactccagggctca

SEQ ID NO: 65918 - DNA, 201 bp, Homo sapiens
tcctgagtactgtttaatactataactaaacactgatacagcacactaagacagttactggatacaaaaaacaatttctcacttaggtaattcattttttwtttatttatttattttttgagactgagtctcactctatcactgaggctggagtggagtggtgtgatctcggctcactgcaacctctgcctcccagattca

SEQ ID NO: 65919 - DNA, 201 bp, Homo sapiens
cctctagtagagaatcatgcctaactaaagagctcagagctcacagatagatcacctctgaagccatgtccaggcaagggtcaacaagaatgaaaacacasggtaacacacaaagcattcagtccacaaatcacaggcatcagtctgacttctagtcatacttttgcaaaaagaattccaagagttccagtatctagtcta

SEQ ID NO: 65920 - DNA, 201 bp, Homo sapiens
cagggtctcactctgttgcccaggctagagcacagtggaacaatcatggctcagtgtagcctcaacctcccaggctcaagtgatcctccacctcagcctgsgaaagtgttgggatgacaggcatgagccactacactcatccctttttttttttttttttttttgaggtggagtcttgctctgttgcccaggctggagtgc

SEQ ID NO: 65921 - DNA, 201 bp, Homo sapiens
agttcccactttagaataagtgatcagggaaggcctctctaagaaaataacacgtgtggccgggtgtggtggctcatgcctgtaatcccagcacttcgggwggctgaggtgggtagatcatctgaggtcaggagttcaagaccagcctgaccaacacgatgaaaccccatctctactaaaaatacaaaattagccgggcgt

SEQ ID NO: 65922 - DNA, 201 bp, Homo sapiens
aacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaat

SEQ ID NO: 65923 - DNA, 201 bp, Homo sapiens
gctggtctcgaactcctgacctcaaatgatccacccacctcggtctcccaaagtgctgggattacaggcatgagccaccgcgcctggccccgttatttcakttaagcctcaaatacaaatatggagtaagcaaggcaggcggcctcattccccttttacaggtgaagaagccacttcagagatttcccacagcacagagat

SEQ ID NO: 65924 - DNA, 201 bp, Homo sapiens
cagcctcccaagtagctgggactacaggcatgagccaccatgcgtggctaatttatgtatttatttatttttaagaaatggggtttcactatgctgcccakgctgatcttgaactcctggcctcaagcaatcctcccgcctcagcctcccaaagtgttgggatgacagatgtgagccaccacactcacaattctttttttt

SEQ ID NO: 65925 - DNA, 201 bp, Homo sapiens
gaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaa

SEQ ID NO: 65926 - DNA, 201 bp, Homo sapiens
gcctcagcctcccaagtagctgggactacaggcatgagccaccatgcgtggctaatttatgtatttatttatttttaagaaatggggtttcactatgctgyccaggctgatcttgaactcctggcctcaagcaatcctcccgcctcagcctcccaaagtgttgggatgacagatgtgagccaccacactcacaattctttt

SEQ ID NO: 65927 - DNA, 201 bp, Homo sapiens
tgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttcta

SEQ ID NO: 65928 - DNA, 201 bp, Homo sapiens
caaattcctgggctcaaacgatactcctgcctcagcctcccaagtagctgggactacaggcatgagccaccatgcgtggctaatttatgtatttatttatytttaagaaatggggtttcactatgctgcccaggctgatcttgaactcctggcctcaagcaatcctcccgcctcagcctcccaaagtgttgggatgacaga

SEQ ID NO: 65929 - DNA, 201 bp, Homo sapiens
gtggttcatgcctatcatcccagcactttgggaggccgaggcaggcggatcacctgaggccaggagttcaagaccagcctggccaacatggtgaaatcccygtctctattaaaaattttttaaaaattagctgggcctggtggtgtccacctgtagtctcaactactcgggaggctgaggcaggagaatcgcttgaacctg

SEQ ID NO: 65930 - DNA, 201 bp, Homo sapiens
tcgccatgttagccaggctggtcttgaactcctgacctcaggtgatccacccacctcagcctcccaaagtgctgggatgacaggcgtgagccaccgcaccyggccttctctttttgaatgaactcgactgctttcaactgaatacattaggacagagggcaccagacctttaccaggaatgaggccgggtgcagtggttca

SEQ ID NO: 65931 - DNA, 201 bp, Homo sapiens
gcctgggtgacagaatgaaactccatctcaaaaacaaacaaacaaaaaaactttttgtctgacacgccctccatactacccacaacttcactctgcttcayggaggtgagcaggcagttcacctagggctgtgtactggaaagctctcgtccccatcaccccctactttcagagccagcttagccactgtaagcactgctg

SEQ ID NO: 65932 - DNA, 201 bp, Homo sapiens
accacacctggctaattttcatattttcagtagagacggggtttcgccatgttagccaggctggtcttgaactcctgacctcaggtgatccacccacctcrgcctcccaaagtgctgggatgacaggcgtgagccaccgcacccggccttctctttttgaatgaactcgactgctttcaactgaatacattaggacagagg

SEQ ID NO: 65933 - DNA, 201 bp, Homo sapiens
aacctcccaggctcaagtgatcctccacctcagcctgcgaaagtgttgggatgacaggcatgagccactacactcatccctttttttttttttttttttttgaggtggagtcttgctctgttgcccaggctggagtgcagtggtgcgatctcagctcactgcaacctctgcctcctgggtttaagtgattctcctgcctaa

SEQ ID NO: 65934 - DNA, 201 bp, Homo sapiens
caacctcccaggctcaagtgatcctccacctcagcctgcgaaagtgttgggatgacaggcatgagccactacactcatccctttttttttttttttttttttgaggtggagtcttgctctgttgcccaggctggagtgcagtggtgcgatctcagctcactgcaacctctgcctcctgggtttaagtgattctcctgccta

SEQ ID NO: 65935 - DNA, 201 bp, Homo sapiens
atggcttggattttcttgctattatttttatttgttaaaatctgggcagtgcaataatggggcacttctatttcttccgttttctgtattttccatttccytctattttctgtattagaaatacactacttagccggacatggtggctcatgcctgtaatcccagcactttgggaggtcaaggcgggcagatcacctgagg

SEQ ID NO: 65936 - DNA, 201 bp, Homo sapiens
ccccaaagcgctggaagctgcgagctcgcccaagcctaaccgtgaccccaagacgcctggggctgcgagctcggcccccgcagaagtgcagcacaccctgyggcccgctccgacttccgcccttccccagccgcgactccggccgcctcagcccggacctcagcgtgtgcggccagcccagggacggcgacgagctgggca

SEQ ID NO: 65937 - DNA, 201 bp, Homo sapiens
aatccctcgagttccttgtactgtaactggagtatatctccctcctgagggtagctaaggaacgggttgggacagagggttggttttttgcaccaaaagayctattttggacatggacatgttatgcaaagatgctattatctcttctaggggcgatgcccgtgagcaactggataatcaaatctggagcatttcagtctc

SEQ ID NO: 65938 - DNA, 201 bp, Homo sapiens
tctctggcctcgccctgccccgggtccccaacgccaagggacagtgtcatctcgatcggcacctccgcctgtctggttgcagcctcagccgtcccgagcgrcctccacctcccagaagtctccctggaccgagcatctctcccctgctcccaggaggaagcgacaggaggagccaaggacaccaggatggtccaccaaacc

SEQ ID NO: 65939 - DNA, 201 bp, Homo sapiens
tcctctccttaagaccttctgggccttgcagatcccaactcaacatcagttcggccactagattcttgctgacctcccccaggagatgccaagggcagggmggccctgatccccctgaaccctccaaccaggggaatcaggaccacacccctgatcttcctccccttcctctcttcctctcccttggcctcccctacctcc

SEQ ID NO: 65940 - DNA, 201 bp, Homo sapiens
cacagtggtgcgatagcacctcctggtggtcacttgaagtggtgcactcagcagcaagttccatctttcacccacttgccaggcctggcatttaagatttygtctccaagggaccagggaggccccagtttgagagaggaggctccgatcaatccagggtgctacttgttaggaggtcaagtaaagggcttgatggggagc

SEQ ID NO: 65941 - DNA, 201 bp, Homo sapiens
agccaacccgaagcaccgtctgggtgtgtgttccattgtgggtctctccggcattaggggttagggcttgcataggaaaagtggctcagtgttcatgtgtkgggttctgccagccactgggccactgccaggaagcccgactctgcatccaggtgatgccaacacatcctgctcagcccagtaagaatccagttcctcagg

SEQ ID NO: 65942 - DNA, 201 bp, Homo sapiens
acctcccccaggtccttctgaaaaagggccaagctcactggactcttgagacccacctgtcatcgctgtccctgctacaggcagccacaccagtgtgaccycagtgccttctttatgggccaaggggctccgagcgtctcctaaaccccagatccctccctttcctcccggaactcccaggggtcggcggccccacagggg

SEQ ID NO: 65943 - DNA, 201 bp, Homo sapiens
attgtaagtctcttgctttctttttggatcgtcctcattttggcttttctgggctcatggaggaggcagggccaggcattgggcctctcccattgggagtrgggagggcacaggccaggcccttgaccatctgcccggcctggtgaggttgggggttggatgtggttggctggccgtgatgaaacaacctgagttgccacc

SEQ ID NO: 65944 - DNA, 201 bp, Homo sapiens
agaggacaagaagctcctatttgatttcccacgtcctgcaggctgcttcacttctgtccaggcaccagcacctcccccaggtccttctgaaaaagggccawgctcactggactcttgagacccacctgtcatcgctgtccctgctacaggcagccacaccagtgtgaccccagtgccttctttatgggccaaggggctccg

SEQ ID NO: 65945 - DNA, 201 bp, Homo sapiens
aacacaggctaaggaaccaaactgaatccagttcaaattccaagctctgccattcatcctctgtgggatcttagacaagcaacttcacctctctcagcctwggtttcttcatctgtagaatggtcattgcctgccccccatgggtggttgtgtggttcagtgaggagacagatatcagaggtcacacagtggcccccctgg

SEQ ID NO: 65946 - DNA, 201 bp, Homo sapiens
acatatcaagaacctgtcttttcaaaaaacttaaaaattagtgaggcatggtggcatgtacctatttggtcccagctattcgggaggctgacgtgggaggmtcacttgagcccaggaggtggtggctgcaatgaaccaggatcacacccctcactgcactgcagcctgggcaacagagtgagaaccaatctcaaactaaaa

SEQ ID NO: 65947 - DNA, 201 bp, Homo sapiens
acctggagttggcctgactctaaaacgatgcatgcctcaccatggcgcattgctcctttaaagagcaccagaagagagaatttgacaaagtggttgcccgyggggcctgggatgggtggggaaactatgctagggctctgggctgctgagggcctgagggaaggaatggggagcccgggcgcagaagtagaggagggggct

SEQ ID NO: 65948 - DNA, 201 bp, Homo sapiens
tccacattctggtccgcagggctcagctctgctttctagacttccaaataggaagaagagggaaagttcccagtctctgggcacaaccaagaacagagagyaagttctgactcagcagagggattgattcattccatgcaaagagctgcactgccaaggctgacacgagccagggactcagcacacggcatcacacccagt

SEQ ID NO: 65949 - DNA, 201 bp, Homo sapiens
catccttaagttctgtgccggcagctttaacccctcctgtaggccctcagagcgctgacatctccaggctgctgggctgcaccgccaccctgtccttcttygcctcgtaaggaaatacagcaccaaagatatcttcgtgatagcgcttctggctcttttaggtaaaaacagagagcaacgtgtcaagtccaggctgggatg

SEQ ID NO: 65950 - DNA, 201 bp, Homo sapiens
ttccacatcaacccgcactctgggaaccacatcgccttccacctcaatccccgttttgatgagaacgctgtggtccacaacacccagatcaacaactcttrggggtctgatgagaggggcacagctggggagaggtggggagtgggcagtgaagatgaagccccatgctcagtcccctcccatcccccacgcagctccacc

SEQ ID NO: 65951 - DNA, 201 bp, Homo sapiens
cttccacctgggcgagcttgggcaagttgcttaatctttctaagcctcattacctcaccagggacacaggagctgaggctgcttccctcattggaaagcastgaaacccaggaatcagcccacagtaggccttcaacaaataccacttctcaccttagtggtaaaatatggcactggaagtaatgctcttggctgtgggag

SEQ ID NO: 65952 - DNA, 201 bp, Homo sapiens
atgcatgcctcaccatggcgcattgctcctttaaagagcaccagaagagagaatttgacaaagtggttgcccgtggggcctgggatgggtggggaaactaygctagggctctgggctgctgagggcctgagggaaggaatggggagcccgggcgcagaagtagaggagggggctgccccacggctacagaaggcatctggg

SEQ ID NO: 65953 - DNA, 201 bp, Homo sapiens
agtaggtctctgggcttgagaagcctgtgggtaagtcagtccgagtatgcttatctgagataaggatgtccccatccactcagtatgcaacctgaggtcasctctcctctgctccccatgagcattttatgcatatataaataatacccctgcagccataaaaaggaacgagatcatgtcctttgcaggaacatggatgga

SEQ ID NO: 65954 - DNA, 201 bp, Homo sapiens
ggagatattagagaagacattaaaaacttgaagaatgtgaaaatcagccaggagatagaactgtgctttaatgagggttatagaaccacactggatatgargcattttgggaataaactttgaaaattggaagtaccagtttgtgaattttgctcagagagatgaaggtggggggtgggtgacagtggtgaagcatctcct

SEQ ID NO: 65955 - DNA, 201 bp, Homo sapiens
tcagcgacattgttccagccttcatccagggtctattaagggtatagttttgtaagcaaattgcaaattacctttgcaagcagagtaggtctctgggcttsagaagcctgtgggtaagtcagtccgagtatgcttatctgagataaggatgtccccatccactcagtatgcaacctgaggtcacctctcctctgctcccca

SEQ ID NO: 65956 - DNA, 201 bp, Homo sapiens
ctcagcctcccaaatagctgggattaaaggtgtgtgccacatctggctaatttttttatttttttgtagagatgggggtcccactatgttgcccaggctgrctggcctcaaactcctggtctcaagtgattgttttgcctcggcctcccaatgtcctgcaattatagatgtgagccactgtgcccagccaggaactttaac

SEQ ID NO: 65957 - DNA, 201 bp, Homo sapiens
cccagattttctggggctttcacgatgccaggtgtgtacactgagctaggatgggtttcccagggttctttgtggtcacacaactcaacaatacagaccaraaagcagtggcgagtaggctgaatttggctggtgggtgttttctgtttggtctgcacagtgtttaacttgttattataggaaattcaaacatgcagagag

SEQ ID NO: 65958 - DNA, 201 bp, Homo sapiens
agagaagtcagagacacaaagaagctgtgatttgcttgaggtcactaaagtacttaatggcagagttcagacctgacctgaggggcaacaaaagacacccscctcaaatccatggggagcagagtctatctgaatcagatcccagattttctggggctttcacgatgccaggtgtgtacactgagctaggatgggtttccc

SEQ ID NO: 65959 - DNA, 201 bp, Homo sapiens
ccttgtgtgtacttgcgagcccatgtccatcacgctctgccttcaattctggatgctgtgctgtgaatacgcttgagtggaggccgcatgctttccaggarggtgtgtattttcagtgttgtctctcatgatagtatgaaaggctctggagggaatcacaggcctccacaaacaggcaagcggaaaaatgttccacagaca

SEQ ID NO: 65960 - DNA, 201 bp, Homo sapiens
atgcaagtccatagcctccccccacccactttttatacaagtggcatcattccatatcagtgctcagttccatcttcctctttttcttttctttttaaggytacacagaacctattatatggaaataccctaatttatttcacttttttcctgttggaagacttttaagctctttccaatgctttgctttataatcttttg

SEQ ID NO: 65961 - DNA, 201 bp, Homo sapiens
aagagctgcactgccaaggctgacacgagccagggactcagcacacggcatcacacccagtcctctccagaactctgccacgtagtgttaccatcctgccrttcagaggagggaagtggggcacaggcaggtcaagcaacttggccaatgtctgaattgctagtgtacggagctgggaggggagcccatggggccataaat

SEQ ID NO: 65962 - DNA, 201 bp, Homo sapiens
tcccattgggagtggggagggcacaggccaggcccttgaccatctgcccggcctggtgaggttgggggttggatgtggttggctggccgtgatgaaacaayctgagttgccaccccgtgggcagccacggaagaccatgccccacattcacttctgtcacctgcaaagggaggctaggctgagagacgtttccccgagagg

SEQ ID NO: 65963 - DNA, 201 bp, Homo sapiens
acagagagcaagttctgactcagcagagggattgattcattccatgcaaagagctgcactgccaaggctgacacgagccagggactcagcacacggcatcrcacccagtcctctccagaactctgccacgtagtgttaccatcctgccattcagaggagggaagtggggcacaggcaggtcaagcaacttggccaatgtct

SEQ ID NO: 65964 - DNA, 201 bp, Homo sapiens
atcttcacagcccccagcccttcaaataaagcccaaattccccagcagggcatacaaattcctcccagtctgaccccaatcaacctcgctgcctcaccccyaaaccacaaagctcacgcagcctctgcagctcactcaaggccctctcgggccaccatgtttttgcatatgctgtccctggtcccggaagcatcctctgcc

SEQ ID NO: 65965 - DNA, 201 bp, Homo sapiens
ggagaaggaaacggggcccactctcctaagaaggcttccttggcctgctccaaacccaagagggtccccagtccctcaggcgaggatgctgtggcccacamtcgcctcgacacgctgccttcccagggaccacatccgtactggccaaggcacagtctcgcatgagactggtggccccagagcaaaacgctttctaagaca

SEQ ID NO: 65966 - DNA, 201 bp, Homo sapiens
ttccctccagcaggggatgccctttgacctctgcttcctgctacagagctcagatttcaaggtgagcaggaaacccctccccacctctcacccccgggtcycccagctctatcaggcgaatgggctttaagtaatcaccttgattgacattcagccagagtgatgctactatacagataacacaatcatttccttgtaagg

SEQ ID NO: 65967 - DNA, 201 bp, Homo sapiens
ctctatcaggcgaatgggctttaagtaatcaccttgattgacattcagccagagtgatgctactatacagataacacaatcatttccttgtaaggtgttaytcatggctgcctagtcatcttatacacctttatctgaatctacaggtgcacctgctgcttcttttactctgaaaataagaactagaggagtcatcacgtt

SEQ ID NO: 65968 - DNA, 201 bp, Homo sapiens
ggctctggctggcaggcagtcttggccagccaggctgagctccccactgtcggggcaagcctgggtgtcctctggtgatgctgagtccagaacaaggctgyccacattctggtccgcagggctcagctctgctttctagacttccaaataggaagaagagggaaagttcccagtctctgggcacaaccaagaacagagagc

SEQ ID NO: 65969 - DNA, 201 bp, Homo sapiens
gtaatcaccttgattgacattcagccagagtgatgctactatacagataacacaatcatttccttgtaaggtgttactcatggctgcctagtcatcttatrcacctttatctgaatctacaggtgcacctgctgcttcttttactctgaaaataagaactagaggagtcatcacgttgctgtttggtggtgtgtgtctttg

SEQ ID NO: 65970 - DNA, 201 bp, Homo sapiens
gaacacggcaggaagttccaggaaggctaacatgaaaagggaggtggatgggggagtccaagggccaaaggctcatgaggtcagcctcacagtggagcccstctagaatgcatgggtgcgcgtgggtgagtgctcgcgcacacatgcgctctcccattgaatttcctggtttcttttcagcagactcccgccaacccacct

SEQ ID NO: 65971 - DNA, 201 bp, Homo sapiens
tgtttgctaatatcagcacttttccttaagcattttctacttatttttagaaaatcatactgtaaaggcaaaatccaataattgcacaaaaacacattagrtccaaattagagaaacaaaaagatgccaaccaagcagtctctgcgacgcaagttgtatgcaagatcccagacaaatgcaaggcagaggcaccgaagccct

SEQ ID NO: 65972 - DNA, 201 bp, Homo sapiens
ggaggtcaagtaaagggcttgatggggagcaacgttgaggaaataagacttgaggctgggggatatcactttcctccatctccccaggccctgtgacctcrgataatgcagagctggctccatccttaagttctgtgccggcagctttaacccctcctgtaggccctcagagcgctgacatctccaggctgctgggctgca

SEQ ID NO: 65973 - DNA, 201 bp, Homo sapiens
gtcgagccccagggaacatttgcagcgcagcccaaatttggccctggccctggggaggatagaaagtgtgctggatacagtcagacagaactggctgccaytttggatttgatgccttccacctgggcgagcttgggcaagttgcttaatctttctaagcctcattacctcaccagggacacaggagctgaggctgcttcc

SEQ ID NO: 65974 - DNA, 201 bp, Homo sapiens
gtaaagctgttaaaaacaggcacatatgttttcctttctcttgggtaattttttagaagtagaaaagccagccaatagaagtagatatttgactgtattamaactcaccaagcagtttttcttattttttttaatttttaaattttttttagccagagtcttgctctattgcccaggctggagtgcagtgtcgtgcactct

SEQ ID NO: 65975 - DNA, 201 bp, Homo sapiens
actctctgctcctgctccacacaggatgcccagtggccccagcactgggcacagagcactgggcccaagaggtgccctgatgggacaaatgtgtgaaggcygagagtctattctgacaccccaggctcagggggtaacgcggccctggggacagaagagcccctctgatggccgtggtggaagcatcggccgccctccagc

SEQ ID NO: 65976 - DNA, 201 bp, Homo sapiens
caggcctgcgccccctgccctaccacaggtctttggaccagcacgaagctccatctgctgctggcacacctggcagccatttcagaggagccatggactgsctggggtgtccctctgtcggggatctgtccaggctgtgacacccaccagctccccactctgagaagagctttccctacaaaacacccacacacgcataca

SEQ ID NO: 65977 - DNA, 201 bp, Homo sapiens
gccgttgctgccagaaactgcggaagggcgcgatgcctgtgccaggcccgatgaggatgcaaggatgggagggatcctcggggaggtggaagccgctggcrctgaagaggacaggagaagagggggccagtcctcagacaccccaggcccacgcacacacaggatggctggggagctgggcctgtgggaggcggtcgtgag

SEQ ID NO: 65978 - DNA, 201 bp, Homo sapiens
tgagggggtggagaggacaagaagctcctatttgatttcccacgtcctgcaggctgcttcacttctgtccaggcaccagcacctcccccaggtccttctgwaaaagggccaagctcactggactcttgagacccacctgtcatcgctgtccctgctacaggcagccacaccagtgtgaccccagtgccttctttatgggcc

SEQ ID NO: 65979 - DNA, 201 bp, Homo sapiens
gtcgctcctctgggagtcctccccgcctggaatattgttggacgctcccccatgaccccacggagtctgtacgtatctgtgccatgccagttcaaagcacyccattgtaactgtgtttgcgttgtctgtccccgtcactccacccccatctccctatgcccatgaggcttcagagggccgggactgtgccttgttcatttg

SEQ ID NO: 65980 - DNA, 201 bp, Homo sapiens
gggaagcctccagccttacccttgtgctgggagtcatggagccgttgctgccagaaactgcggaagggcgcgatgcctgtgccaggcccgatgaggatgcraggatgggagggatcctcggggaggtggaagccgctggcactgaagaggacaggagaagagggggccagtcctcagacaccccaggcccacgcacacaca

SEQ ID NO: 65981 - DNA, 201 bp, Homo sapiens
ccgggctgttgttaccatgttggccaccagagggcgccagggctccaagcccaactggaattctcacttcactcccactagctatttaatagcattatccycactttacagatgaggaaactgaggcccagcgcattcagatcactcatccatagtcacagaactgaaagtgcggatgcagaattccctcagccaatcgga

SEQ ID NO: 65982 - DNA, 201 bp, Homo sapiens
cagcacacgcctaattgcccttccatgctctgcctaaatgtcgctcctctgggagtcctccccgcctggaatattgttggacgctcccccatgaccccacrgagtctgtacgtatctgtgccatgccagttcaaagcaccccattgtaactgtgtttgcgttgtctgtccccgtcactccacccccatctccctatgccca

SEQ ID NO: 65983 - DNA, 201 bp, Homo sapiens
agaggccagggagactctcctgcccccattctacagatggaaaaatggaacacattcacccgacttctcaaagctgccaactggtccaggatgtgcagtarggccatctgacagcccacccagctcagatctcagccactgctaagattctcttggggtccagaacctttctgggcctgattcccctgggtctacctgcca

SEQ ID NO: 65984 - DNA, 201 bp, Homo sapiens
tctgtgcagctgtcctacatcagcttccaggtcagactgtgcacctggcaccggtcccaggggctgggatgcagggcccagcatagctgtgtctaggcccwgctgggtgggcccaagccaatctcctacccaggtcactctggggacaacctctgcttccctgtcccagtacctgcccgccccttctcctctgtcactctg

SEQ ID NO: 65985 - DNA, 201 bp, Homo sapiens
aaacacgccagcttaactcccacccccggggcctttgtacctgctgcccctccagaacagcccagagtgtttccttcagtatccacagggctcctcctcaycatctcaggtttattctcagatgccaccttccagctctgccttccctggccaccctatttaaaattacactccccagcgttccctgggctgtttcctgct

SEQ ID NO: 65986 - DNA, 201 bp, Homo sapiens
ctggggttgcccagcttccctatcacatggaccttcatgagccatctgtcttcccaactgttatacttagattgtgcttgaatctggtttagaccctaacsctgctcagcacctgctctggtgcgggccctctaaccatctccaaagctttacttagcatacccatttcctgcccagcgttcatcccccacccaagatact

SEQ ID NO: 65987 - DNA, 201 bp, Homo sapiens
aggccccagtttgagagaggaggctccgatcaatccagggtgctacttgttaggaggtcaagtaaagggcttgatggggagcaacgttgaggaaataagamttgaggctgggggatatcactttcctccatctccccaggccctgtgacctcagataatgcagagctggctccatccttaagttctgtgccggcagcttta

SEQ ID NO: 65988 - DNA, 201 bp, Homo sapiens
caggtgagctaagactagaaagacaaacctactgcaggaaacaaccagaagaatgaaaagtccaactggagccccgtagagactcgggttgatgcacttcrggtcacacacacgttcctgtaactggccccacactgaagaccagactcaggtcttcattttctagaaagagggtccaggagctcaggggtggtccccatc

SEQ ID NO: 65989 - DNA, 201 bp, Homo sapiens
ttgttcaaggaaaaataaataataaataaatgaaaccccaggtgagctaagactagaaagacaaacctactgcaggaaacaaccagaagaatgaaaagtcyaactggagccccgtagagactcgggttgatgcacttcgggtcacacacacgttcctgtaactggccccacactgaagaccagactcaggtcttcattttc

SEQ ID NO: 65990 - DNA, 201 bp, Homo sapiens
tgcaagcagagtaggtctctgggcttgagaagcctgtgggtaagtcagtccgagtatgcttatctgagataaggatgtccccatccactcagtatgcaacstgaggtcacctctcctctgctccccatgagcattttatgcatatataaataatacccctgcagccataaaaaggaacgagatcatgtcctttgcaggaac

SEQ ID NO: 65991 - DNA, 201 bp, Homo sapiens
ttttttaaagtagagatgagatctcgctgttgctcaggctggtcttcaacttctgggctcaagtgacccacctgccttggcgtcccaaggtgctgtgattmcaggcgtgagccactgcgcccggccccaatttcacatgctctttacatttgttctcttctttcccacttaatcaggcttgtgctagcctccaacaagtgt

SEQ ID NO: 65992 - DNA, 201 bp, Homo sapiens
ttagaaaattttacagaaaaataaaaatccagacttctgtcttctcttaaaaatttggaagctctgccaatactgggcccagatggcaatcactgattagyactgagtagatgttgacttttcagatgaggggtgtgacgtctactttgccacagtccccaccactcccccacctggccatctcacccatacacatcacct

SEQ ID NO: 65993 - DNA, 201 bp, Homo sapiens
ctaacccgcagaggcccgcacagggaagcaaacttgggaggccttccctcgagagaggtcaggaaccgtttgtggggctgcagttctgctcctaggcaggygctggccccctggtgcccctcccacctgggaagcctccagccttacccttgtgctgggagtcatggagccgttgctgccagaaactgcggaagggcgcga

SEQ ID NO: 65994 - DNA, 201 bp, Homo sapiens
accatctccgtcaatggctctgtgcagctgtcctacatcagcttccaggtcagactgtgcacctggcaccggtcccaggggctgggatgcagggcccagcrtagctgtgtctaggcccagctgggtgggcccaagccaatctcctacccaggtcactctggggacaacctctgcttccctgtcccagtacctgcccgcccc

SEQ ID NO: 65995 - DNA, 201 bp, Homo sapiens
agcgcattcagatcactcatccatagtcacagaactgaaagtgcggatgcagaattccctcagccaatcggagatcaaaagcagggactttcctgttaccyccactcccaggagagggagccctggctactatgcgggagacggaaaggcagccattctaacccgcagaggcccgcacagggaagcaaacttgggaggcct

SEQ ID NO: 65996 - DNA, 201 bp, Homo sapiens
aagatatcttcgtgatagcgcttctggctcttttaggtaaaaacagagagcaacgtgtcaagtccaggctgggatgagcccctggggttgcccagcttccytatcacatggaccttcatgagccatctgtcttcccaactgttatacttagattgtgcttgaatctggtttagaccctaaccctgctcagcacctgctctg

SEQ ID NO: 65997 - DNA, 201 bp, Homo sapiens
cctccatctccccaggccctgtgacctcagataatgcagagctggctccatccttaagttctgtgccggcagctttaacccctcctgtaggccctcagagygctgacatctccaggctgctgggctgcaccgccaccctgtccttcttcgcctcgtaaggaaatacagcaccaaagatatcttcgtgatagcgcttctggc

SEQ ID NO: 65998 - DNA, 201 bp, Homo sapiens
ccatccaagtccatcatcctgttgggcactgtcctgcccagtgctcagaggtaagctaagggctccagttgacctctgggaagagagagcccttcaaggtmattccagccattcccctggctttgggcaggctgtggatgacggggaggaaataaggcccagaactcagtggacaaaggtccaggtgggctgcccacccca

SEQ ID NO: 65999 - DNA, 201 bp, Homo sapiens
ctcaccttagtggtaaaatatggcactggaagtaatgctcttggctgtgggagctacagagagcaatgaggtctctatcaaacccagcctcctctctctcragaggaaccaatggggataccctaccccccaaccccaaagccctgtgcacctgggggtaaaaatctgggtgccacgggctcaggaaggcttgcttgggag

SEQ ID NO: 66000 - DNA, 201 bp, Homo sapiens
agctcacgcagcctctgcagctcactcaaggccctctcgggccaccatgtttttgcatatgctgtccctggtcccggaagcatcctctgccagcctgcccycagcacacgcctaattgcccttccatgctctgcctaaatgtcgctcctctgggagtcctccccgcctggaatattgttggacgctcccccatgaccccac

SEQ ID NO: 66001 - DNA, 201 bp, Homo sapiens
ctcgcgcacacatgcgctctcccattgaatttcctggtttcttttcagcagactcccgccaacccacctatgatgtacccccaccccacctatgtaagtgrtttctcagggagggcggaggttctgtttgtggtgggcaggctgggggtgaagggccacttcgggggtatccactagccttgcaaaatgaaaagcgaaggg

SEQ ID NO: 66002 - DNA, 201 bp, Homo sapiens
aggatgtcactaccgatcataggcttaagctcttctcctgctggtgcaaatcaggccggaagtttagcgttagtggggctgcctgcagaggggttgagggrcaggtgaccgtggtggagtccgggaacacggcaggaagttccaggaaggctaacatgaaaagggaggtggatgggggagtccaagggccaaaggctcatg

SEQ ID NO: 66003 - DNA, 201 bp, Homo sapiens
aattgcacaaaaacacattaggtccaaattagagaaacaaaaagatgccaaccaagcagtctctgcgacgcaagttgtatgcaagatcccagacaaatgcraggcagaggcaccgaagccctcctgtgcctgtcactggcaataacccatgccacagaagactatttgctttccctgggcctaggtttgctgtgcgctttc

SEQ ID NO: 66004 - DNA, 201 bp, Homo sapiens
gagatctcgctgttgctcaggctggtcttcaacttctgggctcaagtgacccacctgccttggcgtcccaaggtgctgtgattacaggcgtgagccactgygcccggccccaatttcacatgctctttacatttgttctcttctttcccacttaatcaggcttgtgctagcctccaacaagtgtccactggcatggaaggc

SEQ ID NO: 66005 - DNA, 201 bp, Homo sapiens
gagcagttgggactacaggagtgcactgtgatgcccagctaattaatttttttttaaagtagagatgagatctcgctgttgctcaggctggtcttcaactyctgggctcaagtgacccacctgccttggcgtcccaaggtgctgtgattacaggcgtgagccactgcgcccggccccaatttcacatgctctttacatttg

SEQ ID NO: 66006 - DNA, 201 bp, Homo sapiens
tacgatcatagctcactgcagcctccaattcctgggctcgagcaatcctcccatctcagcctctggagcagttgggactacaggagtgcactgtgatgccmagctaattaatttttttttaaagtagagatgagatctcgctgttgctcaggctggtcttcaacttctgggctcaagtgacccacctgccttggcgtccca

SEQ ID NO: 66007 - DNA, 201 bp, Homo sapiens
ttaattaattattttttttcttttgagacagggacttttttctttgacccaggctggagtgcagtggtacgatcatagctcactgcagcctccaattcctrggctcgagcaatcctcccatctcagcctctggagcagttgggactacaggagtgcactgtgatgcccagctaattaatttttttttaaagtagagatgag

SEQ ID NO: 66008 - DNA, 201 bp, Homo sapiens
tgtctctcccttccttggggcaggaatttccaaaggactacagggatgaagctgaagggctccaaaagaaaaaaatacattcagaggtatttcaaatgtamtcatctccatttattcatttattcatttaattaattattttttttcttttgagacagggacttttttctttgacccaggctggagtgcagtggtacgatc

SEQ ID NO: 66009 - DNA, 201 bp, Homo sapiens
gactgtctgagtaactaattggatttgtgtttgcctccacacaggaccctaagacccgtggggctgcgactccctctgtactggtcacagccgcaccctakccccttgcatggcgctgtcaaacccaggctggccactgactagcgctggaggggagcaaacgggaggccggccacctgactgatggtcccacaccttctc

SEQ ID NO: 66010 - DNA, 201 bp, Homo sapiens
tctgggaagacactttgctgaaggtggccaggagggcaaaggtcacagtggccattgttatatggtggtggtggggagagggggatggcttcttcttaacyttctcgggtgagtcgaaggtttaccctccagacccttgatgggtcccttatgtcccttggacatcctgagtccccagccagggccctgggcgctttgctg

SEQ ID NO: 66011 - DNA, 201 bp, Homo sapiens
ttcgtgcagtacttccaccgcgtgcccttccaccgtgtggacaccatctccgtcaatggctctgtgcagctgtcctacatcagcttccaggtcagactgtscacctggcaccggtcccaggggctgggatgcagggcccagcatagctgtgtctaggcccagctgggtgggcccaagccaatctcctacccaggtcactct

SEQ ID NO: 66012 - DNA, 201 bp, Homo sapiens
aaggcatctgggaagacactttgctgaaggtggccaggagggcaaaggtcacagtggccattgttatatggtggtggtggggagagggggatggcttcttcttaaccttctcgggtgagtcgaaggtttaccctccagacccttgatgggtcccttatgtcccttggacatcctgagtccccagccagggccctgggcgct

SEQ ID NO: 66013 - DNA, 201 bp, Homo sapiens; identical to SEQ ID NO: 14150

SEQ ID NO: 66014 - DNA, 201 bp, Homo sapiens
tccagcttgaaagaagctggggaaaggaagaacagtggggttagtcagagctgggccagaagtgcctttcgttgtgctggattctgggttattggcagccyctctgccagagctacccgtctagggcactgatctatgggaggggaagcaggtgctacccacaccctattctagttccactctgggcaggtccaactctgg

SEQ ID NO: 66015 - DNA, 201 bp, Homo sapiens; identical to SEQ ID NO: 14293

SEQ ID NO: 66016 - DNA, 201 bp, Homo sapiens
tattgagggaaggggagtaacttcaaggtaatccagagagaagcaaatgcaatacagttctgactgagatgcagattcctttttgttaaatgctgactgtstccttggtttcccattcacctgggaagtagaagaataaaaatcattccatagttccatccaaggagggcagctgcaacagtgtgctcttgagcaggctgt

SEQ ID NO: 66017 - DNA, 201 bp, Homo sapiens
aatgaggggtgattaccgtgaaagataaaggggagaggctgtaggggggaaggcctcagaccaccatgcaggctgactgtgaaggaaaggcaggggggatragggaagactaagatgagcctcaggctacagtacagtaagtcctcacttaatggagttgataggatcttggaaattatgactttaaataaaataatgtag

SEQ ID NO: 66018 - DNA, 201 bp, Homo sapiens; identical to SEQ ID NO: 14160

SEQ ID NO: 66019 - DNA, 201 bp, Homo sapiens; identical to SEQ ID NO: 14162

SEQ ID NO: 66020 - DNA, 201 bp, Homo sapiens; identical to SEQ ID NO: 14164

SEQ ID NO: 66021 - DNA, 201 bp, Homo sapiens; identical to SEQ ID NO: 14165

SEQ ID NO: 66022 - DNA, 201 bp, Homo sapiens
atcatgtgacagcagaggaagcagtctggcccatccacacgctatgtgcagagctgtctcaactccagggcccctgaaaaggagaagggaagtaccatgtrtcactgtggcccagcaggactatgagagaagcactgttcttctttgagtttgtagatgaggacacagggtcagaaagggtggtgtcttagaccattcagg

SEQ ID NO: 66023 - DNA, 201 bp, Homo sapiens
tccgaagaacaacagattgattccagcttgaaagaagctggggaaaggaagaacagtggggttagtcagagctgggccagaagtgcctttcgttgtgctgsattctgggttattggcagcccctctgccagagctacccgtctagggcactgatctatgggaggggaagcaggtgctacccacaccctattctagttccac

SEQ ID NO: 66024 - DNA, 201 bp, Homo sapiens; identical to SEQ ID NO: 14420

SEQ ID NO: 66025 - DNA, 201 bp, Homo sapiens
aacagtggggttagtcagagctgggccagaagtgcctttcgttgtgctggattctgggttattggcagcccctctgccagagctacccgtctagggcactratctatgggaggggaagcaggtgctacccacaccctattctagttccactctgggcaggtccaactctggagtgatgtgaagagcaggctgcctggactg

SEQ ID NO: 66026 - DNA, 201 bp, Homo sapiens; identical to SEQ ID NO: 14422

SEQ ID NO: 66027 - DNA, 201 bp, Homo sapiens; identical to SEQ ID NO: 14424

SEQ ID NO: 66028 - DNA, 201 bp, Homo sapiens; identical to SEQ ID NO: 14426

SEQ ID NO: 66029 - DNA, 201 bp, Homo sapiens; identical to SEQ ID NO: 14429

SEQ ID NO: 66030 - DNA, 201 bp, Homo sapiens; identical to SEQ ID NO: 14443

SEQ ID NO: 66031 - DNA, 201 bp, Homo sapiens; identical to SEQ ID NO: 14445

SEQ ID NO: 66032 - DNA, 201 bp, Homo sapiens; identical to SEQ ID NO: 14447

SEQ ID NO: 66033 - DNA, 201 bp, Homo sapiens; identical to SEQ ID NO: 14448

SEQ ID NO: 66034 - DNA, 201 bp, Homo sapiens; identical to SEQ ID NO: 14295

SEQ ID NO: 66035 - DNA, 201 bp, Homo sapiens; identical to SEQ ID NO: 14450

SEQ ID NO: 66036 - DNA, 201 bp, Homo sapiens; identical to SEQ ID NO: 14179

SEQ ID NO: 66037 - DNA, 201 bp, Homo sapiens; identical to SEQ ID NO: 14453

SEQ ID NO: 66038 - DNA, 201 bp, Homo sapiens; identical to SEQ ID NO: 14455

SEQ ID NO: 66039 - DNA, 201 bp, Homo sapiens; identical to SEQ ID NO: 14456

SEQ ID NO: 66040 - DNA, 201 bp, Homo sapiens; identical to SEQ ID NO: 14458

SEQ ID NO: 66041 - DNA, 201 bp, Homo sapiens; identical to SEQ ID NO: 14302

SEQ ID NO: 66042 - DNA, 201 bp, Homo sapiens; identical to SEQ ID NO: 14199

SEQ ID NO: 66043 - DNA, 201 bp, Homo sapiens
ctggggaagaacaatccccgagggctgctgctttgcgtctgtggctccaagaagtgcctgtggtcaggccccagctctacttggtccctgaaaaagcaccyggctaagggctgggcctggccagcagggagggcagttgatgagagagggtgttcccgctggagggttggtgctgtggagcctacaccggcagggacagcc

SEQ ID NO: 66044 - DNA, 201 bp, Homo sapiens; identical to SEQ ID NO: 1215

SEQ ID NO: 66045 - DNA, 201 bp, Homo sapiens
agcttgatgaggaccacagcctactggaagctctgaccctcgcctcagcccgcgggcccctgcgcaagcgcagcgtgcccatggccaaggccaagcccaarttcagcatctctccagattccctgtcctgagccatggtctctcgggccccccacacgcgtgtgtacacacggaccatgtggtatgtagcccggccagggc

SEQ ID NO: 66046 - DNA, 201 bp, Homo sapiens; identical to SEQ ID NO: 14476

SEQ ID NO: 66047 - DNA, 201 bp, Homo sapiens; identical to SEQ ID NO: 14481

SEQ ID NO: 66048 - DNA, 201 bp, Homo sapiens; identical to SEQ ID NO: 14484

SEQ ID NO: 66049 - DNA, 201 bp, Homo sapiens; identical to SEQ ID NO: 14490

SEQ ID NO: 66050 - DNA, 201 bp, Homo sapiens; identical to SEQ ID NO: 14492

SEQ ID NO: 66051 - DNA, 201 bp, Homo sapiens
cagtgtgaggcctgcagacagggcatcagtgagggtctgtctcaggcggctccagaggcagggccaaggggccaggaagttgccgctgctggtctgagctstaagctgccctctcccagcacccatgcagtccccagcgctgattcccttccttgcagagctgacccatttctggttttgagggtgaaggggtgaaagcta

SEQ ID NO: 66052 - DNA, 201 bp, Homo sapiens; identical to SEQ ID NO: 14352

SEQ ID NO: 66053 - DNA, 201 bp, Homo sapiens; identical to SEQ ID NO: 14317

SEQ ID NO: 66054 - DNA, 201 bp, Homo sapiens; identical to SEQ ID NO: 14243

SEQ ID NO: 66055 - DNA, 201 bp, Homo sapiens
caacctcctcctccccagatcatcagccccgaactgaagcaaaacagactttgggtagtctttcctctgtttactctttacttcatttgatcaattccaawttttttcataatgccattattattgagggaaggggagtaacttcaaggtaatccagagagaagcaaatgcaatacagttctgactgagatgcagattcct

SEQ ID NO: 66056 - DNA, 201 bp, Homo sapiens
cctaacgcctgtggatttggcatctccagccaatgtcaccatgagacccacccgagccccactaatgtgcacctctggcccttctgctggagaggactcaygcagcttctccagggcccactttctctccacgggcaggaggctctgtccttcacctgagctcctcccccacatctttttctagggagaactttcccaggg

SEQ ID NO: 66057 - DNA, 201 bp, Homo sapiens
agttgtctccaaaccaagggaaagagggaaggtggaactcagcaagcccctgggcctccctgagatcccagattggaaactggcagcaggcttggctgttytgtgacagcctagattatgtccagaacacctatggagtcagaacaacctcactggcactttttctggcccacgtgcatgatgagccctccatcttcttcc

SEQ ID NO: 66058 - DNA, 201 bp, Homo sapiens
gcaggtccaagatttcagccaaagtctgtctaatgccacagccctgctcttccctccccctctttcccctagcacacagtcccagtgacctaagctccagyttttagtagggctgcaccttgttctaagtgtcacattcaccacagggagaaagttgtctccaaaccaagggaaagagggaaggtggaactcagcaagccc

SEQ ID NO: 66059 - DNA, 201 bp, Homo sapiens
tgctggaaaaggtgtgggaaggttcaggatggtgggagggactgaggtccctgaggtgaagaggcccttggtcctgacgggtttgacccgtgcctggaccyttggagcagtgttgtgtgaacttgcctagaactctgccttctccgttgtcaataaagcctccccctcatgacctaaactctgggcttttcttgctgggga

SEQ ID NO: 66060 - DNA, 201 bp, Homo sapiens
ctgtccccagaggctgaggagagggggtactgtgcccaccacacatgattaggcctcagacccaactctggtcctggctccacaacagtggctgccactcrctttgtccagaaggtggcttgggggtggatatctttgggttgctggaaaaggtgtgggaaggttcaggatggtgggagggactgaggtccctgaggtgaa

SEQ ID NO: 66061 - DNA, 201 bp, Homo sapiens
gggaaggtgacctgaggaggctcggctttgtagagccccgctcaggcacagggaggaggagatgccagggctcctgccttttgccacatcggcctcgtgcwgtgagggctctgtgggctggggctgctgcccctgcctacctcctgcctgtccccagaggctgaggagagggggtactgtgcccaccacacatgattaggc

SEQ ID NO: 66062 - DNA, 201 bp, Homo sapiens
ctagagctgtgcgtccagccagtcctgggtccccacgattgaccagccacactctgggccggtggctggggaagaacaatccccgagggctgctgctttgygtctgtggctccaagaagtgcctgtggtcaggccccagctctacttggtccctgaaaaagcacctggctaagggctgggcctggccagcagggagggcag

SEQ ID NO: 66063 - DNA, 201 bp, Homo sapiens
tttgtccctgctcctcccaacccaattcaggactggctcacccctctcccccgcccaaggctgcagaggctgtgggaggtactgggccctagagctgtgcrtccagccagtcctgggtccccacgattgaccagccacactctgggccggtggctggggaagaacaatccccgagggctgctgctttgcgtctgtggctcc

SEQ ID NO: 66064 - DNA, 201 bp, Homo sapiens; identical to SEQ ID NO: 14539

SEQ ID NO: 66065 - DNA, 201 bp, Homo sapiens; identical to SEQ ID NO: 14269

SEQ ID NO: 66066 - DNA, 201 bp, Homo sapiens; identical to SEQ ID NO: 14271

SEQ ID NO: 66067 - DNA, 201 bp, Homo sapiens
ccctttctctatggcactggcctcaactggacaaagaagttcacctgagcactactcagcccagcaggaacttctgtgataattttgtttgtgatattctrcctccaggattgcatcccttagtcatcatgtgacagcagaggaagcagtctggcccatccacacgctatgtgcagagctgtctcaactccagggcccctg

SEQ ID NO: 66068 - DNA, 201 bp, Homo sapiens
tctggggccttgttacataagggtactaatcccattcatgaggattccaccctcatcacctcccaaaggccccgcttccaaataccatcaccttgggcatyaggatttaacatgtgcattttagggggacacagacatttagcctatagcaggaagtaatttgctaagatctcacagctagtaggaggcaggtccaagatt

SEQ ID NO: 66069 - DNA, 201 bp, Homo sapiens
atagcaggaagtaatttgctaagatctcacagctagtaggaggcaggtccaagatttcagccaaagtctgtctaatgccacagccctgctcttccctcccsctctttcccctagcacacagtcccagtgacctaagctccagcttttagtagggctgcaccttgttctaagtgtcacattcaccacagggagaaagttgtc

SEQ ID NO: 66070 - DNA, 201 bp, Homo sapiens
ggcacatctgccacccatctgtccccaactcatatcaatggtgtgagacatgtcctgggcctcagtcctgagcttcagagggaaggcaagccaggccaccytcttcctgtgtgctagtctagaaaaactagcccactcgcacactagaacctgcccaggcctaacgcctgtggatttggcatctccagccaatgtcaccat

SEQ ID NO: 66071 - DNA, 201 bp, Homo sapiens
tccatctgggggcaccctttctctatggcactggcctcaactggacaaagaagttcacctgagcactactcagcccagcaggaacttctgtgataattttktttgtgatattctgcctccaggattgcatcccttagtcatcatgtgacagcagaggaagcagtctggcccatccacacgctatgtgcagagctgtctcaa

SEQ ID NO: 66072 - DNA, 201 bp, Homo sapiens
cccagggaggggctggaaagctccaggcatagagaggcagttcgaccaagcctccctcctccgcgaaggtgttcttgcccactgatggtgctacctccatytgggggcaccctttctctatggcactggcctcaactggacaaagaagttcacctgagcactactcagcccagcaggaacttctgtgataattttgtttgt

SEQ ID NO: 66073 - DNA, 201 bp, Homo sapiens
ccttcctccacccctcagggaccttaagctgctggtgagtgtgaagcccacagaactgagggcttagcgccacctgctggccacagagaagacttacttcrgcagagaaaaatcaggaccactggtcctaggttttccaccaactctgagggagacccccagccttaaggcataacccagggaggggctggaaagctccag

SEQ ID NO: 66074 - DNA, 201 bp, Homo sapiens
ctgtggctggcttacatggagtaggtgctacatgaatgaacaaatgaatgaatgaataacggatggatggcgtacaggacaaaaagccagggttattgctrcagtgtgaggcctgcagacagggcatcagtgagggtctgtctcaggcggctccagaggcagggccaaggggccaggaagttgccgctgctggtctgagct

SEQ ID NO: 66075 - DNA, 201 bp, Homo sapiens
atgcctgtgacctggtccccttgtctccatctcacccactgtagtccatctgccacgcagcctccagggtggtcttagaagcgtgggtcaccccccacccycatcatgaaataccttcggtagttccccatcacctctgggtcaaggctagcttcttagcagccatttcaggctgtgactgcctctccggccttatggccc

SEQ ID NO: 66076 - DNA, 201 bp, Homo sapiens
gattttaggggctgtggcaatgcctgtgacctggtccccttgtctccatctcacccactgtagtccatctgccacgcagcctccagggtggtcttagaagsgtgggtcaccccccacccccatcatgaaataccttcggtagttccccatcacctctgggtcaaggctagcttcttagcagccatttcaggctgtgactgc

SEQ ID NO: 66077 - DNA, 201 bp, Homo sapiens
ggtgtcccctcctagctgagaccacgattttaggggctgtggcaatgcctgtgacctggtccccttgtctccatctcacccactgtagtccatctgccacrcagcctccagggtggtcttagaagcgtgggtcaccccccacccccatcatgaaataccttcggtagttccccatcacctctgggtcaaggctagcttctt

SEQ ID NO: 66078 - DNA, 201 bp, Homo sapiens
ctcatccagggtgttacaaggcacttgtcactatgctatttctggcctcagcaggaacctgtactgggttatttttgtccctgctcctcccaacccaattyaggactggctcacccctctcccccgcccaaggctgcagaggctgtgggaggtactgggccctagagctgtgcgtccagccagtcctgggtccccacgatt

SEQ ID NO: 66079 - DNA, 201 bp, Homo sapiens
tggtgtgaggctgggccagcctcagctcagcctccccctgctgctcatccagggtgttacaaggcacttgtcactatgctatttctggcctcagcaggaamctgtactgggttatttttgtccctgctcctcccaacccaattcaggactggctcacccctctcccccgcccaaggctgcagaggctgtgggaggtactgg

SEQ ID NO: 66080 - DNA, 201 bp, Homo sapiens; identical to SEQ ID NO: 14398

SEQ ID NO: 66081 - DNA, 201 bp, Homo sapiens; identical to SEQ ID NO: 14400

SEQ ID NO: 66082 - DNA, 201 bp, Homo sapiens
ctgtcctgagccatggtctctcgggccccccacacgcgtgtgtacacacggaccatgtggtatgtagcccggccagggcctggtgtgaggctgggccagcytcagctcagcctccccctgctgctcatccagggtgttacaaggcacttgtcactatgctatttctggcctcagcaggaacctgtactgggttatttttgt

SEQ ID NO: 66083 - DNA, 201 bp, Homo sapiens
aagcccaagttcagcatctctccagattccctgtcctgagccatggtctctcgggccccccacacgcgtgtgtacacacggaccatgtggtatgtagcccrgccagggcctggtgtgaggctgggccagcctcagctcagcctccccctgctgctcatccagggtgttacaaggcacttgtcactatgctatttctggcct

SEQ ID NO: 66084 - DNA, 201 bp, Homo sapiens; identical to SEQ ID NO: 14551

SEQ ID NO: 66085 - DNA, 201 bp, Homo sapiens; identical to SEQ ID NO: 14407

SEQ ID NO: 66086 - DNA, 201 bp, Homo sapiens; identical to SEQ ID NO: 14410

SEQ ID NO: 66087 - DNA, 201 bp, Homo sapiens; identical to SEQ ID NO: 14415

SEQ ID NO: 66088 - DNA, 201 bp, Homo sapiens; identical to SEQ ID NO: 41272

SEQ ID NO: 66089 - DNA, 201 bp, Homo sapiens; identical to SEQ ID NO: 43212

SEQ ID NO: 66090 - DNA, 201 bp, Homo sapiens; identical to SEQ ID NO: 41274

SEQ ID NO: 66091 - DNA, 201 bp, Homo sapiens; identical to SEQ ID NO: 40824

SEQ ID NO: 66092 - DNA, 201 bp, Homo sapiens; identical to SEQ ID NO: 41275

SEQ ID NO: 66093 - DNA, 201 bp, Homo sapiens; identical to SEQ ID NO: 44804

SEQ ID NO: 66094 - DNA, 201 bp, Homo sapiens; identical to SEQ ID NO: 41276

SEQ ID NO: 66095 - DNA, 201 bp, Homo sapiens; identical to SEQ ID NO: 41278

SEQ ID NO: 66096 - DNA, 201 bp, Homo sapiens; identical to SEQ ID NO: 43941

SEQ ID NO: 66097 - DNA, 201 bp, Homo sapiens; identical to SEQ ID NO: 41280

SEQ ID NO: 66098 - DNA, 201 bp, Homo sapiens; identical to SEQ ID NO: 43942

SEQ ID NO: 66099 - DNA, 201 bp, Homo sapiens; identical to SEQ ID NO: 43943

SEQ ID NO: 66100 - DNA, 201 bp, Homo sapiens; identical to SEQ ID NO: 43944

SEQ ID NO: 66101 - DNA, 201 bp, Homo sapiens; identical to SEQ ID NO: 43945

SEQ ID NO: 66102 - DNA, 201 bp, Homo sapiens; identical to SEQ ID NO: 43946

SEQ ID NO: 66103 - DNA, 201 bp, Homo sapiens; identical to SEQ ID NO: 43947

SEQ ID NO: 66104 - DNA, 201 bp, Homo sapiens; identical to SEQ ID NO: 43948

SEQ ID NO: 66105 - DNA, 201 bp, Homo sapiens; identical to SEQ ID NO: 43950

SEQ ID NO: 66106 - DNA, 201 bp, Homo sapiens; identical to SEQ ID NO: 43236

SEQ ID NO: 66107 - DNA, 201 bp, Homo sapiens; identical to SEQ ID NO: 40778

SEQ ID NO: 66108 - DNA, 201 bp, Homo sapiens; identical to SEQ ID NO: 41309

SEQ ID NO: 66109 - DNA, 201 bp, Homo sapiens; identical to SEQ ID NO: 40841

SEQ ID NO: 66110 - DNA, 201 bp, Homo sapiens; identical to SEQ ID NO: 44820

SEQ ID NO: 66111 - DNA, 201 bp, Homo sapiens; identical to SEQ ID NO: 41313

SEQ ID NO: 66112 - DNA, 201 bp, Homo sapiens; identical to SEQ ID NO: 44826

SEQ ID NO: 66113 - DNA, 201 bp, Homo sapiens; identical to SEQ ID NO: 41316

SEQ ID NO: 66114 - DNA, 201 bp, Homo sapiens; identical to SEQ ID NO: 44829

SEQ ID NO: 66115 - DNA, 201 bp, Homo sapiens; identical to SEQ ID NO: 41319

SEQ ID NO: 66116 - DNA, 201 bp, Homo sapiens; identical to SEQ ID NO: 44832

SEQ ID NO: 66117 - DNA, 201 bp, Homo sapiens; identical to SEQ ID NO: 41323

SEQ ID NO: 66118 - DNA, 201 bp, Homo sapiens; identical to SEQ ID NO: 44720

SEQ ID NO: 66119 - DNA, 201 bp, Homo sapiens; identical to SEQ ID NO: 44834

SEQ ID NO: 66120 - DNA, 201 bp, Homo sapiens; identical to SEQ ID NO: 41326

SEQ ID NO: 66121 - DNA, 201 bp, Homo sapiens; identical to SEQ ID NO: 44835

SEQ ID NO: 66122 - DNA, 201 bp, Homo sapiens; identical to SEQ ID NO: 41328

SEQ ID NO: 66123 - DNA, 201 bp, Homo sapiens; identical to SEQ ID NO: 44836

SEQ ID NO: 66124 - DNA, 201 bp, Homo sapiens; identical to SEQ ID NO: 41329

SEQ ID NO: 66125 - DNA, 201 bp, Homo sapiens; identical to SEQ ID NO: 41330

SEQ ID NO: 66126 - DNA, 201 bp, Homo sapiens; identical to SEQ ID NO: 41331

SEQ ID NO: 66127 - DNA, 201 bp, Homo sapiens; identical to SEQ ID NO: 41332

SEQ ID NO: 66128 - DNA, 201 bp, Homo sapiens; identical to SEQ ID NO: 40486

SEQ ID NO: 66129 - DNA, 201 bp, Homo sapiens; identical to SEQ ID NO: 40487

SEQ ID NO: 66130 - DNA, 201 bp, Homo sapiens; identical to SEQ ID NO: 41543

SEQ ID NO: 66131 - DNA, 201 bp, Homo sapiens; identical to SEQ ID NO: 42879

SEQ ID NO: 66132 - DNA, 201 bp, Homo sapiens; identical to SEQ ID NO: 42883

SEQ ID NO: 66133 - DNA, 201 bp, Homo sapiens; identical to SEQ ID NO: 45034

SEQ ID NO: 66134 - DNA, 201 bp, Homo sapiens; identical to SEQ ID NO: 40790

SEQ ID NO: 66135 - DNA, 201 bp, Homo sapiens; identical to SEQ ID NO: 40500

SEQ ID NO: 66136 - DNA, 201 bp, Homo sapiens; identical to SEQ ID NO: 40502

SEQ ID NO: 66137 - DNA, 201 bp, Homo sapiens; identical to SEQ ID NO: 40504

SEQ ID NO: 66138 - DNA, 201 bp, Homo sapiens; identical to SEQ ID NO: 40506

SEQ ID NO: 66139 - DNA, 201 bp, Homo sapiens; identical to SEQ ID NO: 40509

SEQ ID NO: 66140 - DNA, 201 bp, Homo sapiens; identical to SEQ ID NO: 40511

SEQ ID NO: 66141 - DNA, 201 bp, Homo sapiens; identical to SEQ ID NO: 40513

SEQ ID NO: 66142 - DNA, 201 bp, Homo sapiens; identical to SEQ ID NO: 40515

SEQ ID NO: 66143 - DNA, 201 bp, Homo sapiens; identical to SEQ ID NO: 41355

SEQ ID NO: 66144 - DNA, 201 bp, Homo sapiens; identical to SEQ ID NO: 41358

SEQ ID NO: 66145 - DNA, 201 bp, Homo sapiens; identical to SEQ ID NO: 41165

SEQ ID NO: 66146 - DNA, 201 bp, Homo sapiens; identical to SEQ ID NO: 41360

SEQ ID NO: 66147 - DNA, 201 bp, Homo sapiens; identical to SEQ ID NO: 41362

SEQ ID NO: 66148 - DNA, 201 bp, Homo sapiens; identical to SEQ ID NO: 44754

SEQ ID NO: 66149 - DNA, 201 bp, Homo sapiens; identical to SEQ ID NO: 41364

SEQ ID NO: 66150 - DNA, 201 bp, Homo sapiens; identical to SEQ ID NO: 40877

SEQ ID NO: 66151 - DNA, 201 bp, Homo sapiens; identical to SEQ ID NO: 41367

SEQ ID NO: 66152 - DNA, 201 bp, Homo sapiens; identical to SEQ ID NO: 40600

SEQ ID NO: 66153 - DNA, 201 bp, Homo sapiens; identical to SEQ ID NO: 41368

SEQ ID NO: 66154 - DNA, 201 bp, Homo sapiens; identical to SEQ ID NO: 43870

SEQ ID NO: 66155 - DNA, 201 bp, Homo sapiens; identical to SEQ ID NO: 41563

SEQ ID NO: 66156 - DNA, 201 bp, Homo sapiens; identical to SEQ ID NO: 43871

SEQ ID NO: 66157 - DNA, 201 bp, Homo sapiens; identical to SEQ ID NO: 39276

SEQ ID NO: 66158 - DNA, 201 bp, Homo sapiens; identical to SEQ ID NO: 40524

SEQ ID NO: 66159 - DNA, 201 bp, Homo sapiens; identical to SEQ ID NO: 44865

SEQ ID NO: 66160 - DNA, 201 bp, Homo sapiens; identical to SEQ ID NO: 40531

SEQ ID NO: 66161 - DNA, 201 bp, Homo sapiens; identical to SEQ ID NO: 44866

SEQ ID NO: 66162 - DNA, 201 bp, Homo sapiens; identical to SEQ ID NO: 42681

SEQ ID NO: 66163 - DNA, 201 bp, Homo sapiens; identical to SEQ ID NO: 44867

SEQ ID NO: 66164 - DNA, 201 bp, Homo sapiens; identical to SEQ ID NO: 41388

SEQ ID NO: 66165 - DNA, 201 bp, Homo sapiens; identical to SEQ ID NO: 41199

SEQ ID NO: 66166 - DNA, 201 bp, Homo sapiens; identical to SEQ ID NO: 41390

SEQ ID NO: 66167 - DNA, 201 bp, Homo sapiens; identical to SEQ ID NO: 41200

SEQ ID NO: 66168 - DNA, 201 bp, Homo sapiens; identical to SEQ ID NO: 41392

SEQ ID NO: 66169 - DNA, 201 bp, Homo sapiens; identical to SEQ ID NO: 41201

SEQ ID NO: 66170 - DNA, 201 bp, Homo sapiens; identical to SEQ ID NO: 44776

SEQ ID NO: 66171 - DNA, 201 bp, Homo sapiens; identical to SEQ ID NO: 39781

SEQ ID NO: 66172 - DNA, 201 bp, Homo sapiens; identical to SEQ ID NO: 41203

SEQ ID NO: 66173 - DNA, 201 bp, Homo sapiens; identical to SEQ ID NO: 41204

SEQ ID NO: 66174 - DNA, 201 bp, Homo sapiens; identical to SEQ ID NO: 44779

SEQ ID NO: 66175 - DNA, 201 bp, Homo sapiens; identical to SEQ ID NO: 41205

SEQ ID NO: 66176 - DNA, 201 bp, Homo sapiens; identical to SEQ ID NO: 44780

SEQ ID NO: 66177 - DNA, 201 bp, Homo sapiens; identical to SEQ ID NO: 45072

SEQ ID NO: 66178 - DNA, 201 bp, Homo sapiens; identical to SEQ ID NO: 41206

SEQ ID NO: 66179 - DNA, 201 bp, Homo sapiens; identical to SEQ ID NO: 44781

SEQ ID NO: 66180 - DNA, 201 bp, Homo sapiens; identical to SEQ ID NO: 41207

SEQ ID NO: 66181 - DNA, 201 bp, Homo sapiens; identical to SEQ ID NO: 44782

SEQ ID NO: 66182 - DNA, 201 bp, Homo sapiens; identical to SEQ ID NO: 44167

SEQ ID NO: 66183 - DNA, 201 bp, Homo sapiens; identical to SEQ ID NO: 39720

SEQ ID NO: 66184 - DNA, 201 bp, Homo sapiens; identical to SEQ ID NO: 41208

SEQ ID NO: 66185 - DNA, 201 bp, Homo sapiens; identical to SEQ ID NO: 43906

SEQ ID NO: 66186 - DNA, 201 bp, Homo sapiens; identical to SEQ ID NO: 44890

SEQ ID NO: 66187 - DNA, 201 bp, Homo sapiens; identical to SEQ ID NO: 43907

SEQ ID NO: 66188 - DNA, 201 bp, Homo sapiens; identical to SEQ ID NO: 41209

SEQ ID NO: 66189 - DNA, 201 bp, Homo sapiens; identical to SEQ ID NO: 43908

SEQ ID NO: 66190 - DNA, 201 bp, Homo sapiens; identical to SEQ ID NO: 43910

SEQ ID NO: 66191 - DNA, 201 bp, Homo sapiens; identical to SEQ ID NO: 43911

SEQ ID NO: 66192 - DNA, 201 bp, Homo sapiens; identical to SEQ ID NO: 43912

SEQ ID NO: 66193 - DNA, 201 bp, Homo sapiens; identical to SEQ ID NO: 43913

SEQ ID NO: 66194 - DNA, 201 bp, Homo sapiens; identical to SEQ ID NO: 43914

SEQ ID NO: 66195 - DNA, 201 bp, Homo sapiens; identical to SEQ ID NO: 43916

SEQ ID NO: 66196 - DNA, 201 bp, Homo sapiens; identical to SEQ ID NO: 43917

SEQ ID NO: 66197 - DNA, 201 bp, Homo sapiens; identical to SEQ ID NO: 44228

SEQ ID NO: 66198 - DNA, 201 bp, Homo sapiens; identical to SEQ ID NO: 44229

SEQ ID NO: 66199 - DNA, 201 bp, Homo sapiens; identical to SEQ ID NO: 39916

SEQ ID NO: 66200 - DNA, 201 bp, Homo sapiens; identical to SEQ ID NO: 39918

SEQ ID NO: 66201 - DNA, 201 bp, Homo sapiens; identical to SEQ ID NO: 41888

SEQ ID NO: 66202 - DNA, 201 bp, Homo sapiens; identical to SEQ ID NO: 41422

SEQ ID NO: 66203 - DNA, 201 bp, Homo sapiens; identical to SEQ ID NO: 44792

SEQ ID NO: 66204 - DNA, 201 bp, Homo sapiens; identical to SEQ ID NO: 41260

SEQ ID NO: 66205 - DNA, 201 bp, Homo sapiens; identical to SEQ ID NO: 44795

SEQ ID NO: 66206 - DNA, 201 bp, Homo sapiens; identical to SEQ ID NO: 41425

SEQ ID NO: 66207 - DNA, 201 bp, Homo sapiens; identical to SEQ ID NO: 41262

SEQ ID NO: 66208 - DNA, 201 bp, Homo sapiens; identical to SEQ ID NO: 44796

SEQ ID NO: 66209 - DNA, 201 bp, Homo sapiens; identical to SEQ ID NO: 41427

SEQ ID NO: 66210 - DNA, 201 bp, Homo sapiens; identical to SEQ ID NO: 41268

SEQ ID NO: 66211 - DNA, 201 bp, Homo sapiens; identical to SEQ ID NO: 44798

SEQ ID NO: 66212 - DNA, 201 bp, Homo sapiens; identical to SEQ ID NO: 43211

SEQ ID NO: 66213 - DNA, 201 bp, Homo sapiens; identical to SEQ ID NO: 41271

SEQ ID NO: 66214 - DNA, 201 bp, Homo sapiens; identical to SEQ ID NO: 44800

SEQ ID NO: 66215 - DNA, 201 bp, Homo sapiens
atgttacccagatggagctcagagaggctggatgggccaggctgctcagggccgcccggctaaagaaacccagaaagcccccgatatgtgtcagtgacacrgatgtggccttcaggagggggtgggcgggtgcacggccgcgtttggaggcagctccctgtctctccttcctgtatgttcgtctggggtttgggtggggaa

SEQ ID NO: 66216 - DNA, 201 bp, Homo sapiens
tttttttttagtggattccttaggatttcctatatacaagatactgttttggcaaatagggatgtttttatttcttcttttctgatctggatgccttttayttttcttttcctgcctaattgccctggctagagcctccagtgcaatgttgaatagagtggcaagaatggacccccctgtcttgttcctgatctttcatca

SEQ ID NO: 66217 - DNA, 201 bp, Homo sapiens
cagctcctcctccagcctcctgggccctggctgggctctcagacccaccaggcaaccctgcggcctcctttgtgcctctgttttgcctggacctcatgggrgccccctgcccgcgtccacaacacacgggcactcagtgcagggctctccgagggcagggccaggcctgaccccatcacagcctcagcgggaccccgctct

SEQ ID NO: 66218 - DNA, 201 bp, Homo sapiens
ccctcccaggggccgctccctccccagtcatgtaggggcaccccaggactccccagcactggaacctaggcagcagacagcaatgtgtggagagcgaggcyggagtcccatgtccctgtgggggatgagagcctcagctgggccctctgtccacaacgcccactcactgagggccactggggtggggtggctctgggggag

SEQ ID NO: 66219 - DNA, 201 bp, Homo sapiens
gcctccacgcagccgagtgctagcctgttgtgcaggtgtgcgggacacaccctcccaaagacaccagctgtcctcggcggagcagggtgtgcctaggccckgctcagtgcctctgggagcctctgtgtccgcctcagcccacagacattattgaccgtgttcccaccgttgcaagggccgtggagggacgagatgaagctt

SEQ ID NO: 66220 - DNA, 201 bp, Homo sapiens
caatagtggagggaaggtcagcagataaacaagtgaacaaaggtctctggttttcctaggcagaggaccctgcggccttccgcagtgtttgtgtccctgaktacttgagattagggagtggtgatgactcttaaggagcatgctgccttcaagcatctgtttaacaaagcacatcttgcaccacccttaatccattcaacc

SEQ ID NO: 66221 - DNA, 201 bp, Homo sapiens
ggactgtggggaggctggcgaggccagctgtgcagctcccccttggcctctccgtgcagtgcttctcactcccaggcatgggacaggacccctggagcaarggtcttatgacccacagtcagacaaggtaggcggagaacatctttatggccagctcctccccagaaaagtggggaaggcttgagttgtatttctaggtct

SEQ ID NO: 66222 - DNA, 201 bp, Homo sapiens
gtcacggttctggaagctggaggtcaaaatgagggtgtctgtacctgacactctgcagaggacccttccttgctcttccagctgctggtggtggccgggartcttggccttcctcggcatgcagctgcgtcactgcagtctctgcctgtgtcacaaggccttctccaggtgttctcttttttgttttgttttgttttgaga

SEQ ID NO: 66223 - DNA, 201 bp, Homo sapiens
agccacacccctggcctgccacctctcacattcagctgctggagggcatcctttgttggggagagtgcagatttaagcttcattcagtagtgggttggtgyctcggcgccccctccactcacctgctctgtgatcttggccacagaactgttggtgccacttgaacttgatctataagagaatcacgccctcctcataggg

SEQ ID NO: 66224 - DNA, 201 bp, Homo sapiens
gctcagagactcctggttgctcccctcaggccagagccagaacacgcgtgggtcgtccttcatcatacacatgggagacacgcacagcgagggggcgtccygggagaccaggcagcctgagccgtccctgggtgcggggcctgtctgggctccgggctgcgcgtgagggtcccagggctgaccgggcaccagggggcttcc

SEQ ID NO: 66225 - DNA, 201 bp, Homo sapiens
ggtgtgagagcagagcttggagtgtctgtgctgtccgtggagatgggggcacatgtttggacatgggtgggggaccctggggggcagaccgcagccctgcrcttctcttcctgccaggaatgatgctgggtggtggctgtgggcaggagctggcccactggatcatccatgggcgcccggagaaggacatgcatggctatg

SEQ ID NO: 66226 - DNA, 201 bp, Homo sapiens
ggcgagggtttggcgttgtggtggttcccatggactgggcgaggctcatagcacccgacagtggatggggtgtgctgagagggtcgggggagggtaggggmcagagacagcttccgcgtgcatgatgaagagtggagggtgctggccgcagctgccgggaaagggactgggatgcggtggaatcatgcagtccccagcctg

SEQ ID NO: 66227 - DNA, 201 bp, Homo sapiens
gcagcttcggggagaggatgggaaaggagaggaggagaggcagggaggggtgggggggagatgagtctccagcctgaaggtcgccgaggtgagcacttgaygtagcagggctgtgtcctggtgatatcctgtcagcctgggattctgccgagacctctggctggagtgcccagactctgccatggggtccgctttccctgg

SEQ ID NO: 66228 - DNA, 201 bp, Homo sapiens
ccacggctgtgcatagcctcagtgtggggcaagtggcaactctcagcaaccacggggttacgcttatctgggtgtaggaggtgcgggtactgctggagcgkggtaggggggacacggctgctgtctctgcaagaggaagaggataaccagcctgagagcaagagtgtgagtggggggtgaggtgggggtggggttgtcgct

SEQ ID NO: 66229 - DNA, 201 bp, Homo sapiens
ggaaggaaagtaactaactcagggtcacacagcaggggcaggaatagcaacctgggctgctggactcacaccccaatcattcggaaggtgggcgagcccaragtccctttggcttggggcatgtaggtcattttcaggtaacaaagcacttcccctaagcctctaaataaggaacttattttagataaaatcccccacaag

SEQ ID NO: 66230 - DNA, 201 bp, Homo sapiens
ggatgaggggaggtcagagcccgggttccgctccaaattgtttctcgtggctgcagctggggaatgcacgcaacggcaccaccctgtcccgaggagagagmacctggctgcgctccctgtcccgaggagagagaacccagcacccctccctgtcccctgtgtgcttcccccgcccctgtggagagagaacctggcccctcg

SEQ ID NO: 66231 - DNA, 201 bp, Homo sapiens
gctccatcctccatccctaattcctcccaaggcctgcctttgaggtgcctttccagggaagaagcaaggcagagttggcctaggtccctgcagctgccccytcctgtgtatgtcaagattcaagcgaagctagggggtgttacttacaaagccagtccagatcccagcgtgcctctggtaccggaggcacaggaaaagggc

SEQ ID NO: 66232 - DNA, 201 bp, Homo sapiens
aggcctgcctgactgcatgccccacccgggcccatggcagcgcacctggaagcggacggctgaggacttgttgcagtgcatggagatgggcgcgaagctgyacagggccttcagtacgtcgcggttgaaggagttccagggaacagaggtgaactgctgagacacggacgcctgagggcaggtgcagacatcctcgttgtt

SEQ ID NO: 66233 - DNA, 201 bp, Homo sapiens
ggagaatgagggagagggagagggagggtgggggagagggagggagagggagggagagggagggagagggacggtgagtggagccgtgtcgtcgtcatccygtggcttctccctgggtgcctgtcaggctctgtctcttgtgtgacagcctgtccagctccctgaatcagctcagctcctggagagggggccccttgcaga

SEQ ID NO: 66234 - DNA, 201 bp, Homo sapiens
cctcccccaacgcctccgcttcttcctccctggacttctgccccgtcagagggcagcctgcaggcacctctctctgtcctggaagcctggccagcaagtcrgggccaagggctggtgggggcctgcagagagggccagcctgagccagaggaagagtcttggggttggctcaggtatgtccaggccatgagggcagaggaa

SEQ ID NO: 66235 - DNA, 201 bp, Homo sapiens
tctctctctgccttccagaacatgcccaatgtccgtgatcatgatgcctctgtctacctccgcctccaaggggatgccttgtctgtgggtggctatgaggycaaccccatcttttgggaggaggtaagatgccagggccctgggataatgggagggagttggggctgcatctcagcatggagagggcctctttcaggaagt

SEQ ID NO: 66236 - DNA, 201 bp, Homo sapiens
gcttcaacagcgcaggtgagtccgggcagcagccctcctggcccccaagagggaggtcctgtcattcccagagctctgggggaggcgggcgcaggagcacygtggcccccgacagtggtggggacaggagaggctggggagtccagccccttctgcttcccagagagtgcacctgtgccagggtccagtccagcagcagtc

SEQ ID NO: 66237 - DNA, 201 bp, Homo sapiens
atgagacccagtgcaagccacttcctcgtctctaatgcagggtgacggggaggggctgtggaggttctgggagcagggagggcatttgtactggtgaggcrcccagcatggggtctgcacatggaaacgctaagtcatccccagccgaggcatggactggggtgctggtggccagagccggtgacggcagcctatcccgat

SEQ ID NO: 66238 - DNA, 201 bp, Homo sapiens
aggtttatttctcgactctcaattctaatccattgatctgtaggtctatccttacttagtacctcactgtcttgattatgtagctttgcagtaagtttggwatcaagaagtgtgaatcctccaactttgtttttccttttcaaaattgttttgggtattcttggtcccttgcatctctgtatgaactttagggtcagctat

SEQ ID NO: 66239 - DNA, 201 bp, Homo sapiens
gtgagcagcagtgtgattggaggcttggaggggaggactggagagcctctcaggaagggtgggcggcaagcctttcgcttttagagagaccctggtgtcarcatctcaagccttccctgggcctctcagtgtctcacagaagagtctccaatctgctcctggggtgggggggtggggggatggcagtccactctccccact

SEQ ID NO: 66240 - DNA, 201 bp, Homo sapiens
cctcccaggttcaagccattctcctgtctcagactcctgagtagctgggattacagctgcccaccaccacgcccggttaattttttgtatttttagtagakatggggtttcaccatgttggccaggctgattttgaactcctgacctcaggtgattcacccatgtcggcctcccaaagtgctgggattacaggtgtgagcc

SEQ ID NO: 66241 - DNA, 201 bp, Homo sapiens
aagctgggctcccaaccccatcttacagacaaggaagggtgagaagcttgccccaggtcactgctgtggactgaatggtgacccccaaaacatatatctayatcctaactcgtcagaacctgtgaatggggccttgtttggaaataggatctttgcaggtgtaattaaggtcaggatctccagatgatattatctagggct

SEQ ID NO: 66242 - DNA, 201 bp, Homo sapiens
aactcactgtgacttgggtttgcgtgcctctgatgggtagtgacgtggagcatcttttcctgggcctgttggccatttgcatttgcttttgagaattgtcrattcaagtcccttgcctattttttttttttttaaatggagtctcactctgttgcccaggctggagtgcagtggcacaatctcggctcactgcagcctcca

SEQ ID NO: 66243 - DNA, 201 bp, Homo sapiens
acaatagtggagggaaggtcagcagataaacaagtgaacaaaggtctctggttttcctaggcagaggaccctgcggccttccgcagtgtttgtgtccctgrttacttgagattagggagtggtgatgactcttaaggagcatgctgccttcaagcatctgtttaacaaagcacatcttgcaccacccttaatccattcaac

SEQ ID NO: 66244 - DNA, 201 bp, Homo sapiens
ggtgtgagccctcccctcacccattatcaggggcatgggagacagccctgtaacaaaagactggttcacaagagaaaagcacaccagatagatttaatcaragctttatgtgacatgggagccatcagaaagggggacccagagacccagggaagacggttcctatgcttaaggtcggtgaagaatggggagccgtgtgga

SEQ ID NO: 66245 - DNA, 201 bp, Homo sapiens
atgcttaaggtcggtgaagaatggggagccgtgtggacaggtgttggacggcaggggatgcctgtggggatggactgtggggaggctggcgaggccagctstgcagctcccccttggcctctccgtgcagtgcttctcactcccaggcatgggacaggacccctggagcaaaggtcttatgacccacagtcagacaaggta

SEQ ID NO: 66246 - DNA, 201 bp, Homo sapiens
tcgcagcttcagactggttcgtttcttaccttcccctcccctggtgctttatttttaggcaggttagtgcgccctgctcacaccacctgcatttggcattyggtacagtgtggaggtgtcaccagagagggtgcctgccctcccttccttgcctcgttattggttctctctctctccctctctctctctctctctctctcc

SEQ ID NO: 66247 - DNA, 201 bp, Homo sapiens
agctgcctcccctctcctggggctggccctttcctggccctggcagcctccccaagcctaggcagtggctgcctgggtcagcctctacctgtgtggcctargagccaggccaggccaggtgcttgctgagctgacccaaaggctctgcttccgggatgacatcccccagaggaacaggccaggccaaacacagcgtggggg

SEQ ID NO: 66248 - DNA, 201 bp, Homo sapiens
acggcccatccctgggggaaggctgaggatgaggggaggtcagagcccgggttccgctccaaattgtttctcgtggctgcagctggggaatgcacgcaacrgcaccaccctgtcccgaggagagagaacctggctgcgctccctgtcccgaggagagagaacccagcacccctccctgtcccctgtgtgcttcccccgccc

SEQ ID NO: 66249 - DNA, 201 bp, Homo sapiens
cggcccctgtgacccagtgcgctctgctcaggggtttcctgtcaggctgcataatagctgccctgcgccgcggctctggactgttgcagttccaggacagrcgcagagaagatgctggcagtggagtcacagagaacagccctgccacactgctctgggactccgggcagttggggcctcagcgtcctcacgtggagaaca

SEQ ID NO: 66250 - DNA, 201 bp, Homo sapiens
atgctgacaacggtggggccagcagggcttcggccctggctggtggggcactgtggggtgggctcttccagtgtggagatgaccttgggcaggggctgcargttccattcaccctgcaaggaagggggcaggaggtaaactgaggctggaggggcaagatgggtggctgcttccccagccacttcccagccacctcttgga

SEQ ID NO: 66251 - DNA, 201 bp, Homo sapiens
gcgtcctcacgtggagaacagaaactagggtgacaccaaagatgtttacgaaacctccttccagcctcgtcctaatctgatggacaggtgggacccaaacrgtgactccaggctgaggatgcaggaggtgccctcaacatcaccccagcccttccattcagggacccctttgcatagctgccgccgtgataacccattgca

SEQ ID NO: 66252 - DNA, 201 bp, Homo sapiens
ccagggggccctctcctgggcgcatggcacctgtgcagcccatttctgtctgctcaggaagctccctgggcgtggcagcctcgtgcagcaggacgctgtcyaccctgatcagacacagccacacacattggggcctgggggctccagctggcaggtgagggctcaggtctcacgtgtggttcatctttcttcttgggtggc

SEQ ID NO: 66253 - DNA, 201 bp, Homo sapiens
gcctggcctgcttcctccgggtctgcggtttggccatagacccctggattgggccggtgaccacattcatctcacggcccatccctgggggaaggctgagratgaggggaggtcagagcccgggttccgctccaaattgtttctcgtggctgcagctggggaatgcacgcaacggcaccaccctgtcccgaggagagagaa

SEQ ID NO: 66254 - DNA, 201 bp, Homo sapiens
cagtagctggctccggagagctccgtgtggcagcctcccagctgccattgtgggcgtgggaggaggggctgctggggtgggagcacagccagtccccaaamagcaccccacatgtcccccaccaactctagaaagcctgtatcctgggggccagagcccgtcccttctgagatggtggtagtgtccggagccagcactcca

SEQ ID NO: 66255 - DNA, 201 bp, Homo sapiens
ggtttggccccctgagtctggggagggggctgcggctggagaccagggtgggggctgttggctttcacacgcttcaggctgaaggaacacctgcagcctcmccttgctcacaggcgggcctggcttctggatgagacagctttgtgggagccaggggaggagaggaggggagccggctccccagatggcctggcctgcttc

SEQ ID NO: 66256 - DNA, 201 bp, Homo sapiens
gtgggccggatggctggagtcaaggtcccgctggtggccatgcaccatgcctatgtcgtcaccgagcgcatcgaggggattcaggtaggtggacagccccrggttccgtgtcagtctgtggggggcacagagacctggctctgaatcccagcttgaacccaggtggtgtgacccttgtgggtcccctcactgccccaagcc

SEQ ID NO: 66257 - DNA, 201 bp, Homo sapiens
gtcccttgcctattttttttttttttaaatggagtctcactctgttgcccaggctggagtgcagtggcacaatctcggctcactgcagcctccacctcctkgattcaagtgattctcccacctcagcctcctgagtagctgggactacaggcatgcaccaccatgcccaactaattttttttttaaatatttttaatggaa

SEQ ID NO: 66258 - DNA, 201 bp, Homo sapiens
caagtgattctcatgcctcagcctcctgagtagctgggattacaggcgcacaccaccatgcccaactattttttctatttttagtagagacggggtttcgycatattggccaggctggtctgaaactcctgacctcaggtgatcctcccacctcagcctcccaaagtgctgggattacaggtgtgagccaccgtgttagaa

SEQ ID NO: 66259 - DNA, 201 bp, Homo sapiens
ctcctcatttgccttccaccatgattgtgaggcctccccagccatgtggaactgtgagtccattaaacctctttcctgtataaattacccagtcttggttrtgtctttattagcagcgtgagaacacactaatacaccatcttcttgtattcctgatgttcttgttgtggtttgtggttatttatttatgagacagagttt

SEQ ID NO: 66260 - DNA, 201 bp, Homo sapiens
ttccatatgaatgcgtgattttcaatcggaggactcttcttgggctgttgcttggacatttttctcgactccatttttctctgtcttctctttctggaacygctgtaaaatggatgttgaactttcaagacggaccttctgatattcttattttttttccactcctgatttctgttttgttgtctttttcttttagcctaa

SEQ ID NO: 66261 - DNA, 201 bp, Homo sapiens
ctgtgttgaaaatcatccattagacgtttgaagagtttgctccatgtcttccagcctccagcgatgcagtcccctgttgatggccctcctggccatccggygttgtgatgtttcccacggcgtggccttggtgcaggcctctgtccagactcagggcttggtgggcactcttgggcccttccatatgaatgcgtgattttc

SEQ ID NO: 66262 - DNA, 201 bp, Homo sapiens
ggggtatttgcatgtgtatatataactgtcactatttttccccagttgtgtcaagggatctgtcaaacatattgatactattgatactattttctgaataygcacacacatcagataaaccacctaacgcccccaagtcccatttccctcccctggaggacttcctgctgccttcagatcttccgctcccttttggactga

SEQ ID NO: 66263 - DNA, 201 bp, Homo sapiens
cagtgtttgtgtccctgattacttgagattagggagtggtgatgactcttaaggagcatgctgccttcaagcatctgtttaacaaagcacatcttgcaccrcccttaatccattcaaccctgagtggacacagcacatgtttcagagagcacagggttgggggtaaggtcacagatcaacaggatcccaaggcagaagaat

SEQ ID NO: 66264 - DNA, 201 bp, Homo sapiens
gaggtgcaggttgcagtgagttgagatggcaccactgcactctagcctgggcgatagagcaggactctgtcagaaagaaagagagaaagagagagagagaragagagagagagagagagagcgctagtagttttttagtggtttccttaggattttgtatatacaagaccttgttatctgcaaataggaatatttttactt

SEQ ID NO: 66265 - DNA, 201 bp, Homo sapiens
gcctcctgccctctcttctctcctgtcctcaactcctccctccagggatggtggctgggagcttcctgccactttgttactgacccccctctttccatccrttcatcatgcaaccctcccttactcattcctctctctgtccagccctccatctctccatccgtctctccatccatctactcccgtatctatccatgcctt

SEQ ID NO: 66266 - DNA, 201 bp, Homo sapiens
gaacccaggaggtgcaggttgcagtgagttgagatggcaccactgcactctagcctgggcgatagagcaggactctgtcagaaagaaagagagaaagagaragagagagagagagagagagagagagagcgctagtagttttttagtggtttccttaggattttgtatatacaagaccttgttatctgcaaataggaatat

SEQ ID NO: 66267 - DNA, 201 bp, Homo sapiens
ggggagtcccgtgggattttagaagcagttcctctcaattccaggtcattgagaactgcccagtgaccggcattcgtgtgtggacggatgattttggggtrcggcgggtcgcgggtgtggagactcagcatggttccatccagacaccctgcgtggtcaactgtgcaggtgcgagtggcatttctcctgactcctgtgtgg

SEQ ID NO: 66268 - DNA, 201 bp, Homo sapiens
ctcggtaggctgaggcaggagaatcacttgaacccaggaggtgcaggttgcagtgagttgagatggcaccactgcactctagcctgggcgatagagcaggwctctgtcagaaagaaagagagaaagagagagagagagagagagagagagagagagagcgctagtagttttttagtggtttccttaggattttgtatatac

SEQ ID NO: 66269 - DNA, 201 bp, Homo sapiens
ccccaagacccatacccgttatcaatcactccccatttcccaccctgtccccagacttaggcaatcccaaatctgatttctgcctcgatggagtttcctaktctggacgtttagtataaatggaatcacatgatgtctggcttctttttacggttttgtccgtgtagtacatgtatcagtatttcattcttttttgcagct

SEQ ID NO: 66270 - DNA, 201 bp, Homo sapiens
atggaactctggggctggctttgtttttagagtagtagtgctagcagaggtaaggatataactactactactactactactactattattattattattaytattattattattattattattattatttgagacagggtctcactctgtttcccaggctggagtgcagtggcatgatcatagctcactgcagccttgacc

SEQ ID NO: 66271 - DNA, 201 bp, Homo sapiens
cctgggcccctgagctgggagcctcgtccctgggggctgcccattgccaccctgtgccagcctggcttccctatggtcaccggggaggtaccaggcttggytgcttcgtagaccagggtagtgaagcgggtggcgaaatggggccggaacctgggtcccagtgcgctgctgcctctgactcctgtgcgctgggcaagccac

SEQ ID NO: 66272 - DNA, 201 bp, Homo sapiens
ggaaggggagacccacccaggccagctgaggcagcttcaggacgctcagggggaagcacttggtaccacgcctggcacagggaggaggctcaggagcaagsttctctctcctggagcgacggcccggagtgcaaacatacccacctccagtgggtgccagcccaagtgtgagctttattggctcattagcccgcacggcat

SEQ ID NO: 66273 - DNA, 201 bp, Homo sapiens
gaaactgaggcagcacagacccggctggggcctcagcacagacccggcttccttctccctctcgcaggctccaccgtgtacacgtgcatgctcaaccaccrtgggggcaccgagagtgacctgactgtcagccgcctggcacccagccaccaggcctccccgctggcccccgcctttgaaggtatgggatgcctctgtgca

SEQ ID NO: 66274 - DNA, 201 bp, Homo sapiens
gggatggtttcatccccgaggcccagctccggtgagtagtgcctgctgggctgtgctgctgggaggccctgccctgacaacccccttgcccctccgtgtgycccgtccttgcccctccgtgtgccctgcctccccaggtggttccactgtcgtgatcagttattctgcacacgggaagccgagccctgccgacttgccccc

SEQ ID NO: 66275 - DNA, 201 bp, Homo sapiens
gagtggggcggtgctgctggagcgggagcggctgacctccgggaccacctggcacacggcaggtagggaccgggggccaggtaggggcagggaaggatagsacatagcgaggggccacagcccattgctagctgggacagttcttggttcacaacaaccagcctggggaagagaccctggggaagggtgcatggccagttt

SEQ ID NO: 66276 - DNA, 201 bp, Homo sapiens
tctccacccacaagctactgagagccgcagggcacctggtaggttccagctggccacgtcctctgggtcgtgggtggcagcatggtgtgaggggtgcgccrggggatctgggggctgggggctctcgggcaggttcctttgcctccctgggcctcggtccccaactgtgaaggggggacagtgggaccaggcggccctcct

SEQ ID NO: 66277 - DNA, 201 bp, Homo sapiens
gggaaggaaagtaactaactcagggtcacacagcaggggcaggaatagcaacctgggctgctggactcacaccccaatcattcggaaggtgggcgagcccrgagtccctttggcttggggcatgtaggtcattttcaggtaacaaagcacttcccctaagcctctaaataaggaacttattttagataaaatcccccacaa

SEQ ID NO: 66278 - DNA, 201 bp, Homo sapiens
cggctcacgggcgagggtttggcgttgtggtggttcccatggactgggcgaggctcatagcacccgacagtggatggggtgtgctgagagggtcgggggarggtaggggacagagacagcttccgcgtgcatgatgaagagtggagggtgctggccgcagctgccgggaaagggactgggatgcggtggaatcatgcagtc

SEQ ID NO: 66279 - DNA, 201 bp, Homo sapiens
aaggccccgtggcaggccagtgcgtatgtctgaggcacgcattgaggctgggatggagcaggccaggagccgggctcagagggcagcagggtgagatactrgaggcccagcagctgctcctctgagggaggggtgctgagcagaggaggaacatggtcgggcttgggctttggtgggggggtctctgctgttgggtcagcg

SEQ ID NO: 66280 - DNA, 201 bp, Homo sapiens
tacctccccttgtggccccgacccccacttctacccagagcttggcgctccctgtcttttctgtgggctggcagagacctatcctcaccaaggttgccccygggcactgacagagcctgctgcataccaggcccttaatacatacacacagaatgaatgaatgaatgaatgagtgaatgaatgaatgaatgagtgaatgaa

SEQ ID NO: 66281 - DNA, 201 bp, Homo sapiens
cggatggctggagtcaaggtcccgctggtggccatgcaccatgcctatgtcgtcaccgagcgcatcgaggggattcaggtaggtggacagccccgggttcygtgtcagtctgtggggggcacagagacctggctctgaatcccagcttgaacccaggtggtgtgacccttgtgggtcccctcactgccccaagcctcagtc

SEQ ID NO: 66282 - DNA, 201 bp, Homo sapiens
atttggaacgtacatctgtcttggtgtatttttattaatccatgtttattgtcatctgtctcatgaggacagggacttatcccactcatggcaggtccccrgggcctttcctgcccaggccccacccgtgagcacttgctgactgagcgactttgctcttgcctgcagccgagccattttgcaggaggtgctggacgcaga

SEQ ID NO: 66283 - DNA, 201 bp, Homo sapiens
ttttttgtgtgtttttatatattgaccttgtatcctgcaacctcgttgaactattttattagttctaacagttttttttcttttttttcttttttttttttagtggattccttaggatttcctatatacaagatactgttttggcaaatagggatgtttttatttcttcttttctgatctggatgccttttatttttcttt

SEQ ID NO: 66284 - DNA, 201 bp, Homo sapiens
gaagacaaataagcaaaaaagaagtcaagatcacccagcagtaatagtattgacattttagtatgttttactccaaatatttttctatgaaaatatatatstatgcaaaatagaaccaagctgttgttattttgtgattttttttttttaccaagcagtagactgcaaacatctttctgttaatcaaatatcttgcttttt

SEQ ID NO: 66285 - DNA, 201 bp, Homo sapiens
gagcctgctgcataccaggcccttaatacatacacacagaatgaatgaatgaatgaatgagtgaatgaatgaatgaatgagtgaatgaatgaatgagtgartgaatgagtgaatgaatgaatgagtgaatgaatgaatgagtgaatgaatgaatgagtgaatgaatgaatgaatgagtgaatgaatgaatgccatggggaa

SEQ ID NO: 66286 - DNA, 201 bp, Homo sapiens
ctcttgttgcccaggctggagtgcaatggcacaatctcggcttactgcagcctccacctcccgggtttaagcaagtctcctgtctcagcctccagagtagytgggattacaggcatgcaccaccacccccggctaatgttgtatttttagtagagatggggtttctccatgttggtcaggctggtctcaaactcctgacct

SEQ ID NO: 66287 - DNA, 201 bp, Homo sapiens
tgtcattccccaggtagtaacccggcacccccatgtgttgggcacagtgctcagggccaagaacattagggaataaagtggaaatggctccctcccacccrggggcttctgttgtagtggaggagcaggaacgcacacccaggaaccgccccctgccaactgctggcagcagcgccaacagggcaggggtcctgggggcgg

SEQ ID NO: 66288 - DNA, 201 bp, Homo sapiens
gccaggcgctctcctcgcttgacccccaccaccccctgagcctgggaggaggagggcgttcctgggtcctctgctttgcagtgaggttaagttgttgctcraggccccagtcctgtgacaaaacccccacccatctgtctgatcccaagcccagggctgtcctcagccctcactcctgggaagctgactcaggtacgagac

SEQ ID NO: 66289 - DNA, 201 bp, Homo sapiens
tccacaaaaccgccattgtcatcatggcccgttctcaatgagctgctgggcacacctcccagacggggtggtggccgggcagaggggctcctcacttcccwgtaggggcggccgggcagaggcgcccctcacctcccggacggggcggctggccgggcggggggctgaccccccacctccctcccggacggggcggctggc

SEQ ID NO: 66290 - DNA, 201 bp, Homo sapiens
agatctggctgggatctccctctgcctctggctgcagggaccatccagctgcatgagcaggaccagggttcaccatatgggcagctgcctccccgcccccwgccgctcctccccacaagtctgcctaccctcaccaggcgaaggtgccaggcgctctcctcgcttgacccccaccaccccctgagcctgggaggaggaggg

SEQ ID NO: 66291 - DNA, 201 bp, Homo sapiens
tgacttagcagttaatctggctcccaaatgcttctgggaaggatcttcctggatctccaggctgcggcaccttacgcgactaactctgcataggccctggsctcctgaccacagcccagtgggcccaggataaattagatgccttcgaataccagtgggtctcagataaggaggaaaaaaccagctcgcagcttcagactg

SEQ ID NO: 66292 - DNA, 201 bp, Homo sapiens
cagctccccactgtgggcaggaagtccttctgaagccccatgtcctgtgtccccatcagacggtggcagtgcctgcggccatggacacagtgccccgagaygatttcttttcttttttcttctttttgagacagagtctagctctagtctcaggctagagtgcagtggcgcaatttcggctcactgcaacctccgcctccc

SEQ ID NO: 66293 - DNA, 201 bp, Homo sapiens
ttttcaaccccatcagacgtccaccccacactattctcagcaagccagtattagcccttccttcccttggtgctgaggatgtttgacttagcagttaatcyggctcccaaatgcttctgggaaggatcttcctggatctccaggctgcggcaccttacgcgactaactctgcataggccctggcctcctgaccacagccca

SEQ ID NO: 66294 - DNA, 201 bp, Homo sapiens
ggagaatcaattgaactcgggaggtggaggttgcagtgagctgagatcgtgccactgcactccagcctgcgtgacgggagcaagactccacttcaaaaaarcaaacacacaagaacaaaacaaacaaacaaaaaactagaaaatctgaacagaccaataatgagtaaggagattgaatcagtgatcaaacacctcctaaca

SEQ ID NO: 66295 - DNA, 201 bp, Homo sapiens
gggaagccgcccactgtgaaacacgagccactcagcagggaaatgtttaagcggcacccgcacccgctgcacaccgggagcagcggggcgggggcgggggygttcccggtgattccacaccccggcccagcatggtgcctgtcccagaagccaggccacacccagtgaggcggaacagggctggcggagggctggaccctg

SEQ ID NO: 66296 - DNA, 201 bp, Homo sapiens
aatagacaggatcaacaaaactaagagttgagtttttttgaaaaggttaacaaaacccacaaaccttaggctagactaaaataaaaaaagactcagataartaagaaaattataaatgaaagaggaaagattacaattgataccaaagaaataatagacaactatgccaacaaattggataacctagaaatgaataaattg

SEQ ID NO: 66297 - DNA, 201 bp, Homo sapiens
cctcccaaagtgctgggattacaggcatgagccacagcacccgaccttgtatcattttaattaatttaaaattaatcgtaagtagccacatgaggctagcrgccaccagaaagcacagccctggtgtgctctgggacccagtcgggcaggcacccctatgctggctggagcctggggtcgccccacttctctcaacactga

SEQ ID NO: 66298 - DNA, 201 bp, Homo sapiens
cccggacggggcggctggccgggcggggggctgaccccccacctccctcccggacggggcggctggccgggcagggggctgaaccccccacctccctccckgaaggggcggctgccgggcggagacgctcctcacttcccagacggggtggctgccgggtggagggtctcctcacttctcagacggggcggccgggcagag

SEQ ID NO: 66299 - DNA, 201 bp, Homo sapiens
attggcccccagcctcggcgctgctctggccgctgtgcttgcccgggtccggggaagccaccgtgttgctgctgtttcccaggcatctggaattgctgggrtgggaggtgtgttgtccggtggaagtcatattggctgccagaccttggctttgccggaccccagatgcccatgtccaactcaagatcacatggacacgaa

SEQ ID NO: 66300 - DNA, 201 bp, Homo sapiens
aggatataactactactactactactactactattattattattattattattattattattattattattattatttgagacagggtctcactctgtttyccaggctggagtgcagtggcatgatcatagctcactgcagccttgacctcctgggctcaagcgatcctcccacctccacctcccgagtagctgggactac

SEQ ID NO: 66301 - DNA, 201 bp, Homo sapiens
gtgcaggggtggcccccagggtgaccgactagagactcagagacccatgttcctatcctctctttcctcacccccgacacccctgaccccaggcaaccccmccccctccaggtgaccctgacccctggctgcaggaggcaggaacaggctggaaagagcaggcactgcccccaggagcaagtcccaggacagctctgggtg

SEQ ID NO: 66302 - DNA, 201 bp, Homo sapiens
gaagaggaggagggaagagaaaggagggaggagggaagagggggaggaaggaaggaggagaaggagggggaaggaaaaaggggagagaggaaggaggaggwggagggagagggaggagggagggagaaggagaagggggaggaagaggcctcagcaggtggaggactccccagctgtgcctgggcagagccaaagctgctc

SEQ ID NO: 66303 - DNA, 201 bp, Homo sapiens
tggtccagaagaggaggagggaagagaaaggagggaggagggaagagggggaggaaggaaggaggagaaggagggggaaggaaaaaggggagagaggaagsaggaggaggagggagagggaggagggagggagaaggagaagggggaggaagaggcctcagcaggtggaggactccccagctgtgcctgggcagagccaaa

SEQ ID NO: 66304 - DNA, 201 bp, Homo sapiens
gccatgtccggagggctgactttgggttcgccatcgacaagaccatcgcctacggttacatccatgaccccagcggtgggccggtgagtccccttctctgsccctgctaaggcagatgccgatccctcaccagctccaaaccagctccctgcactgcaccctgagtgtgccgggcatagggaggaggcacgggtgtggtcc

SEQ ID NO: 66305 - DNA, 201 bp, Homo sapiens
ggcaggtgtcagacaagtttgccttcggcctctttgacctggactgggaggtgttcacccagcacattgaaggcgccatcaacagggtccccgtgctggakaagacaggaatcaagtccacggtctgcggccctggtgagtgacagcctcggagctggggtgggcgtccatgggtcctttggtctgatgactgttagtagt

SEQ ID NO: 66306 - DNA, 201 bp, Homo sapiens
cgggttcaagcaattctcgtgcctcagcctcccatgtagctgggattaaatgtgcccgtcaccacacccggctgatttttttttgtattttagtagagacrgagtttcaccatgttgccaaggctggtctcgaactcctgagctcaggcaatccacccatctcggacttccaaagtgctaggattacaggcgtgagccacc

SEQ ID NO: 66307 - DNA, 201 bp, Homo sapiens
caccatgcctatgtcgtcaccgagcgcatcgaggggattcaggtaggtggacagccccgggttccgtgtcagtctgtggggggcacagagacctggctctraatcccagcttgaacccaggtggtgtgacccttgtgggtcccctcactgccccaagcctcagtcacctcatctgtgaaatggggattgtaacatggggta

SEQ ID NO: 66308 - DNA, 201 bp, Homo sapiens
gaggggggtactccatgcagagatgccagcaaagcctgactcccttacaacctcacactggctcccacttgtgtgtgaagaggaggtgaggcttgggcggrcggggctggcagccctgggaggttaagaattgcccacacctgcattcacagctgtgccgtgtcggcagttaggagggcaggtggcggggtggggggttgt

SEQ ID NO: 66309 - DNA, 201 bp, Homo sapiens
tccatgcagagatgccagcaaagcctgactcccttacaacctcacactggctcccacttgtgtgtgaagaggaggtgaggcttgggcggacggggctggcrgccctgggaggttaagaattgcccacacctgcattcacagctgtgccgtgtcggcagttaggagggcaggtggcggggtggggggttgtctgcaggagca

SEQ ID NO: 66310 - DNA, 201 bp, Homo sapiens
tgactcccttacaacctcacactggctcccacttgtgtgtgaagaggaggtgaggcttgggcggacggggctggcagccctgggaggttaagaattgcccrcacctgcattcacagctgtgccgtgtcggcagttaggagggcaggtggcggggtggggggttgtctgcaggagcagcggccagggaggggcatggggctg

SEQ ID NO: 66311 - DNA, 201 bp, Homo sapiens
gaatctgacataggagcagagccaaggcctgagcccagagtctcagagcccagggacagcttaggaggcatccacgagggggttccttcctggggcctctrggccagtcgcaagtccggcttgggtagggtctgaccctgcggtcgtccgttgccttgaagggccccgcttgggttcatgctgtgctgtcagtgccttgag

SEQ ID NO: 66312 - DNA, 201 bp, Homo sapiens
ggttcatgctgtgctgtcagtgccttgagactcttcatggtctttgagcaaggtccccactgggtcccgcactgggttctgtagccagttctgaagggaakaaaccgttcatttccaccatctccccgaaagcttgctctagtggtggaacatctgttcaaggcgtcggaagagggggctcctgcaggaaggaggaggcgt

SEQ ID NO: 66313 - DNA, 201 bp, Homo sapiens
cagcgcgggaggctgctgagggttttggttggcagccccggtggcatcagcaaaggtacagcagaaaccgacaaaggggagccctgtcctgaaggacagtratgcctggtggggctggagaagccatggagagctcaggaggcagatggtccctgtggtgtgctggtaacagcttaacaaccagctctctggggcagaggg

SEQ ID NO: 66314 - DNA, 201 bp, Homo sapiens
cttaacacatttaagaagattgaaatcatatcaagtatcgtttccaaccacaatggtataaaactagaaatcaataacaggaggaaaagtggaaattttayacatgtgtggaaattttttttttttttttttttattgatcattcttgggtgtttctcgcacagggggatttggcagggtcataggacaatagtggaggga

SEQ ID NO: 66315 - DNA, 201 bp, Homo sapiens
cagccaggcagccccggctgtcccgttcaatcgtacactgacaaagcggccaggaatgagacccagtgcaagccacttcctcgtctctaatgcagggtgayggggaggggctgtggaggttctgggagcagggagggcatttgtactggtgaggcgcccagcatggggtctgcacatggaaacgctaagtcatccccagcc

SEQ ID NO: 66316 - DNA, 201 bp, Homo sapiens
gtggggaatcagcatttctccttgccaggcacggccaatggcctttggcctccaggaaagagcagggaagtcccaggcccccgtgacttagggagcgcctsggagggcaggcagagctctcattccaggatggtggagctcaccaaggtcagggtgggagccgcaggcctggcccctggccatgttgcctggaggtcccat

SEQ ID NO: 66317 - DNA, 201 bp, Homo sapiens
cagtctcctgctcattggtgtaaaatcactggtgttgtaaaaagcacatcacggctgcataaaatactgctcattgctcggtttccaaccatcactgcgcrtgggtttcagcacaggggctgagtgcagacctcgcttctagcagtttccaaccatcactgcgcatgggtttcagcacaggggctgagtgcagacctcgct

SEQ ID NO: 66318 - DNA, 201 bp, Homo sapiens
tactccggaggctgaggcaggagaatcgtttgaacctgggaggcggaggttgtagtgagtctagattgtgccactgcaccaaaaaaaaaaaaaaaaaaaamcagagttgaacaacaatggaaggaaatcggaagcaggggccctcccaaatatacggggctcgcttctggaaacagcaaagtccactcctggttttgatgt

SEQ ID NO: 66319 - DNA, 201 bp, Homo sapiens
agttcgagaccagcctggccaacatgatgaaaccccatctctattaaaaatacaaaattagccgggcatggtggtgggtgcctgtaatcccagctactccrgaggctgaggcaggagaatcgtttgaacctgggaggcggaggttgtagtgagtctagattgtgccactgcaccaaaaaaaaaaaaaaaaaaaaccagagt

SEQ ID NO: 66320 - DNA, 201 bp, Homo sapiens
ccacgcccacccggaagcaactgcctacagccagggcaggcaggcgcttcttggtcccccactcaaagcccctggtaccaacacttcccatgtgccagccrtgctcttccagaacgcacccaacagcccactgcagataaggaaatcgaggccaaagagagaggccatctggccaggtcacatgttgttaaaggcagaaag

SEQ ID NO: 66321 - DNA, 201 bp, Homo sapiens
gtggctcaagtctgtaatcccagcactttgggaggctgaggtgggcagatcacttgaggtcaggagttcgagaccagcctggccaacatgatgaaaccccrtctctattaaaaatacaaaattagccgggcatggtggtgggtgcctgtaatcccagctactccggaggctgaggcaggagaatcgtttgaacctgggagg

SEQ ID NO: 66322 - DNA, 201 bp, Homo sapiens
ctgacaggtgtcactgaggatagaaacgcctctgatgtggctgctgaggcagccttgagtgatgagtgaggttctagcaggtggagcgtgacggggaggcrgggtgctgggaaagccgggggctgacagggaggtttgtgcgtgggaggcggctgcagggccctgatgcagctgggcccgggtctcactccagccagcagt

SEQ ID NO: 66323 - DNA, 201 bp, Homo sapiens
acatcaccccagcccttccattcagggacccctttgcatagctgccgccgtgataacccattgcacagggagaagtctgcagactggcaacaaaatgttaycagttagccctgggtgctggcctttctttgattttagcttacttttttttttttgtcttcctgcttttaatctttaaaacttttacagtgagcattcatg

SEQ ID NO: 66324 - DNA, 201 bp, Homo sapiens
caagtgattctcccacctcagcctcctgagtagctgggactacaggcatgcaccaccatgcccaactaattttttttttaaatatttttaatggaaacagrgtttcactatgttggccagggtggtctcgagctcctgacctcagatggtcctcccaccttggtctcccaaagtgctgggattacaggcatgagccaccac

SEQ ID NO: 66325 - DNA, 201 bp, Homo sapiens
ggcggctccagctgcctcccctctcctggggctggccctttcctggccctggcagcctccccaagcctaggcagtggctgcctgggtcagcctctacctgkgtggcctaggagccaggccaggccaggtgcttgctgagctgacccaaaggctctgcttccgggatgacatcccccagaggaacaggccaggccaaacaca

SEQ ID NO: 66326 - DNA, 201 bp, Homo sapiens
cttcctccctggacttctgccccgtcagagggcagcctgcaggcacctctctctgtcctggaagcctggccagcaagtcggggccaagggctggtgggggmctgcagagagggccagcctgagccagaggaagagtcttggggttggctcaggtatgtccaggccatgagggcagaggaacaagtctaccacagtccccac

SEQ ID NO: 66327 - DNA, 201 bp, Homo sapiens
ggagcccgcccctgggtgcacctgctgcctggacccaggtcctccaacaggcccttgggcagaacagcttgtccagaatgggccattctgaatagttaagygctctggtaaaccagagatgccattctgaataaatatcttcaaagcactggaatgcagataagccggtaacacgagtcagactgaaatttacagctgttc

SEQ ID NO: 66328 - DNA, 201 bp, Homo sapiens
aatacatacacacagaatgaatgaatgaatgaatgagtgaatgaatgaatgaatgagtgaatgaatgaatgagtgaatgaatgagtgaatgaatgaatgartgaatgaatgaatgagtgaatgaatgaatgagtgaatgaatgaatgaatgagtgaatgaatgaatgccatggggaagtggcaagaggaaggccctgggag

SEQ ID NO: 66329 - DNA, 201 bp, Homo sapiens
ggggagcagcctccctgagcctcagtttccctggctggggaatgaggaccttgctcgtcccccctcataaggggaagctgtcaggaaagtgctttcaacgytgagccatctcccagtggtgcacaattagctttccagaggattctggtggattcctagagctgagggctggggatcggcggtgctggttgctgggaaggt

SEQ ID NO: 66330 - DNA, 201 bp, Homo sapiens
gccaggtcctgccactacctggctcagcgacctgcccccccgagcctcagtttcccccattggtggaatggagtgaggaagacgcgcctcccggggctgcratggagaattgagtcagagtctgggggtgctgggagggctggggagcagcctccctgagcctcagtttccctggctggggaatgaggaccttgctcgtcc

SEQ ID NO: 66331 - DNA, 201 bp, Homo sapiens
gggcaggagatggggggcagccctgaccagcctgagagctgggatccccctcacatcccccactgtgcctaggacagggttctgggcttcgtcagggcttkggcagtgcccacagttcaggtgggacagagtgtggcagtgggtcctgagtccccctgggatggtcagaagagggggcaggagagagtccctggcactgcc

SEQ ID NO: 66332 - DNA, 201 bp, Homo sapiens
ttgggcggttccccagcgtgttgggcacccagcttgggcgtcaggcagctcccctgggtgttgggcacccagcttaggcattgggaagctcccccttcacragcccctccctgacgcccccacctgagggtgcagagggctgcagtgctgatgggcagtctgctcgggggggcggtcgccccagggaacctcctggagttg

SEQ ID NO: 66333 - DNA, 201 bp, Homo sapiens
gtgcagtggcgcgatctcggctcactgcaacctccgcctcccaggttcaagtgattctcctgcctcagcctcccaagtagctgggattacaggcgtgcacyaccacacccagctaatttttgtacttttagtagagatggggtttcaccatgttggccaggctggtcttgaactctcctgacctcgtgatctgcctgcctc

SEQ ID NO: 66334 - DNA, 201 bp, Homo sapiens
gttcttgaggaagaagcacaccccaaaggcccccgtggcattcccacctgtctggaacttttcagatcaagaaggagtgcctggcctgcagaggggccgcygctgtgtttgacatgtcctacttcgggaagttctacctggtggggctggatgcaaggaaggctgccgactggctcttctccgcagatgtcagccgacccc

SEQ ID NO: 66335 - DNA, 201 bp, Homo sapiens
gaaatacaatagttttttgtgtgtttttatatattgaccttgtatcctgcaacctcgttgaactattttattagttctaacagttttttttcttttttttyttttttttttttagtggattccttaggatttcctatatacaagatactgttttggcaaatagggatgtttttatttcttcttttctgatctggatgcctt

SEQ ID NO: 66336 - DNA, 201 bp, Homo sapiens
ttgaccttgtatcctgcaacctcgttgaactattttattagttctaacagttttttttcttttttttcttttttttttttagtggattccttaggatttcmtatatacaagatactgttttggcaaatagggatgtttttatttcttcttttctgatctggatgccttttatttttcttttcctgcctaattgccctggct

SEQ ID NO: 66337 - DNA, 201 bp, Homo sapiens
ctgtgcttgggaagcatgtgtcacagtgtgcacctgagctgagaagggcttggtgcgggctggaagagagggaggggaggctcagtacaggtgtgttggamacagcccccgttctccacgttcttgaggaagaagcacaccccaaaggcccccgtggcattcccacctgtctggaacttttcagatcaagaaggagtgcct

SEQ ID NO: 66338 - DNA, 201 bp, Homo sapiens
gctggatgcaaggaaggctgccgactggctcttctccgcagatgtcagccgacccccaggtatggagcctgaggttggggggcatgttcctgtcactccawgggcacagcctcaggcactgagatgagctggcaagccaccctgtcccctcgggcaccctgagcacactgctccttgccctcacctggctttgagctcccc

SEQ ID NO: 66339 - DNA, 201 bp, Homo sapiens
tgtgattgtgccactgcaagccgccctgggagacagggtgaccttgtctcaagccaaaatgaaacaaaacaaaccaaaaccaatatccttgcgtggctggragagacggtgtcgtgcagcccagaactggccatcgctgtggtcatggttagcaccaggggctttgtgtgctttcttgctggttcctcacagtggcccgtg

SEQ ID NO: 66340 - DNA, 201 bp, Homo sapiens
cctcatggatccatgagctcgttccttcgctcgttccctcaacagtcatcacgtgagcctgcactgtgtggaagcaccaggtagccagggtcgggaggagktgaaggaggccggtggggcttcagggaccccacagtgggctgtatgtccagacgggggcaggaagggccccgtaacacctggagggggacatgcaagggg

SEQ ID NO: 66341 - DNA, 201 bp, Homo sapiens
ggaaggccatgtgaagccgccgagccgggatgagcaaggcttcctggaggagagggccggcctgagcttggaaggatggggaggagccactggctacaagsgtgtagaggtgagaaccagtgtgacctgcccatcgctggtcgtctctgggtcattcagctgaaatggcatctctgagctgagaggagtgttgcctgtaag

SEQ ID NO: 66342 - DNA, 201 bp, Homo sapiens
agctggcaagccaccctgtcccctcgggcaccctgagcacactgctccttgccctcacctggctttgagctccccccgtccggccccctttgccccatccsaggccccaggccctcattactttcctccacctctccctcctgccttccttctcctccctacctctgccttcctctctactcttccagaaaggatgtgtgg

SEQ ID NO: 66343 - DNA, 201 bp, Homo sapiens
ccgaggggtccctggctcctccggaaacaccctccatgacaaggttaaggcttatccatgcgtgcattccttctataaacacctgccgggctgtgttcccyacccatgagaaaccaggaccggggaagaccctcggctgctggctcatgcacacagccacagaagagtcttgggcaaaaggacggctgagcaggtgtgcac

SEQ ID NO: 66344 - DNA, 201 bp, Homo sapiens
tgtgcaccttggaaagacccctctgactgtgcttcggaggctgggagaagggactgggggtgggggacagggaggaaggacatcatgttagcagccaccartggagcacctgtgacttgccaagcctgagccaacatctcccatccccacggtagccctttgaggtggtcataattgttcttatttttactgatgcagaaa

SEQ ID NO: 66345 - DNA, 201 bp, Homo sapiens
ggaggtcccatgtgtcctcgggttactcaacccgcatgagtcatttgtgaaacatccaagagacccttgttccctgcagctgcccctccgctagctcttgwtagcgctccccgcagattccctgtgaggttgttcagagcttctttcctgccctccctgggcctagaaatagttccagccctcccaaggtgctccctgggc

SEQ ID NO: 66346 - DNA, 201 bp, Homo sapiens
ttgcgtgggtctggcagcgagaaacacaggcccggaagaatcccaggggcacagataaccccaggcgtctctctgtctctctctatctttctcttcctctygttttaattagcctggggagccggtactccccacgaagccctattttggggaagatgtgcaggcaaggacatcttggatctggtctgtcggctggatggg

SEQ ID NO: 66347 - DNA, 201 bp, Homo sapiens
tggagtgaagtgcagccccggggagaagcagatagagccccaggggccggggcagcgtgcagggtaggagcacacagccgtgactcactgcccccaccccscagcttgcgtgggtctggcagcgagaaacacaggcccggaagaatcccaggggcacagataaccccaggcgtctctctgtctctctctatctttctcttc

SEQ ID NO: 66348 - DNA, 201 bp, Homo sapiens
ggagaaaggggctcattcatgatcagctcataacccgcaccttcggcagcagtcattgagcaccgactgtgtgtcaggctcagtttgaggcacggaggacycaacagtgagccaaacacaggaggttctggcccatgtggagtttgtatctctggtgggaggaaataggattaaaaaaataaaataagtggaaggtgtagg

SEQ ID NO: 66349 - DNA, 201 bp, Homo sapiens
atctctcgtcctgtaacccatccccaccagggatgaagaagcagagagggaaacattctctttctccaggaagaggcattgccacctctgggatgggaccygcacaggggaaggtgctgaccgtgcagctctctgtgctgtccccggggcaggggcacagtcagcggggagggctcagcccattcagaaaacctggcatct

SEQ ID NO: 66350 - DNA, 201 bp, Homo sapiens
ggatgtggattgtggattgtggacctggtccagatgctctgttcctcctggcctgtgggcttcaagggcattctatggttagataaccactctggcctcasttccccatctaagaatcgcgagtcccgttagagctatctccaagtctggcctcccccaggggtcctgctagccctagcgttaccccgttggaaggtggct

SEQ ID NO: 66351 - DNA, 201 bp, Homo sapiens
tgttgtgcccgctgtggtcagagctgggagattagaggtctcgtttcaggctaaatgggggctttgttcaggcggcattgctggagctcccagtactcagygattgcatctctgaacctgtccacgctgttgcggttcggagtggctgcagtgtgggcgtgctcggctcggtttcccggaacaaagcgtaccaatgctagg

SEQ ID NO: 66352 - DNA, 201 bp, Homo sapiens
gatcctcccacctcagcctcccaaagtgctgggattacaggtgtgagccaccgtgttagaaggacagcagtcagattagatgagggcccacactcatgacytcactttaacctgatcatatctgcaaagacctcatttccaaataagatcacactcccagtcctggtgaggactttcacatatcttttgtgggggacacaa

SEQ ID NO: 66353 - DNA, 201 bp, Homo sapiens
ttttatttctgtggggtaggcatgatctcctgtctttcattcctgattttagcactttgagtcctctcattttctctgtcactctagctagaagtttgtcyattttgttgatcttttcaaaacatcaactttttgttttgctgttttttcctatttttcgattcttatttctgttctaacatttcattccttctgcttgct

SEQ ID NO: 66354 - DNA, 201 bp, Homo sapiens
tttgtgtgtttttatatattgaccttgtatcctgcaacctcgttgaactattttattagttctaacagttttttttcttttttttcttttttttttttagkggattccttaggatttcctatatacaagatactgttttggcaaatagggatgtttttatttcttcttttctgatctggatgccttttatttttcttttcc

SEQ ID NO: 66355 - DNA, 201 bp, Homo sapiens
ctatgtttttgttttgttgcttgtgtttttggtgtcatgtctaagaacctaaccgaaggtaaaaaacatttatgttttcttctaagagttttatatcttcrcttttacacttaggtctaggatccatgaaaattaattttttttgcatggcgtgaggtcgggtccagccacgttcttttgcatgtggctacccagttggcc

SEQ ID NO: 66356 - DNA, 201 bp, Homo sapiens
tggtgtgatctcggctcactgcaacctccgcctcctgggttcaagcaatgctcctgcctcagcctccccagtagctgggattacaggtgcacaccaccacrcccagctaattttgtatttgtagtagagatggggtttctccatgttggctaggctggtctcaaactccagacctcaggtgatctgcctgcctcagcctcc

SEQ ID NO: 66357 - DNA, 201 bp, Homo sapiens
cttttaaaattgggttatttgtcttattattattattattattatttgagacagggtttcgctcttgttgcccaggctggagtgcaatggtgtgatctcgkctcactgcaacctccgcctcctgggttcaagcaatgctcctgcctcagcctccccagtagctgggattacaggtgcacaccaccacgcccagctaatttt

SEQ ID NO: 66358 - DNA, 201 bp, Homo sapiens
ttcatgggcctgttgtccacttgcatatattctgtggagagatgtctgttcagatcctttgtcccttttaaaattgggttatttgtcttattattattatyattattatttgagacagggtttcgctcttgttgcccaggctggagtgcaatggtgtgatctcggctcactgcaacctccgcctcctgggttcaagcaatg

SEQ ID NO: 66359 - DNA, 201 bp, Homo sapiens
gttgttcagagcttctttcctgccctccctgggcctagaaatagttccagccctcccaaggtgctccctgggccatccccaaacccagcccaggttacctycccaatccccccttttttaaaggtcttgctgtgttgcccaggctgcagagcagtggtgcgattttggctccctgcagcctctacctcctgggctcaagcc

SEQ ID NO: 66360 - DNA, 201 bp, Homo sapiens
tcggagctggggtgggcgtccatgggtcctttggtctgatgactgttagtagtgatgccccgtgagaccagcctgtgtcacacaggggacccagggctgtycccggtccctctcgctgcttggctccagcagccctgggtactaggtgtggcctttattcccctctacgggcgagaggcctgggcttcacaagggccatca

SEQ ID NO: 66361 - DNA, 201 bp, Homo sapiens
ggggtcctacaacgagaaggaccatctcgagcccgtgaccctgggtggaggtgctggcccaccacggggcatggggaaccaagtccccacccagttctggmtgatgccaaggcctctctctctgccttccagaacatgcccaatgtccgtgatcatgatgcctctgtctacctccgcctccaaggggatgccttgtctgtg

SEQ ID NO: 66362 - DNA, 201 bp, Homo sapiens
ccctgggtccccctagctgggcaaggcgtatggtgtggaatcccatgtgctgagcccggcagagaccaagactctgtacccgctgatgaatgtggacgacytctacgggaccctgtatgtgccgcacgacggtaccatggaccccgctggcacctgtaccaccctcgccagggcagcttctgcccgaggagcacaggtact

SEQ ID NO: 66363 - DNA, 201 bp, Homo sapiens
gctggcacctgtaccaccctcgccagggcagcttctgcccgaggagcacaggtactgatggccgcctggctctgggtcccctgttcccagcccactcctcytgccttagaaccctgagagcagaagggaagagaacaagagccattctctgactgctgtgtgactttgggccagtgaggacctctctgagccttctggtcc

SEQ ID NO: 66364 - DNA, 201 bp, Homo sapiens
ctacagatgggggttctcagggccaaggcagatcagggcaggtggtaattctacagatgatggttatcggggccagggcagatggggcaggtgctattctrtagctgggggttctcaggatgagggcagataggggaaggtgataattctacagatgggggttctcagggtgagggcagatggggcaggcggtaagtctat

SEQ ID NO: 66365 - DNA, 201 bp, Homo sapiens
cctggcggccaggtctgcgtgtgtctggaggacgactgtggccctcaggagcttgaagttgctgggtggccggtgggtccagatcccatgagatgaggccrgggactcgaggagcgtgtggaggacggagcggccaggaatcctgtcctcagtgacctctgcctcctcttgagggccctggggaggtgtgggccaggagag

SEQ ID NO: 66366 - DNA, 201 bp, Homo sapiens
cagcactgagcgcagccccactggcttctcgtccctctccctccttgtcctcccggcagctctctggagtggccagtgtgggcctggcggccaggtctgcrtgtgtctggagtggccagtgtgggcctggcggccaggtctgcgtgtgtctggaggacgactgtggccctcaggagcttgaagttgctgggtggccggtgg

SEQ ID NO: 66367 - DNA, 201 bp, Homo sapiens
ggtgagctggggctaaccatcttcacctagagaccctgatgcccagcactgagcgcagccccactggcttctcgtccctctccctccttgtcctcccggcrgctctctggagtggccagtgtgggcctggcggccaggtctgcgtgtgtctggagtggccagtgtgggcctggcggccaggtctgcgtgtgtctggaggac

SEQ ID NO: 66368 - DNA, 201 bp, Homo sapiens
cacccgggcccatggcagcgcacctggaagcggacggctgaggacttgttgcagtgcatggagatgggcgcgaagctgtacagggccttcagtacgtcgcrgttgaaggagttccagggaacagaggtgaactgctgagacacggacgcctgagggcaggtgcagacatcctcgttgttgaacctggtggggacaaggaac

SEQ ID NO: 66369 - DNA, 201 bp, Homo sapiens
agagggttccccccacaagtcaagtgaaagaacttgcccaactttcaagttctccaagtcaaggcatgggtgggtctagttttctggcgctgtggtcatcyggtttccctgacagtgtcgcaggggacctgctgctggcagaaatagtgtccccagctcccctctgggaggaggggttggttggagtggggtgggaagcac

SEQ ID NO: 66370 - DNA, 201 bp, Homo sapiens
agggcagccacagcaaaaggccacaagtggagaggtttcagcagaacttttttttccccacatttctggagactgggaggtccaagatcaaggtgtcagaygatgggttcctggagagggctctcctggcttgtagtcggccaccttctcactgtcctcatgcagcggggagagggccctggcgtcgcttcctcctcctat

SEQ ID NO: 66371 - DNA, 201 bp, Homo sapiens
cccacccacccacccacccaacagctcatgcgtccccatcttcatgagtgttctgggctgccagaacagaggatcacaaacctggtggcttaaaacaacamcaatttattgtcacggttctggaagctggaggtcaaaatgagggtgtctgtacctgacactctgcagaggacccttccttgctcttccagctgctggtgg

SEQ ID NO: 66372 - DNA, 201 bp, Homo sapiens
gtggacctggtccagatgctctgttcctcctggcctgtgggcttcaagggcattctatggttagataaccactctggcctcagttccccatctaagaatcrcgagtcccgttagagctatctccaagtctggcctcccccaggggtcctgctagccctagcgttaccccgttggaaggtggctgtcttatgtatatttgga

SEQ ID NO: 66373 - DNA, 201 bp, Homo sapiens
tggcctgcagaggggccgccgctgtgtttgacatgtcctacttcgggaagttctacctggtggggctggatgcaaggaaggctgccgactggctcttctcygcagatgtcagccgacccccaggtatggagcctgaggttggggggcatgttcctgtcactccatgggcacagcctcaggcactgagatgagctggcaagc

SEQ ID NO: 66374 - DNA, 201 bp, Homo sapiens
tggaatcaagaagtgtgaatcctccaactttgtttttccttttcaaaattgttttgggtattcttggtcccttgcatctctgtatgaactttagggtcagytatttaatttcttcaaagaaactagctgagattctgacaggcattgtgttgaagctatggatcaatttggggtgtgttgtcagcttaacaaaaataagtc

SEQ ID NO: 66375 - DNA, 201 bp, Homo sapiens
ctacctcctccaagtctgcagcctgagcgtctcacacccatgtcaggcagaggactttggggccgaggtgcccagttggagggttaggtcagggaacagarcggggtggtgtctgggaagagcactttctgcagtgggctgggaggaggccggaatctgctccaatccggctctgccttgggcaagttactctactcttct

SEQ ID NO: 66376 - DNA, 201 bp, Homo sapiens
tggtggccgggcagaggggctcctcacttccctgtaggggcggccgggcagaggcgcccctcacctcccggacggggcggctggccgggcggggggctgaycccccacctccctcccggacggggcggctggccgggcagggggctgaaccccccacctccctcccggaaggggcggctgccgggcggagacgctcctcac

SEQ ID NO: 66377 - DNA, 201 bp, Homo sapiens
tccccgtgctggagaagacaggaatcaagtccacggtctgcggccctggtgagtgacagcctcggagctggggtgggcgtccatgggtcctttggtctgaygactgttagtagtgatgccccgtgagaccagcctgtgtcacacaggggacccagggctgtccccggtccctctcgctgcttggctccagcagccctgggt

SEQ ID NO: 66378 - DNA, 201 bp, Homo sapiens
ttccaaaaagagagggtcctcaggccaatttggagggagatagccatggtcatagtagtggcgcttgcctaagtgtgggggactcagcgggcctcagcccygccccacatgatctcattccacagagggatcctctctcatcacaacctatagtccaggagtctgagccccagcgaaggccaccagtggcaggcggctctg

SEQ ID NO: 66379 - DNA, 201 bp, Homo sapiens
cacagatggggagactgaggcctgggggcaggagggagcggggctgagctgggaaaactgtgctgagtgtgtatgccgcggcttgcagccaggcagccccrgctgtcccgttcaatcgtacactgacaaagcggccaggaatgagacccagtgcaagccacttcctcgtctctaatgcagggtgacggggaggggctgtgg

SEQ ID NO: 66380 - DNA, 201 bp, Homo sapiens
cctgagccaggtatttataggcgatcagttgggttccagccaaccagatgcaggcgaggaatgcgtgtgcctgcgcagtcagcggaacctctgggttgaargcagttgtgagggccgatgaggacaagggccagagctgcagacccgggccccgggtgcgagagcgggcgcctgccgctgcccaaagaccctcctcaccac

SEQ ID NO: 66381 - DNA, 201 bp, Homo sapiens
aacaccatagggcccttatttccctgggtactcagcacagcccccagcgtgtcccctctgcaccccacccagctctgattctctccccagctccctgtttygctgaggcctggagcccccatggcctcactgagccgagccctacgtgtggctgctgcccaccctcgccagagccctacccggggcatggggccatgcaac

SEQ ID NO: 66382 - DNA, 201 bp, Homo sapiens
accaaacttgccttcctaggataaattccagttggccatggtgttttgttttgttttgttttgttttgtgtttttgagacagagtgagactctgttgcccrggctggagtgcagtggtgtgatcttggcttactgcaaccttcgcttcctgggttcaagcaaattctcctgcctccactcctgagtagctgggattacagg

SEQ ID NO: 66383 - DNA, 201 bp, Homo sapiens
tgttgccaaggctggtctcgaactcctgacctcaaatgaccctcccgccttggcctcccaaagtgctgggattacaggcatgagccaccacgtccagtctrgccatggtgtatcatctctcttatatattgctggattcagtttgctattgttttgttgggggtatttgcatgtgtatatataactgtcactatttttccc

SEQ ID NO: 66384 - DNA, 201 bp, Homo sapiens
gtgatgtttcccacggcgtggccttggtgcaggcctctgtccagactcagggcttggtgggcactcttgggcccttccatatgaatgcgtgattttcaatyggaggactcttcttgggctgttgcttggacatttttctcgactccatttttctctgtcttctctttctggaaccgctgtaaaatggatgttgaactttca

SEQ ID NO: 66385 - DNA, 201 bp, Homo sapiens
ggagcacccaccctgttggtcccagacccctgccaagcagcctggctggtggcacccagggcacacaggctaatgccgtcctcagcccagccgtcactgaygtggggcttccaaaccccttcagtgtgccagagtggacggccgccaccagcaggaccagccaccggcccccaagggctgtagcactaatgcaatgttctg

SEQ ID NO: 66386 - DNA, 201 bp, Homo sapiens
ctgttcttcaggtggcaaagcctcctgagagtcggcagcccgggaacacagaggagccgaagcagggagcgggcggggcctcagattggtgccctcctcayccacacagaagtgccagctcctgcctcagtttccccttgagcccctcgctcaccaggcccaggcaggagggacgtgctgctgggtaagagtctggtggag

SEQ ID NO: 66387 - DNA, 201 bp, Homo sapiens
gtcaagtgaaagaacttgcccaactttcaagttctccaagtcaaggcatgggtgggtctagttttctggcgctgtggtcatccggtttccctgacagtgtygcaggggacctgctgctggcagaaatagtgtccccagctcccctctgggaggaggggttggttggagtggggtgggaagcacccccggggagtcccgtgg

SEQ ID NO: 66388 - DNA, 201 bp, Homo sapiens
tgatcttggccacagaactgttggtgccacttgaacttgatctataagagaatcacgccctcctcatagggcatgacaggcttagcacggggcttggcacrcagtaggtgctccaaaaatgggggcctttgctatgtcactctctgagctgcccaagggcgggacctccctcacattcatcttggtccagttatttcctgc

SEQ ID NO: 66389 - DNA, 201 bp, Homo sapiens
actattagaatgagcaaagggtcagtttgaggacaggtaaaatcaatgtgcacatgccctctccaggggaaaggccctactgcagacagctttgcttgaamgagctcagttaacacgagctcagttacagtgcaaacgtggaggctgattgtgtggattgcagtcaccacggttgctgcgtccccaggacatggtgactcc

SEQ ID NO: 66390 - DNA, 201 bp, Homo sapiens
ctccccggcaaggggggaggctcctcctgtgtctcgtcctcatggcggtggcctctccgacccacacagcagggcctgtggcccgggccactccccgtgcrttgtggggtggctgtcgaggcaggacggcttggagggagcccggcctccgggtctctccagcccactctgctcccggctgctgctgctggtggacagcct

SEQ ID NO: 66391 - DNA, 201 bp, Homo sapiens
agaggctggagcaaaaaggtgggctcagctcccagatgccccacgtgggtcatccacagcgcagctcagccccaccccaccctactggcctggggagcccrgaaggctctgccccagggggcgggtgtggggctgaggctgctggcctggggagcccggaaggctctgccccagggggcgtgtgtggggctgaggctgctg

SEQ ID NO: 66392 - DNA, 201 bp, Homo sapiens
ctgtggtggaggctggtgggaatgggtaccagtgctgtgtggcccagggagggaggcctcctgcacctgcccactgaccgacacttgccacctaagtggcytgaatggaatgggacaggcaaggtggggggtcctctcatccttggggaccaatggcatcccacagaactccctccagggcctggaagggtctgacctcca

SEQ ID NO: 66393 - DNA, 201 bp, Homo sapiens
ctctacctccccttgtggccccgacccccacttctacccagagcttggcgctccctgtcttttctgtgggctggcagagacctatcctcaccaaggttgcycccgggcactgacagagcctgctgcataccaggcccttaatacatacacacagaatgaatgaatgaatgaatgagtgaatgaatgaatgaatgagtgaat

SEQ ID NO: 66394 - DNA, 201 bp, Homo sapiens
agtcctgctgtgaaacctgggacccagaccctcgggagcaggggacgcgaggccttaaggccagctgaggggtagcatttgatccagatttacagaaatcsaaatccccttcccggggctgcgtctcaccagtcccctctggtgcacccaccttccatccccatggcaacccacagcccaggccaggctccagagctccag

SEQ ID NO: 66395 - DNA, 201 bp, Homo sapiens
ccactcctggttttgatgttttctattcatcccttttactcactcgaagcccgagccctgctgtccaggccaggtgctgggctggctctggggaccagcgwagtcctagtaggccagccctatctgcgtggagccacggttgggtgtgcatcatgcagccccccattctcctccaggccgctgtggacgcgtccccaccct

SEQ ID NO: 66396 - DNA, 201 bp, Homo sapiens
cttcatcagcttccgccttagtcccaccgagctttggggctgatgagggggcaacccctcttgtctgggtttgggaggggcctgcccaggaggaggtgctrgctccaggcttgggggttgggtgccccgtctcgaggctgcctgccgataccctgcggccactgctgtagcatccacgatgcctctccctcctcctggctc

SEQ ID NO: 66397 - DNA, 201 bp, Homo sapiens
tataccacagtgtgcagtgagacagccttgggccatgtgaaaagttgggggtatgaatgggacgcagaaaggttccattttgtttttttttgttgttgttkttttttttttgagacagggttttactctgttgcccaagctggagtacagtggtgtgatctcagctcactacaacctccacctcccaggtcaagcaattct

SEQ ID NO: 66398 - DNA, 201 bp, Homo sapiens
gcaggggccctcccaaatatacggggctcgcttctggaaacagcaaagtccactcctggttttgatgttttctattcatcccttttactcactcgaagccygagccctgctgtccaggccaggtgctgggctggctctggggaccagcgtagtcctagtaggccagccctatctgcgtggagccacggttgggtgtgcatc

SEQ ID NO: 66399 - DNA, 201 bp, Homo sapiens
aacattgtcgattcacctcactcctctcacccctggaggatgtgggtttccaggctgacagttatgttcgaagctctgtgcttggaagatactgttctacrgtagattagcatctactagagccacgccaaggggtggtttcagggtttcaggcctctctctctgtcttatgtatttgcgatggagtctcactctgttgcc

SEQ ID NO: 66400 - DNA, 201 bp, Homo sapiens
gtccaggccaactggctgggaacagcgcctggccactgggaagacgggcaacaggcagccctgtgggtcctgagcccttgcccccagccagggccaagcargaaggggactctgttcccagcagggtccacgctatcacaaaggacccctgccccaaccctttatttgcagagctacatctgataataacagacatgtcac

SEQ ID NO: 66401 - DNA, 201 bp, Homo sapiens
ggctggagtgcagtggcacgatctcggctcactgcaagcaccacgttctgggttcacgcattctcctgcctcagcctcccgaatagctgggactacaggcrcccgccaccacgcccagctaattttttgtatttttagtagagacgaggtttcaccatattagtcaggatggtcttgatttcctgacctcgtgatctgcct

SEQ ID NO: 66402 - DNA, 201 bp, Homo sapiens
tcattcccctcttgtccaggccaactggctgggaacagcgcctggccactgggaagacgggcaacaggcagccctgtgggtcctgagcccttgcccccagycagggccaagcaggaaggggactctgttcccagcagggtccacgctatcacaaaggacccctgccccaaccctttatttgcagagctacatctgataata

SEQ ID NO: 66403 - DNA, 201 bp, Homo sapiens
ttgccttgctcagtctccctctcctccagccccagctaagtctcacccctcctccatccactctgcgtcctccagggttggttggaatctcccatcctctrctgctgcctctgcctgttctctcatctttgtcggttatatgttttgcttccctcccttcctcccttgctctcttcctcgatccattccttcttccttctt

SEQ ID NO: 66404 - DNA, 201 bp, Homo sapiens
ggctccagacatccgcctgccttggcctcccaaagtactgggattacaggcgtgagccactgcacccggcctcagctcactctttctgccccatcgtcacyttctctggagccttccttgtctctcacccagatggctgctccggcctctgccctctgccctgataacccaggccctccacgtagggccctgcccctctag

SEQ ID NO: 66405 - DNA, 201 bp, Homo sapiens
cttccttgtctctcacccagatggctgctccggcctctgccctctgccctgataacccaggccctccacgtagggccctgcccctctagcctgcctcctcyaccctcccctgcagtggccctgccaccttctgcccctcaaggagccctgcctctcctggccaggctcttagcccaggctccccgtggctctctgccccct

SEQ ID NO: 66406 - DNA, 201 bp, Homo sapiens
ttaatactagtggatgtaaactcaaatagccccctgtgctggtagaggctgggctcggtggctcatgcctgcaaccctagcactttgggaggccgaggtgrtaagatcgcttgagtccgggagtttgagaccagcctgagcaacatagcgagatcctatctctaaaaaaacaacaaaaaaatttttcaattagctcagcac

SEQ ID NO: 66407 - DNA, 201 bp, Homo sapiens
cctcatctagagtctaacatggtgtggtgctggggtgccaacagtagcagctggcacctcagtgacgcgtggccctcagttcatcgtattttctttacgasaccgtctgttttttgcttatttaagtatttgctccctccctccgtcagctcctcgagggctgggacatgtcctgctcagcgctgcctcccagggccaagc

SEQ ID NO: 66408 - DNA, 201 bp, Homo sapiens
ccaggggctttgtgtgctttcttgctggttcctcacagtggcccgtggcatcacagatgagggactggggcttggtagggttcaggggtaagtacagggcstgggactagaaccggggcctctgactgggaagctcgtggacccctggaactgggcttcccctgaggttgctgagcccatagcctgggtcagagcccttca

SEQ ID NO: 66409 - DNA, 201 bp, Homo sapiens
atctagagtctaacatggtgtggtgctggggtgccaacagtagcagctggcacctcagtgacgcgtggccctcagttcatcgtattttctttacgagaccrtctgttttttgcttatttaagtatttgctccctccctccgtcagctcctcgagggctgggacatgtcctgctcagcgctgcctcccagggccaagcccag

SEQ ID NO: 66410 - DNA, 201 bp, Homo sapiens
cagctgccattgtgggcgtgggaggaggggctgctggggtgggagcacagccagtccccaaacagcaccccacatgtcccccaccaactctagaaagcctstatcctgggggccagagcccgtcccttctgagatggtggtagtgtccggagccagcactccatgggacctggccccaggcaggaggctccctcagagacc

SEQ ID NO: 66411 - DNA, 201 bp, Homo sapiens
gagtatgtgcactgcaaaagggactccaggcctctctctccttctttcagaatccttcacgcccgaccacaagcccctgatgggggaggcacctgagctcygagggttcttcctgggctgtggcttcaacagcgcaggtgagtccgggcagcagccctcctggcccccaagagggaggtcctgtcattcccagagctctgg

SEQ ID NO: 66412 - DNA, 201 bp, Homo sapiens
gggactggaggtcctgggggacaaatctgggttctgttagcagataaacaatctggcgatgactgtcagggaggaggcggccagaaactagggagatcccrgcggctctgctctcacctcccctctccagaggctgcacaggggcaggaagcagggccggctgtgtctagcttgcttcctgcctctgtggtgcaaagctgc

SEQ ID NO: 66413 - DNA, 201 bp, Homo sapiens
ggctgcgggttctcccaccttgctgaggcttggcataggtgctgcttctgtctggtttggctacaggacggggagacgaccaggtgggaacacgtcccctyccatttgaggcccagcagccttgcccccacccgcacggccactccagcaagctgctgggacttgttctcagacaggcggctccagctgcctcccctctcc

SEQ ID NO: 66414 - DNA, 201 bp, Homo sapiens
cccatttgaggcccagcagccttgcccccacccgcacggccactccagcaagctgctgggacttgttctcagacaggcggctccagctgcctcccctctcytggggctggccctttcctggccctggcagcctccccaagcctaggcagtggctgcctgggtcagcctctacctgtgtggcctaggagccaggccaggcca

SEQ ID NO: 66415 - DNA, 201 bp, Homo sapiens
ttcactgagaggtgggtggattttgtgccctcgattgccatcccctcagaatcccaggcaggcagggaggacatgtccatgtcattgatgaatgctgtggycttgggcgtgcctcctccttcttggggcctcgggggtggaggggagggcaagtgctgttgggacagaccctcagcgggccatctggaaccagatgctgcc

SEQ ID NO: 66416 - DNA, 201 bp, Homo sapiens
cctcacttccctgtaggggcggccgggcagaggcgcccctcacctcccggacggggcggctggccgggcggggggctgaccccccacctccctcccggacrgggcggctggccgggcagggggctgaaccccccacctccctcccggaaggggcggctgccgggcggagacgctcctcacttcccagacggggtggctgcc

SEQ ID NO: 66417 - DNA, 201 bp, Homo sapiens
tgccccctcagaacaaggatgctgggtctgtgggcaggtctcgtgagctgcggcacgaagctcatctggctgggacatggtggtcagcggcatctcagagkaccgttggggacattcatagcctgccaatgagttagcgaaaacccctctaatcccatcccagagaaaccagggttgacagttgagtgtgttgcccgccat

SEQ ID NO: 66418 - DNA, 201 bp, Homo sapiens
cacctcccagacggggtggtggccgggcagaggggctcctcacttccctgtaggggcggccgggcagaggcgcccctcacctcccggacggggcggctggycgggcggggggctgaccccccacctccctcccggacggggcggctggccgggcagggggctgaaccccccacctccctcccggaaggggcggctgccggg

SEQ ID NO: 66419 - DNA, 201 bp, Homo sapiens
gctgggtaagagtctggtggagtccccctttctaggtgacctttgtctttgctgttgatttggacgcggttcctgcccatgccctcctccttgtctggcccttgcaggaggaccctctcttaggctctgccctgcacgctgccttgagatggggtggctcctctgcccaccttctcttccccctgataactgcctgtgtgt

SEQ ID NO: 66420 - DNA, 201 bp, Homo sapiens
tgctcctcatttgccttccaccatgattgtgaggcctccccagccatgtggaactgtgagtccattaaacctctttcctgtataaattacccagtcttggktatgtctttattagcagcgtgagaacacactaatacaccatcttcttgtattcctgatgttcttgttgtggtttgtggttatttatttatgagacagagt

SEQ ID NO: 66421 - DNA, 201 bp, Homo sapiens
gcaagtgtctccatccctcaacacaaccccctccctgccctgctgtgccactaccaccgccttctctgggcactcctgcctcccaggtcccatccccaccscgcaggacctggggtctgccccagcacagacctgtggggcagcagggctgcttggcccctcaggagcatcttgagctccgaaagggctctcaaggctggc

SEQ ID NO: 66422 - DNA, 201 bp, Homo sapiens
gtttgggaggggcctgcccaggaggaggtgctggctccaggcttgggggttgggtgccccgtctcgaggctgcctgccgataccctgcggccactgctgtrgcatccacgatgcctctccctcctcctggctctctgtctgggagcgcaagtgtctccatccctcaacacaaccccctccctgccctgctgtgccactacc

SEQ ID NO: 66423 - DNA, 201 bp, Homo sapiens
gggggcaacccctcttgtctgggtttgggaggggcctgcccaggaggaggtgctggctccaggcttgggggttgggtgccccgtctcgaggctgcctgccrataccctgcggccactgctgtagcatccacgatgcctctccctcctcctggctctctgtctgggagcgcaagtgtctccatccctcaacacaaccccctc

SEQ ID NO: 66424 - DNA, 201 bp, Homo sapiens
ggtggaaagagaggaagaggttactaggcagcatgtgatggctggtcctctgggtgcacatgcggtagctgtacatgtttgttcatacgtcacatgtctcwttcgcatctttttttttttttttttgagacggagtttcactcttgttgcccaggctggagtgcaatggcacaatctcggcttactgcagcctccacctcc

SEQ ID NO: 66425 - DNA, 201 bp, Homo sapiens
caccctctcagccatgcaggggaccctgggggaagaaggctggattggaccgtggtctcaggcaggggcgtggtctggccccttcatcctgggcgtgcagkgctgttccatggggatcgtcgcagagtagagtgcacagtgccggtgtgagcccacagggacagcatggaggagggggaggagtaggtcccccctcagcct

SEQ ID NO: 66426 - DNA, 201 bp, Homo sapiens
ctgtggggtgggctcttccagtgtggagatgaccttgggcaggggctgcaggttccattcaccctgcaaggaagggggcaggaggtaaactgaggctggargggcaagatgggtggctgcttccccagccacttcccagccacctcttggattcttgccctcaaactcagcttgtctcaaactgaactcactctgctcccc

SEQ ID NO: 66427 - DNA, 201 bp, Homo sapiens
ggtagtgtccggagccagcactccatgggacctggccccaggcaggaggctccctcagagaccaggatcggggcccagattctagttctgggccagcacgwccctcttctgggctttgtttccttgttggaaaacaggcatcttggcatctgctttgacttctcgaggctgagatgaggatggtaaacacagcagcccctg

SEQ ID NO: 66428 - DNA, 201 bp, Homo sapiens
caggggaggtgggacatgagcgtcaactggcgtgcgcgatcgtggggacacaggaaataggcggcggggaggtgctacacgcataaggaggcccagctgcygggaaacacgccgcgcaccggccgtggcagttatccatggtgtacctcccagcaccgtcagctcacgtagggccactgggactctcagtcaagcactagt

SEQ ID NO: 66429 - DNA, 201 bp, Homo sapiens
cgtcaactggcgtgcgcgatcgtggggacacaggaaataggcggcggggaggtgctacacgcataaggaggcccagctgctgggaaacacgccgcgcaccrgccgtggcagttatccatggtgtacctcccagcaccgtcagctcacgtagggccactgggactctcagtcaagcactagtgttttactaaacttaacgat

SEQ ID NO: 66430 - DNA, 201 bp, Homo sapiens
cgttcccagtgctgtgcttctcgtcctctccctcactagcgctcgagagactctggagtgaactctggacatgctgcctgggagcctgctgggtgctggaytggggtcccaggatggaagatgtggctccttccctcgatgggctcagaccccgagtgaggttggggcccaggaagggacctgcagccacagcccagcctg

SEQ ID NO: 66431 - DNA, 201 bp, Homo sapiens
ccaggatggaagatgtggctccttccctcgatgggctcagaccccgagtgaggttggggcccaggaagggacctgcagccacagcccagcctgtactggaragaggtcctaggcagggtgaggggtgaccccaggccaacgggttctcatggaaccgagagtcccgcaaagatggccacagagaactgagtgttggcaaga

SEQ ID NO: 66432 - DNA, 201 bp, Homo sapiens
tgctgacaacggtggggccagcagggcttcggccctggctggtggggcactgtggggtgggctcttccagtgtggagatgaccttgggcaggggctgcagrttccattcaccctgcaaggaagggggcaggaggtaaactgaggctggaggggcaagatgggtggctgcttccccagccacttcccagccacctcttggat

SEQ ID NO: 66433 - DNA, 201 bp, Homo sapiens
ccaacgggttctcatggaaccgagagtcccgcaaagatggccacagagaactgagtgttggcaagaaccagacagggtggggcaaggccccgagtgtctcracctcttggctagaaaaaaagtgtggcccgtgttggggggctctgccctgggactgaccccaggggcctgtggacgagccgggagcccacatcagctgcc

SEQ ID NO: 66434 - DNA, 201 bp, Homo sapiens
cctatcccgatggccttctgccagtcagggccatctcttgcagagcacaggacagtggtgcaggcgctccccggcaaggggggaggctcctcctgtgtctygtcctcatggcggtggcctctccgacccacacagcagggcctgtggcccgggccactccccgtgcgttgtggggtggctgtcgaggcaggacggcttgga

SEQ ID NO: 66435 - DNA, 201 bp, Homo sapiens
aggacagtggtgcaggcgctccccggcaaggggggaggctcctcctgtgtctcgtcctcatggcggtggcctctccgacccacacagcagggcctgtggcycgggccactccccgtgcgttgtggggtggctgtcgaggcaggacggcttggagggagcccggcctccgggtctctccagcccactctgctcccggctgct

SEQ ID NO: 66436 - DNA, 201 bp, Homo sapiens
tggtctccagggtcagagaagggctccttgtcggcaggacaacggccacaagacagcgggaccccaccaggcagaacccagccaggtcgccgtcagctggytctggcagcacacgtggaggggctcagagagcacgggcaggagccagcggggaggcccccatgaggaagtggcgctgagcagggcctagaggagggaggg

SEQ ID NO: 66437 - DNA, 201 bp, Homo sapiens
gaggctcctcctgtgtctcgtcctcatggcggtggcctctccgacccacacagcagggcctgtggcccgggccactccccgtgcgttgtggggtggctgtygaggcaggacggcttggagggagcccggcctccgggtctctccagcccactctgctcccggctgctgctgctggtggacagcctccctggggaggcagta

SEQ ID NO: 66438 - DNA, 201 bp, Homo sapiens
tcggtgcgcccctcgcctctgctgacctagtcctttcctggcctgatgaggacattacgcccactgtggagaagaatgtctgaccccacggagacagtgasactgaggccccccagctgccacccctccatggcacccgacacagtgaagcctcctctggctgactcagagcccgtctgggcctgcgcccctgcactctcc

SEQ ID NO: 66439 - DNA, 201 bp, Homo sapiens
tgctgggaaagccgggggctgacagggaggtttgtgcgtgggaggcggctgcagggccctgatgcagctgggcccgggtctcactccagccagcagttccrcactgtctgattcgggacgggtggctggtctgaggagaccagggaacaagccgcggggcactgattgctctgcccactcaggggcagcagaggcctaggc

SEQ ID NO: 66440 - DNA, 201 bp, Homo sapiens
aagccgggggctgacagggaggtttgtgcgtgggaggcggctgcagggccctgatgcagctgggcccgggtctcactccagccagcagttccgcactgtckgattcgggacgggtggctggtctgaggagaccagggaacaagccgcggggcactgattgctctgcccactcaggggcagcagaggcctaggccgcaggtg

SEQ ID NO: 66441 - DNA, 201 bp, Homo sapiens
ctttattctccgaatgtcgtgactgttcccctgttcctttgaacgttccccgagaaccacttggaacgccctcagctgcgtctccagtgccctgctcatgygtttcacaccgggtccacctctctgctttggaagtggccccgggaggaacttcccttgaacaccgtcctcccagtagatgctgactgttggtctgagaga

SEQ ID NO: 66442 - DNA, 201 bp, Homo sapiens
gcctaggccgcaggtgcagccacagagctccgtagctccatgagaaatagcatggggcccgccgggttcgtgctggacaccaccgggggctgccgtggccrcacactgtgtccccagcctcgaaggaacaaacccaaaactatcgcagccacatcatctccggtcccaggcgctggattgggcagccgctccccagacaca

SEQ ID NO: 66443 - DNA, 201 bp, Homo sapiens
gaagtggccccgggaggaacttcccttgaacaccgtcctcccagtagatgctgactgttggtctgagagagggtagagctgggcccaccaggtcggaggtrtgtgcggttcatggtcccgggtcactctgtggtgtgttcttctctgtccttccgtatttctgcgcccctcgcttgcccagtgctaccctaggtctcaggc

SEQ ID NO: 66444 - DNA, 201 bp, Homo sapiens
gggtggggtggctctgggggagaaagctgagttcacccaagggtggggcgaatggagagtcaggggcccgctcaatgctgagccacaaaggggactctggwgcaggggaccggggtccaggcttaccctgggtcctaggctagcccttccctgacgggccatccccaaagcagtgacccgtccccctgtctgcggcaggcg

SEQ ID NO: 66445 - DNA, 201 bp, Homo sapiens
cactctgtggtgtgttcttctctgtccttccgtatttctgcgcccctcgcttgcccagtgctaccctaggtctcaggcggagtgggagagaagcacaatgytttctaggctggggtccctgcgtgtgggatgggggggaggggaaacacaggggaggtgggacatgagcgtcaactggcgtgcgcgatcgtggggacacag

SEQ ID NO: 66446 - DNA, 201 bp, Homo sapiens
tccgagagcgaagccatgagtcctacgccaagaactactccgtcgtcttcccccacgatgagccgctggccgggcgcaacatgaggagagacccgctgcaygaggtaacgcccctacagctcctgctggggactggcagcgagggtctgggacgtcctcagggcagcggagtgacagaaatgcaaggtgtaccccaaccgc

SEQ ID NO: 66447 - DNA, 201 bp, Homo sapiens
tcagccacagacactggggggtttgggaccaaagcatccatgttacccaaggctcggtggagctcaggccagaagcctggcttcccatcctgcccggtccytctgcgggtcgcctctctgggcctcagtgtccccacctgtagcacggagtctagcacaatgtctaaaattctttccgggcctttccataagtctgtccag

SEQ ID NO: 66448 - DNA, 201 bp, Homo sapiens
agcgaaggccaccagtggcaggcggctctgctggcttcaggaatcattcccctcttgtccaggccaactggctgggaacagcgcctggccactgggaagaygggcaacaggcagccctgtgggtcctgagcccttgcccccagccagggccaagcaggaaggggactctgttcccagcagggtccacgctatcacaaagga

SEQ ID NO: 66449 - DNA, 201 bp, Homo sapiens
gcttcattcctgtagcatgttttcaaggttcatcctgtgataaaatgtgtccaaatttcgttgctttttatggctgaataatattccatggtgtatgcagwccatgctttgttgatccactcatcagctgagggccacgggggttctctcccctggttagtggttgcgcatagagctcagtgaacatgcgtgaacggaatt

SEQ ID NO: 66450 - DNA, 201 bp, Homo sapiens
ctctgtctgggtctgagaacattgtcgattcacctcactcctctcacccctggaggatgtgggtttccaggctgacagttatgttcgaagctctgtgcttsgaagatactgttctacagtagattagcatctactagagccacgccaaggggtggtttcagggtttcaggcctctctctctgtcttatgtatttgcgatgg

SEQ ID NO: 66451 - DNA, 201 bp, Homo sapiens
gggcagccacctgcttctcaggaaggaccacccttaccctgggagggcatctcttctactttgacagaggatagaaaacattctgtcttcatgaaatcacrgggatattcagtggtagttttctttttcaggttcttattgaaaaaataaaatcttggcagtgtaaattcagcccttgaaaattgttctggaaatttccct

SEQ ID NO: 66452 - DNA, 201 bp, Homo sapiens
ggcttcattcctgtagcatgttttcaaggttcatcctgtgataaaatgtgtccaaatttcgttgctttttatggctgaataatattccatggtgtatgcaraccatgctttgttgatccactcatcagctgagggccacgggggttctctcccctggttagtggttgcgcatagagctcagtgaacatgcgtgaacggaat

SEQ ID NO: 66453 - DNA, 201 bp, Homo sapiens
ggactaaaggtgcccatcaccacagccagctaatttttgtatttttagtagagatggggtttcgctgtgttggccaggctggtctcaaactcctggcctcragtgatccgcccaactcggcctcccaaagtgctgggattgcaggcgtgagccactgcgcccggactctttctgtgatttccatgcagggattcactggta

SEQ ID NO: 66454 - DNA, 201 bp, Homo sapiens
gcggcctctgccctccttcccacaggcgtatcccagcgggagctgtacagggagggcctttccactcagagcagtggtggaatcagctcctccgctgtctrggatcctgcagtcagcctagctctccccattccttttgtgagctctctggtcccagggctgagcactcaggccttcccatgggagtcagtgggttcaacg

SEQ ID NO: 66455 - DNA, 201 bp, Homo sapiens
agttactaggaacttctatgtgccacctgacaacgatcccctggtgcagatattctcattccaatgaacaggactcctgggatcctggcggagagggaggragcatctgccagaatgtcccttctggtctctgcacatcccctttcctgctcccagagacaggacaggggtcgtatctccctgtgctcatctccagttctg

SEQ ID NO: 66456 - DNA, 201 bp, Homo sapiens
gttttgcaattcttttgtcaaatttgttcctaagcatatttattatttttgatgatattgtaaatgaaattatttcttaacttccttttcagattattcartgctagagtatagaaatatattagttttttggctgagcccagtggctcatgcctataatcccagcactttgggaagctgaggtgggtggattgcttgagg

SEQ ID NO: 66457 - DNA, 201 bp, Homo sapiens
caggctcgctccaccacatccggctaattttttgatttttttgtagagatgccgtctcgctatgttgctcaggctggtcctgagctcctgggctccagacmtccgcctgccttggcctcccaaagtactgggattacaggcgtgagccactgcacccggcctcagctcactctttctgccccatcgtcaccttctctggag

SEQ ID NO: 66458 - DNA, 201 bp, Homo sapiens
tcctgggctccagacatccgcctgccttggcctcccaaagtactgggattacaggcgtgagccactgcacccggcctcagctcactctttctgccccatcrtcaccttctctggagccttccttgtctctcacccagatggctgctccggcctctgccctctgccctgataacccaggccctccacgtagggccctgcccc

SEQ ID NO: 66459 - DNA, 201 bp, Homo sapiens
gacaggaatcaagtccacggtctgcggccctggtgagtgacagcctcggagctggggtgggcgtccatgggtcctttggtctgatgactgttagtagtgaygccccgtgagaccagcctgtgtcacacaggggacccagggctgtccccggtccctctcgctgcttggctccagcagccctgggtactaggtgtggccttt

SEQ ID NO: 66460 - DNA, 201 bp, Homo sapiens
tccccgtggctctctgccccctcagctcctagcgtgggggccctgattgctctccagggagcgggacggcacttgctcctgatctgcatgcagaggatgaycccccagacttggagccatccccgtatcatcgttcacgaacgaagtgccctggggtccctcagaccagggccggccgcttcctcatctagagtctaacat

SEQ ID NO: 66461 - DNA, 201 bp, Homo sapiens
ccttggtgttctgggggaactgctcccagcagtggtaacagcaggtgcaaaggccccgtggcaggccagtgcgtatgtctgaggcacgcattgaggctggratggagcaggccaggagccgggctcagagggcagcagggtgagatactggaggcccagcagctgctcctctgagggaggggtgctgagcagaggaggaac

SEQ ID NO: 66462 - DNA, 201 bp, Homo sapiens
gaatgcgtgtgcctgcgcagtcagcggaacctctgggttgaaagcagttgtgagggccgatgaggacaagggccagagctgcagacccgggccccgggtgygagagcgggcgcctgccgctgcccaaagaccctcctcaccaccagacgaattgggcgcgattcccagctgagcactgctgctgttgtgcagtgattgttc

SEQ ID NO: 66463 - DNA, 201 bp, Homo sapiens
gctgctgggcacacctcccagacggggtggtggccgggcagaggggctcctcacttccctgtaggggcggccgggcagaggcgcccctcacctcccggacrgggcggctggccgggcggggggctgaccccccacctccctcccggacggggcggctggccgggcagggggctgaaccccccacctccctcccggaagggg

SEQ ID NO: 66464 - DNA, 201 bp, Homo sapiens
tctcgaggctgcctgccgataccctgcggccactgctgtagcatccacgatgcctctccctcctcctggctctctgtctgggagcgcaagtgtctccatcmctcaacacaaccccctccctgccctgctgtgccactaccaccgccttctctgggcactcctgcctcccaggtcccatccccaccccgcaggacctggggt

SEQ ID NO: 66465 - DNA, 201 bp, Homo sapiens
tgaaagcagttgtgagggccgatgaggacaagggccagagctgcagacccgggccccgggtgcgagagcgggcgcctgccgctgcccaaagaccctcctcrccaccagacgaattgggcgcgattcccagctgagcactgctgctgttgtgcagtgattgttctccgagaggctgggatctgacccaggctgccacgatcc

SEQ ID NO: 66466 - DNA, 201 bp, Homo sapiens
ccccaaatatcttgcctcgaggccagcaagattccccgtgggtcagtgctctcccggcgtgtctcccagagctccgctcggccagacacggtgttcccagrgcccctgccgaggacgggccccgccgcgaagcagcatgctgggctgggagcactccgtggggcacggtgatcaagtgattttctctgaaaattaatttca

SEQ ID NO: 66467 - DNA, 201 bp, Homo sapiens
caccgagagtgacctgactgtcagccgcctggcacccagccaccaggcctccccgctggcccccgcctttgaaggtatgggatgcctctgtgcacacggcrctgtgactgcggcctgctctgtggactggtggttgtggacagggcaggatggacgggatgggctgctgacggcagctctgtcattagctgttgtgcccgc

SEQ ID NO: 66468 - DNA, 201 bp, Homo sapiens
atgctgggctgggagcactccgtggggcacggtgatcaagtgattttctctgaaaattaatttcagctcaaaaggaaattgaatctcttttcctgacagcragaagtcctagtcgcggcgctgttaggatttgattagctcaggatggagcagtcctgcacccacacacgttagataactatgacatgccagtcagagacc

SEQ ID NO: 66469 - DNA, 201 bp, Homo sapiens
gtagtaacccggcacccccatgtgttgggcacagtgctcagggccaagaacattagggaataaagtggaaatggctccctcccacccgggggcttctgttstagtggaggagcaggaacgcacacccaggaaccgccccctgccaactgctggcagcagcgccaacagggcaggggtcctgggggcggggtcttggtgggt

SEQ ID NO: 66470 - DNA, 201 bp, Homo sapiens
gatacccgatatcatgggcaggttccctgatgcagcacagagagactggtggccgcaggctggggcaccgtgttccctgtcacgggtcgagctgttgccaygatagtgtgaagggcctgggccccaaggggaagttggagcgagggtgtttgtggagtgggtggtgggaagcttcgacccccacccgggtttgctgcttct

SEQ ID NO: 66471 - DNA, 201 bp, Homo sapiens
acacccaggaaccgccccctgccaactgctggcagcagcgccaacagggcaggggtcctgggggcggggtcttggtgggtgtatgcagccacgtattgggrgagcagccagaacacggcgtacattggagaggggctcctgcctgtagagcctgctgcggaggctcttctgccctggtgagcttcgactcacccattcagt

SEQ ID NO: 66472 - DNA, 201 bp, Homo sapiens
agccgggacaccacatccttcatcagcttccgccttagtcccaccgagctttggggctgatgagggggcaacccctcttgtctgggtttgggaggggcctrcccaggaggaggtgctggctccaggcttgggggttgggtgccccgtctcgaggctgcctgccgataccctgcggccactgctgtagcatccacgatgcct

SEQ ID NO: 66473 - DNA, 201 bp, Homo sapiens
ggtggaggggagggcaagtgctgttgggacagaccctcagcgggccatctggaaccagatgctgcccccgaggccctctcagccctgcgctcggggcctcrttccagtcagagggggtggcccctgggtagggcccttccaaacccgagagtgggttttcttttttttcccaaaccaaatttatttttaaagaaacctccc

SEQ ID NO: 66474 - DNA, 201 bp, Homo sapiens
gctggagtgcagtggtgtgatctctgctcactgcaagctctgcctcctgggttcatgccattctcctgcctcagcctcccgagtagctgggactacaggtkcctgctaccacgcctggctaattttttgtattttttagtagagacagggtttcaccacgttagcaaggatggtctcgatctcctgaccttgtgatccacc

SEQ ID NO: 66475 - DNA, 201 bp, Homo sapiens
ctgcttgctttctaaacggtcttgtttggtttggcttgtttattggttaaatcagtggttcctctctgcaatattatgatgatgtaaacactgcttttttktttgtttgttttgttttgttttttttgagacagagtttcactttgttgcccacactggagtacagtggcacagtgtcagctcactgcaacctccgcctcc

SEQ ID NO: 66476 - DNA, 201 bp, Homo sapiens
cgaccgggatggtttcatccccgaggcccagctccggtgagtagtgcctgctgggctgtgctgctgggaggccctgccctgacaacccccttgcccctccrtgtgccccgtccttgcccctccgtgtgccctgcctccccaggtggttccactgtcgtgatcagttattctgcacacgggaagccgagccctgccgacttg

SEQ ID NO: 66477 - DNA, 201 bp, Homo sapiens
gagtagtagtgctagcagaggtaaggatataactactactactactactactactattattattattattattattattattattattattattattattwgagacagggtctcactctgtttcccaggctggagtgcagtggcatgatcatagctcactgcagccttgacctcctgggctcaagcgatcctcccacctcc

SEQ ID NO: 66478 - DNA, 201 bp, Homo sapiens
cggggtcctacaacgagaaggaccatctcgagcccgtgaccctgggtggaggtgctggcccaccacggggcatggggaaccaagtccccacccagttctgratgatgccaaggcctctctctctgccttccagaacatgcccaatgtccgtgatcatgatgcctctgtctacctccgcctccaaggggatgccttgtctgt

SEQ ID NO: 66479 - DNA, 201 bp, Homo sapiens
ggggaggtgtgggccaggagagcagaggttctgggcccttagtgtcaatgttacagtttttgctgacctgggaggctgtccctcaaagtggccagggccaygcgctcccaggtggccccagcctgggacacagtgccctccccatttcctggccagcaagacgggtggggatacagccactggccacggccagctccccct

SEQ ID NO: 66480 - DNA, 201 bp, Homo sapiens
gaccgggatggtttcatccccgaggcccagctccggtgagtagtgcctgctgggctgtgctgctgggaggccctgccctgacaacccccttgcccctccgygtgccccgtccttgcccctccgtgtgccctgcctccccaggtggttccactgtcgtgatcagttattctgcacacgggaagccgagccctgccgacttgc

SEQ ID NO: 66481 - DNA, 201 bp, Homo sapiens
ctgtcctgctctatggaactctggggctggctttgtttttagagtagtagtgctagcagaggtaaggatataactactactactactactactactattaytattattattattattattattattattattattattatttgagacagggtctcactctgtttcccaggctggagtgcagtggcatgatcatagctcact

SEQ ID NO: 66482 - DNA, 201 bp, Homo sapiens
ccagggctgagcactcaggccttcccatgggagtcagtgggttcaacggtttgcctgaaggtgaggacgcagactccagttactgggtgtggacgtgccaygcacccgaaccaagtgtgtgaggaaaatcacacctcctgtgcaagaagccccccatgctgtctgtggcctccacgcagccgagtgctagcctgttgtgca

SEQ ID NO: 66483 - DNA, 201 bp, Homo sapiens
ctccggtgagtagtgcctgctgggctgtgctgctgggaggccctgccctgacaacccccttgcccctccgtgtgccccgtccttgcccctccgtgtgcccygcctccccaggtggttccactgtcgtgatcagttattctgcacacgggaagccgagccctgccgacttgcccccaaggctcagtgcattctttgtgccgt

SEQ ID NO: 66484 - DNA, 201 bp, Homo sapiens
cactgtcctgctctatggaactctggggctggctttgtttttagagtagtagtgctagcagaggtaaggatataactactactactactactactactattattattattattattattattattattattattattattatttgagacagggtctcactctgtttcccaggctggagtgcagtggcatgatcatagctca

SEQ ID NO: 66485 - DNA, 201 bp, Homo sapiens
cttgtcctcccggcagctctctggagtggccagtgtgggcctggcggccaggtctgcgtgtgtctggagtggccagtgtgggcctggcggccaggtctgcrtgtgtctggaggacgactgtggccctcaggagcttgaagttgctgggtggccggtgggtccagatcccatgagatgaggccggggactcgaggagcgtgt

SEQ ID NO: 66486 - DNA, 201 bp, Homo sapiens
ctgagcactcaggccttcccatgggagtcagtgggttcaacggtttgcctgaaggtgaggacgcagactccagttactgggtgtggacgtgccatgcaccygaaccaagtgtgtgaggaaaatcacacctcctgtgcaagaagccccccatgctgtctgtggcctccacgcagccgagtgctagcctgttgtgcaggtgtg

SEQ ID NO: 66487 - DNA, 201 bp, Homo sapiens
ccgtgtgccccgtccttgcccctccgtgtgccctgcctccccaggtggttccactgtcgtgatcagttattctgcacacgggaagccgagccctgccgacytgcccccaaggctcagtgcattctttgtgccgttcacgcaattcccactcctcgtcctccccactacccgtccgctgtggccaggccttccatggcctaa

SEQ ID NO: 66488 - DNA, 201 bp, Homo sapiens
cccactgtcctgctctatggaactctggggctggctttgtttttagagtagtagtgctagcagaggtaaggatataactactactactactactactactattattattattattattattattattattattattattattatttgagacagggtctcactctgtttcccaggctggagtgcagtggcatgatcatagct

SEQ ID NO: 66489 - DNA, 201 bp, Homo sapiens
agacgaccttagcgcacagatttactgtcacctgggctgagtggccggctctgtggggtcattcccatgctcatgttcttggagtccgtggggtccatcgrggacagactgggggtgagctggggctaaccatcttcacctagagaccctgatgcccagcactgagcgcagccccactggcttctcgtccctctccctcct

SEQ ID NO: 66490 - DNA, 201 bp, Homo sapiens
gaaggtgaggacgcagactccagttactgggtgtggacgtgccatgcacccgaaccaagtgtgtgaggaaaatcacacctcctgtgcaagaagccccccaygctgtctgtggcctccacgcagccgagtgctagcctgttgtgcaggtgtgcgggacacaccctcccaaagacaccagctgtcctcggcggagcagggtgt

SEQ ID NO: 66491 - DNA, 201 bp, Homo sapiens
cccactgtgttccagtcagatctggccctggaagcccctctcccctgtccctgggcgaggagaggagagtcaggaacacaccccaggtcccaagatgggcrgattttgcacccccacccgggagccagcctgggtgtccaggacaccttggcagggctgcagtgggtgggatgtccctgctggggaggggggtactccatg

SEQ ID NO: 66492 - DNA, 201 bp, Homo sapiens
tccccactgtcctgctctatggaactctggggctggctttgtttttagagtagtagtgctagcagaggtaaggatataactactactactactactactactattattattattattattattattattattattattattattatttgagacagggtctcactctgtttcccaggctggagtgcagtggcatgatcatag

SEQ ID NO: 66493 - DNA, 201 bp, Homo sapiens
gtctctgccgacagccagtggcccagggccccactccttaggaagacagacgaccttagcgcacagatttactgtcacctgggctgagtggccggctctgyggggtcattcccatgctcatgttcttggagtccgtggggtccatcggggacagactgggggtgagctggggctaaccatcttcacctagagaccctgatg

SEQ ID NO: 66494 - DNA, 201 bp, Homo sapiens
acccgaaccaagtgtgtgaggaaaatcacacctcctgtgcaagaagccccccatgctgtctgtggcctccacgcagccgagtgctagcctgttgtgcaggygtgcgggacacaccctcccaaagacaccagctgtcctcggcggagcagggtgtgcctaggcccggctcagtgcctctgggagcctctgtgtccgcctcag

SEQ ID NO: 66495 - DNA, 201 bp, Homo sapiens
caaaatagaaccaagctgttgttattttgtgattttttttttttaccaagcagtagactgcaaacatctttctgttaatcaaatatcttgcttttttttawaaaaaaaaaagtcagctactttttcacgttatgaaaagagggttccccccacaagtcaagtgaaagaacttgcccaactttcaagttctccaagtcaagg

SEQ ID NO: 66496 - DNA, 201 bp, Homo sapiens
ccgagagcgaagccatgagtcctacgccaagaactactccgtcgtcttcccccacgatgagccgctggccgggcgcaacatgaggagagacccgctgcacraggtaacgcccctacagctcctgctggggactggcagcgagggtctgggacgtcctcagggcagcggagtgacagaaatgcaaggtgtaccccaaccgca

SEQ ID NO: 66497 - DNA, 201 bp, Homo sapiens
caagaagccccccatgctgtctgtggcctccacgcagccgagtgctagcctgttgtgcaggtgtgcgggacacaccctcccaaagacaccagctgtcctcrgcggagcagggtgtgcctaggcccggctcagtgcctctgggagcctctgtgtccgcctcagcccacagacattattgaccgtgttcccaccgttgcaagg

SEQ ID NO: 66498 - DNA, 201 bp, Homo sapiens
gcaaaatagaaccaagctgttgttattttgtgattttttttttttaccaagcagtagactgcaaacatctttctgttaatcaaatatcttgcttttttttwaaaaaaaaaaagtcagctactttttcacgttatgaaaagagggttccccccacaagtcaagtgaaagaacttgcccaactttcaagttctccaagtcaag

SEQ ID NO: 66499 - DNA, 201 bp, Homo sapiens
acagcatggaggagggggaggagtaggtcccccctcagcctttgcccccaccaatgctgacaacggtggggccagcagggcttcggccctggctggtgggrcactgtggggtgggctcttccagtgtggagatgaccttgggcaggggctgcaggttccattcaccctgcaaggaagggggcaggaggtaaactgaggctg

SEQ ID NO: 66500 - DNA, 201 bp, Homo sapiens
tcgctcacggaccacccccgctggatccgagagcgaagccatgagtcctacgccaagaactactccgtcgtcttcccccacgatgagccgctggccgggcrcaacatgaggagagacccgctgcacgaggtaacgcccctacagctcctgctggggactggcagcgagggtctgggacgtcctcagggcagcggagtgaca

SEQ ID NO: 66501 - DNA, 201 bp, Homo sapiens
caagccaaggggtgccgggaggtgctcgggaggtgctcgggaggaggctccctcgagagtggaagggtcgtctccggagcctgcagaggaagcgtggctcrcccacatggtgattttggattttgagcctccagaaccgagagagagtttactgttattgttttaagccaccagttgtggtcgtttgttatgacaggtagg

SEQ ID NO: 66502 - DNA, 201 bp, Homo sapiens
ttgtctcaactccgcacatcattgtagaacaatttttttgtttgtttgtttgagacagtatctcgctctgtcgcccaggctgtagtgcagtggcatgatcwctgctcactgcaagctctgcctcccgggttcatgccattctcctgcctcagcctcctgagtagctgggactacaggcacccgccaccactcccgtctaat

SEQ ID NO: 66503 - DNA, 201 bp, Homo sapiens
gccagacgacagccccctggaggcaggcctggccttcacctgcaagctcaagtcgccggtgcccttcctggggagggaggccctggagcagcagcgggccrcaggcctccgccggcgcctggtgtgcttcaccatggaggagtgagtatcccgctgttccacgcccacccggaagcaactgcctacagccagggcaggcag

SEQ ID NO: 66504 - DNA, 201 bp, Homo sapiens
agttgtggtcgtttgttatgacaggtaggaaactaacccagtcctggagaagacctgaggtctgcagatagcaaacctgccatctccccttcccaaaggtraccccctacttctcctcaaagatttccagagcagctggagggagcagctctccttggaagaccccatttcttgatggcaatctggctgggacccagggcc

SEQ ID NO: 66505 - DNA, 201 bp, Homo sapiens
gaccagagcaaggatgaaggctcagagcgggctttgggcggttccccagcgtgttgggcacccagcttgggcgtcaggcagctcccctgggtgttgggcamccagcttaggcattgggaagctcccccttcacgagcccctccctgacgcccccacctgagggtgcagagggctgcagtgctgatgggcagtctgctcggg

SEQ ID NO: 66506 - DNA, 201 bp, Homo sapiens
ttttgtacttttagtagagatggggtttcaccatgttggccaggctggtcttgaactctcctgacctcgtgatctgcctgcctcggcctcccaaagtgctsggattacaagcgtgaggatcccaacatgctgggattcaaaccaggccagtgtaaggttgcgcacctggggcccctcccaggccagcagggcccgtgggga

SEQ ID NO: 66507 - DNA, 201 bp, Homo sapiens
agcttaggcattgggaagctcccccttcacgagcccctccctgacgcccccacctgagggtgcagagggctgcagtgctgatgggcagtctgctcgggggrgcggtcgccccagggaacctcctggagttggggatgcccctgcctcctgcccaggtgactaagcagctctgagagtgtggctaggggctggagggggtgg

SEQ ID NO: 66508 - DNA, 201 bp, Homo sapiens
caggtctcaaaagagaaaggtgcagccaagcccaggccacccctctgtggcaggtctaggccgagggccttgggagggtgaacccagggagcctgacctcycagtcactgcaacacgacctcccatcccgttctggttcagtctccccacagccctgtgatagggggagaggggctcggctggggccgtcatccccactca

SEQ ID NO: 66509 - DNA, 201 bp, Homo sapiens
ggtttcgctcttgttgcccaggctggagtgcaatggtgtgatctcggctcactgcaacctccgcctcctgggttcaagcaatgctcctgcctcagcctccycagtagctgggattacaggtgcacaccaccacgcccagctaattttgtatttgtagtagagatggggtttctccatgttggctaggctggtctcaaactc

SEQ ID NO: 66510 - DNA, 201 bp, Homo sapiens
tgggagcctttgttggctcaacagacatttatcaagcacctgcacttgctgggctctgaccctgtgctgggcggggggaagtggagtgagaaaactggtcyctgccctctcaaggtccagtgggcaggagtgacaagtctctggcagggacacagcaggacgctggtgcactgggggagccgcagcatggtctccagggtc

SEQ ID NO: 66511 - DNA, 201 bp, Homo sapiens
ggagggagggggttgggtggaggggcccctgcagaccctgcctgatcactgctctcttggaagacctcaccccaagagtatgtgcactgcaaaagggactscaggcctctctctccttctttcagaatccttcacgcccgaccacaagcccctgatgggggaggcacctgagctccgagggttcttcctgggctgtggctt

SEQ ID NO: 66512 - DNA, 201 bp, Homo sapiens
ttattattattatttgagacagggtctcactctgtttcccaggctggagtgcagtggcatgatcatagctcactgcagccttgacctcctgggctcaagcratcctcccacctccacctcccgagtagctgggactacaggcatgtgccaccactcctggctaatttttgtatttttatagagatggggttttgctatgct

SEQ ID NO: 66513 - DNA, 201 bp, Homo sapiens
gggcaggagctggcccactggatcatccatgggcgcccggagaaggacatgcatggctatgacatcaggtaagtgcccattgggacctaagggcagggccygccactcaggacaggtggcgtggggtaaacagcgagggctactgagaaaggagccttgcctgaaatccaggtggcttcctggaaggggcagcagtgaggg

SEQ ID NO: 66514 - DNA, 201 bp, Homo sapiens
agtgggatggcatcaccccacctcacagatggggagactgaggcctgggggcaggagggagcggggctgagctgggaaaactgtgctgagtgtgtatgccrcggcttgcagccaggcagccccggctgtcccgttcaatcgtacactgacaaagcggccaggaatgagacccagtgcaagccacttcctcgtctctaatgc

SEQ ID NO: 66515 - DNA, 201 bp, Homo sapiens
ggctgtcccgttcaatcgtacactgacaaagcggccaggaatgagacccagtgcaagccacttcctcgtctctaatgcagggtgacggggaggggctgtgraggttctgggagcagggagggcatttgtactggtgaggcgcccagcatggggtctgcacatggaaacgctaagtcatccccagccgaggcatggactggg

SEQ ID NO: 66516 - DNA, 201 bp, Homo sapiens
atggaaacgctaagtcatccccagccgaggcatggactggggtgctggtggccagagccggtgacggcagcctatcccgatggccttctgccagtcagggycatctcttgcagagcacaggacagtggtgcaggcgctccccggcaaggggggaggctcctcctgtgtctcgtcctcatggcggtggcctctccgacccac

SEQ ID NO: 66517 - DNA, 201 bp, Homo sapiens
ggctgactcagagcccgtctgggcctgcgcccctgcactctcccaagcgaggaatgtcccggaaatgataaaactgtaaaggacttcaaggaagggccaaytcaggcccctcctgctgcaaacagcaaaatggaggtgacttgcctgaagtcacccggcttttgaaccagagccaggtagggacccagctccctccccagg

SEQ ID NO: 66518 - DNA, 201 bp, Homo sapiens
cctgctgcaaacagcaaaatggaggtgacttgcctgaagtcacccggcttttgaaccagagccaggtagggacccagctccctccccaggagggacagtcytcatgccctggcctcccttggggattccagctctggaacccaccaaccagggttctgtgtggcctctctgtgcctctgtatcctcggctgcaaaatggag

SEQ ID NO: 66519 - DNA, 201 bp, Homo sapiens
catctgtccatccatcctccatccacaaagtaatttatgccacagacatttatggagtcttctccggtaccaggcacggagctaggagccccagaatgaayggggggcatgaatcctgtccctagaaacttctcagcatggtggtggatgggtgggaggggccagtgccaaggcatttcaagaagaaagaagcttccttcc

SEQ ID NO: 66520 - DNA, 201 bp, Homo sapiens
gaatcagccctgacaggtgtcactgaggatagaaacgcctctgatgtggctgctgaggcagccttgagtgatgagtgaggttctagcaggtggagcgtgasggggaggcggggtgctgggaaagccgggggctgacagggaggtttgtgcgtgggaggcggctgcagggccctgatgcagctgggcccgggtctcactcca

SEQ ID NO: 66521 - DNA, 201 bp, Homo sapiens
cctgcagctgccccctcctgtgtatgtcaagattcaagcgaagctagggggtgttacttacaaagccagtccagatcccagcgtgcctctggtaccggaggcacaggaaaagggccatcagccccagcagctctgagacctggtaggagaaaagtggagatctggggcttcgcacaaagcccctcatgttcctctgacacc

SEQ ID NO: 66522 - DNA, 201 bp, Homo sapiens
atgagattggttttgagccccgagctcctccataggctatctaaaattagaaccccgttgacaaggcaatctttgtcaggggcctacggcttgcaccaggraagcagggaaatgtcaacagtatattttctgtgtcaattttgagttttttaggaggcctgggcaaatggcaacttagagcaaatttgcgctatttccaaa

SEQ ID NO: 66523 - DNA, 201 bp, Homo sapiens
ccagaaacggccccagttcaggtgtcggggaaccccttgaggactggcttgtctctttgccttcattctctgttgtgcttatggtgtcaagaggaagaagrgagggagcagcctggctggggcctgcctggggccctgagaggtctctcgtccaagggtgcttccaatagccctgtggggccagatgttgtgggtctgccc

SEQ ID NO: 66524 - DNA, 201 bp, Homo sapiens
gtcagtgggttcaacggtttgcctgaaggtgaggacgcagactccagttactgggtgtggacgtgccatgcacccgaaccaagtgtgtgaggaaaatcacrcctcctgtgcaagaagccccccatgctgtctgtggcctccacgcagccgagtgctagcctgttgtgcaggtgtgcgggacacaccctcccaaagacacca

SEQ ID NO: 66525 - DNA, 201 bp, Homo sapiens
cctcccaaagacaccagctgtcctcggcggagcagggtgtgcctaggcccggctcagtgcctctgggagcctctgtgtccgcctcagcccacagacattaytgaccgtgttcccaccgttgcaagggccgtggagggacgagatgaagcttagcccagagcacccgataatcggcactgtcacttctgcagggcttgggcc

SEQ ID NO: 66526 - DNA, 201 bp, Homo sapiens
gggagctgcacattccaaaggcgtcctgcgtgcctgtgtaccgggctgtgatggccgcgggtgccaagcacggcctcatcaacgcagggtaccgcgccatygactccctgagcattgagaaaggtgagtgcagggtctggacagcatggggcgggggcgggcgcagtggggggcagtgacgctcgagacacctggaggccg

SEQ ID NO: 66527 - DNA, 201 bp, Homo sapiens
cacatcagctgcccctgctctacccactacccaccagcattctccccatccctgtgggccccatcctgacacctcccagcccccgtggcaggaccagggcrgcagatgtccccggtgctgagggcaggcttccatccccacacagccccagccaggagctcgtctctgccgacagccagtggcccagggccccactcctta

SEQ ID NO: 66528 - DNA, 201 bp, Homo sapiens
taggctggggtccctgcgtgtgggatgggggggaggggaaacacaggggaggtgggacatgagcgtcaactggcgtgcgcgatcgtggggacacaggaaayaggcggcggggaggtgctacacgcataaggaggcccagctgctgggaaacacgccgcgcaccggccgtggcagttatccatggtgtacctcccagcaccg

SEQ ID NO: 66529 - DNA, 201 bp, Homo sapiens
cctgtggacgagccgggagcccacatcagctgcccctgctctacccactacccaccagcattctccccatccctgtgggccccatcctgacacctcccagyccccgtggcaggaccagggcggcagatgtccccggtgctgagggcaggcttccatccccacacagccccagccaggagctcgtctctgccgacagccagt

SEQ ID NO: 66530 - DNA, 201 bp, Homo sapiens
ctgagctcgaacaaagctgtgggcagacgtttgggttacagatggctgtgaaaagtgggtttggccccctgagtctggggagggggctgcggctggagacmagggtgggggctgttggctttcacacgcttcaggctgaaggaacacctgcagcctccccttgctcacaggcgggcctggcttctggatgagacagctttg

SEQ ID NO: 66531 - DNA, 201 bp, Homo sapiens
tctagaaggtgcttagtaaatacttgataagccccacgtgaaaacagcgaagcaaataggcttcatcttttactccaggcttgactgatcggtggcgggcytccctggggcacttggctgaagagcatgaggctgtgtctgggtcaggaaagagaggtgatcgactggcattgtctgccacagcgcacatggaggcctggg

SEQ ID NO: 66532 - DNA, 201 bp, Homo sapiens
ggggagggaggccctggagcagcagcgggccgcaggcctccgccggcgcctggtgtgcttcaccatggaggagtgagtatcccgctgttccacgcccaccyggaagcaactgcctacagccagggcaggcaggcgcttcttggtcccccactcaaagcccctggtaccaacacttcccatgtgccagccgtgctcttccag

SEQ ID NO: 66533 - DNA, 201 bp, Homo sapiens
cagtaatgctcgcctttctccggagtcagggatgggtccataaccaacgtgaccagggaagccgaggttccgaggttaaacggcatccagacaggcagccsgggaaccagtcgatgcacccagagcggccggtgcacgtctcctgccccctccatcagggctgtccagagcatttgcaccatggaaatgggcaaatgctac

SEQ ID NO: 66534 - DNA, 201 bp, Homo sapiens
taccaggcccttaatacatacacacagaatgaatgaatgaatgaatgagtgaatgaatgaatgaatgagtgaatgaatgaatgagtgaatgaatgagtgartgaatgaatgagtgaatgaatgaatgagtgaatgaatgaatgagtgaatgaatgaatgaatgagtgaatgaatgaatgccatggggaagtggcaagagga

SEQ ID NO: 66535 - DNA, 201 bp, Homo sapiens
tgcataccaggcccttaatacatacacacagaatgaatgaatgaatgaatgagtgaatgaatgaatgaatgagtgaatgaatgaatgagtgaatgaatgartgaatgaatgaatgagtgaatgaatgaatgagtgaatgaatgaatgagtgaatgaatgaatgaatgagtgaatgaatgaatgccatggggaagtggcaag

SEQ ID NO: 66536 - DNA, 201 bp, Homo sapiens
tcaccaaggttgcccccgggcactgacagagcctgctgcataccaggcccttaatacatacacacagaatgaatgaatgaatgaatgagtgaatgaatgartgaatgagtgaatgaatgaatgagtgaatgaatgagtgaatgaatgaatgagtgaatgaatgaatgagtgaatgaatgaatgagtgaatgaatgaatgaa

SEQ ID NO: 66537 - DNA, 201 bp, Homo sapiens
tccccagctccctgttttgctgaggcctggagcccccatggcctcactgagccgagccctacgtgtggctgctgcccaccctcgccagagccctacccggkgcatggggccatgcaacctgtccagcgcagctggccccacagccgagaagagtgtgccatatcagcggaccctgaaggagggacagggcacctcggtggt

SEQ ID NO: 66538 - DNA, 201 bp, Homo sapiens
gcagcgcacctggaagcggacggctgaggacttgttgcagtgcatggagatgggcgcgaagctgtacagggccttcagtacgtcgcggttgaaggagttcsagggaacagaggtgaactgctgagacacggacgcctgagggcaggtgcagacatcctcgttgttgaacctggtggggacaaggaacagccaggctgggga

SEQ ID NO: 66539 - DNA, 201 bp, Homo sapiens
tgcctgggggcgacctgacctcctgctctccccactgagagtggctttgagcatgctgctggagcccggcgcacgtgatccctgggctactgggagagttkggattccaggaacccgagtcccacttgggttgcagggcagtctgagaagatcaggccctgatcagaggccctcccgtggtgcccacgggggtctgaagca

SEQ ID NO: 66540 - DNA, 201 bp, Homo sapiens
tggcagagacctatcctcaccaaggttgcccccgggcactgacagagcctgctgcataccaggcccttaatacatacacacagaatgaatgaatgaatgartgagtgaatgaatgaatgaatgagtgaatgaatgaatgagtgaatgaatgagtgaatgaatgaatgagtgaatgaatgaatgagtgaatgaatgaatgag

SEQ ID NO: 66541 - DNA, 201 bp, Homo sapiens
tacatgtagtaaagtcctttgaataaagtatgtattgtactataaaaaaaatgaacctggccgggcgcagtggctcaagtctgtaatcccagcactttggraggctgaggtgggcagatcacttgaggtcaggagttcgagaccagcctggccaacatgatgaaaccccatctctattaaaaatacaaaattagccgggca

SEQ ID NO: 66542 - DNA, 201 bp, Homo sapiens
cccaggaggcagaggttgcagtgagccaagatcatgccactgcactccagcctggaagacagagtgggactctttctcaaaacaaacaaacaaacaaacaacaacaacaacaacaaaacagaatttaaacatgagacacacagcaaaagagctgcaacatagagcaatttattgcaaaagaaaaagaacattttgaaagtt

SEQ ID NO: 66543 - DNA, 201 bp, Homo sapiens
gtcgccggtgcccttcctggggagggaggccctggagcagcagcgggccgcaggcctccgccggcgcctggtgtgcttcaccatggaggagtgagtatccygctgttccacgcccacccggaagcaactgcctacagccagggcaggcaggcgcttcttggtcccccactcaaagcccctggtaccaacacttcccatgtg

SEQ ID NO: 66544 - DNA, 201 bp, Homo sapiens
ggcagatcacttgaggtcaggagttcgagaccagcctggccaacatgatgaaaccccatctctattaaaaatacaaaattagccgggcatggtggtgggtkcctgtaatcccagctactccggaggctgaggcaggagaatcgtttgaacctgggaggcggaggttgtagtgagtctagattgtgccactgcaccaaaaaa

SEQ ID NO: 66545 - DNA, 201 bp, Homo sapiens
tgatcaaacacctcctaacaaaaaatagcccaggatatctgatgccttcgctggtgaattctgccaaacatttaagaaagaattaatgctgattcttctcmaactcttccaaaaaattcaagaggaaggaacacttccaaactcattttatgaggccagaattaccctgataccaaagccagacaaggacattacaagaaa

SEQ ID NO: 66546 - DNA, 201 bp, Homo sapiens
tgaccttggataaggatcctctcttggagcctcagtttcctcatttataaaatgtggacactcacctaccatgcagggctgtcatacaggccactgcacaragtgagtcttaatatgtggggattgtgatggcatggctcccacggtgggcagggcctcctgacacagccctggggccatggtcctgggggccacagccct

SEQ ID NO: 66547 - DNA, 201 bp, Homo sapiens
cacaaaacaagtcttaacacatttaagaagattgaaatcatatcaagtatcgtttccaaccacaatggtataaaactagaaatcaataacaggaggaaaartggaaattttacacatgtgtggaaattttttttttttttttttttattgatcattcttgggtgtttctcgcacagggggatttggcagggtcataggaca

SEQ ID NO: 66548 - DNA, 201 bp, Homo sapiens
tcagtttcctcatttataaaatgtggacactcacctaccatgcagggctgtcatacaggccactgcacagagtgagtcttaatatgtggggattgtgatgrcatggctcccacggtgggcagggcctcctgacacagccctggggccatggtcctgggggccacagccctggggcccagccaaaccggagtttatgggctc

SEQ ID NO: 66549 - DNA, 201 bp, Homo sapiens
gggaaacctgctcattgatgggaaaggctccgagatggggaaggcgtttctgcctcgtaggtatctgttagcaaggccagatgcccgctttgagttgtgcmtgcccgtggacatctgaaggccaccagctctccatgctgcctgcctgcggggggcagctcagagctctcagccctgcaggtgcacacatggctcagaagc

SEQ ID NO: 66550 - DNA, 201 bp, Homo sapiens
agaattgcttgaacccaggaagcggaggttgtggtgagccgagattatgccattgcactccagcctgggcaacaagagggaaactctgtctcaaaaacaamaaaaaaaagaaagtgcctacatcgtcaccggcagagcgctataccacagtgtgcagtgagacagccttgggccatgtgaaaagttgggggtatgaatggg

SEQ ID NO: 66551 - DNA, 201 bp, Homo sapiens
tgcagcaaaagtgccaggcgtcaccagctgtgccaggctggaggtgacaccctcctcctgcctaagagcacctgcacctggggctgactggctcccgagcrcttgctggggagcccgagccagggtgtgggatggggagcatgcagaggccaagctgtctagaaggctgttccagccgcccctgccccgagggattcgagc

SEQ ID NO: 66552 - DNA, 201 bp, Homo sapiens
ctggaaggcagtctctaatccaccccaatcctcccagaaagcaaacctgtaagtgtcttgggctcagggaccatggcttgtagccctttccaagcttctaraaggtgcttagtaaatacttgataagccccacgtgaaaacagcgaagcaaataggcttcatcttttactccaggcttgactgatcggtggcgggcttccc

SEQ ID NO: 66553 - DNA, 201 bp, Homo sapiens
cacagcgcacatggaggcctgggaccaaggccattcttcaggatggtgcctctcggctctcaggtcggaacaggagctggaaagctcttcttaccttgctsgacctccctgttcttcaggtggcaaagcctcctgagagtcggcagcccgggaacacagaggagccgaagcagggagcgggcggggcctcagattggtgcc

SEQ ID NO: 66554 - DNA, 201 bp, Homo sapiens
tcgacctccctgttcttcaggtggcaaagcctcctgagagtcggcagcccgggaacacagaggagccgaagcagggagcgggcggggcctcagattggtgycctcctcacccacacagaagtgccagctcctgcctcagtttccccttgagcccctcgctcaccaggcccaggcaggagggacgtgctgctgggtaagagt

SEQ ID NO: 66555 - DNA, 201 bp, Homo sapiens
ctgcttctggggacatggaggatatcaaaggggtgatctgtctctggaaaatgatggtggcagcttcggggagaggatgggaaaggagaggaggagaggcrgggaggggtgggggggagatgagtctccagcctgaaggtcgccgaggtgagcacttgacgtagcagggctgtgtcctggtgatatcctgtcagcctggga

SEQ ID NO: 66556 - DNA, 201 bp, Homo sapiens
gaaggtcgccgaggtgagcacttgacgtagcagggctgtgtcctggtgatatcctgtcagcctgggattctgccgagacctctggctggagtgcccagacyctgccatggggtccgctttccctggcaccccacgctgagtcctaggccagttgctcccctctcaggctgcaagggaccgagctgttgctgtccgtccaag

SEQ ID NO: 66557 - DNA, 201 bp, Homo sapiens
tgagcacttgacgtagcagggctgtgtcctggtgatatcctgtcagcctgggattctgccgagacctctggctggagtgcccagactctgccatggggtcygctttccctggcaccccacgctgagtcctaggccagttgctcccctctcaggctgcaagggaccgagctgttgctgtccgtccaagcatatgcactgtgg

SEQ ID NO: 66558 - DNA, 201 bp, Homo sapiens
gcacacagtaggtgctccaaaaatgggggcctttgctatgtcactctctgagctgcccaagggcgggacctccctcacattcatcttggtccagttatttyctgctcaacaacctctccaggccccccaggtcctgcagagaaagaccttgcagagaaagacacccatggttgaatatcagggtatcccctgatattcgtc

SEQ ID NO: 66559 - DNA, 201 bp, Homo sapiens
ggtgatatcctgtcagcctgggattctgccgagacctctggctggagtgcccagactctgccatggggtccgctttccctggcaccccacgctgagtcctrggccagttgctcccctctcaggctgcaagggaccgagctgttgctgtccgtccaagcatatgcactgtggtgctcaggggcacacggtagacgcgtgctt

SEQ ID NO: 66560 - DNA, 201 bp, Homo sapiens
gggtcttcggggctgggggctggcaggggctcctgggcctctgcggttctgccaaaagcagggagtagtgaggtgagccctgcggtctggaggctggtggyggagatgaggctgagagcgtgagtgaggggtcctatggggtgcgcagagctcgcccaccccttccctcctgccgttggcgacgtggaggctgagggagcc

SEQ ID NO: 66561 - DNA, 201 bp, Homo sapiens
gtgcccagactctgccatggggtccgctttccctggcaccccacgctgagtcctaggccagttgctcccctctcaggctgcaagggaccgagctgttgctktccgtccaagcatatgcactgtggtgctcaggggcacacggtagacgcgtgcttgctgaggaagggatagaatcggagagggtcgagtgctttaacacta

SEQ ID NO: 66562 - DNA, 201 bp, Homo sapiens
ccatcaatggaaacagaaactacatggcttcacgagattgccacggctgtgcatagcctcagtgtggggcaagtggcaactctcagcaaccacggggttaygcttatctgggtgtaggaggtgcgggtactgctggagcggggtaggggggacacggctgctgtctctgcaagaggaagaggataaccagcctgagagcaa

SEQ ID NO: 66563 - DNA, 201 bp, Homo sapiens
ctgtggcaggttccagagctggctaggattcccaatcactgccgctcttgggccccaggtgaggtacttatctgggagtctcagtttccctgcccgagatyggcaggctacaagtgccccccaggtgtttgggcaggaccctgggacccttctctgggctggcaattgggtgtgatcgcgggaagaggcttcttgggcctg

SEQ ID NO: 66564 - DNA, 201 bp, Homo sapiens
gcaatcccaaatctgatttctgcctcgatggagtttcctattctggacgtttagtataaatggaatcacatgatgtctggcttctttttacggttttgtcygtgtagtacatgtatcagtatttcattcttttttgcagctgaataatactccattgtatggatacaatgcactttatccgttcacccactggtggacatt

SEQ ID NO: 66565 - DNA, 201 bp, Homo sapiens
ggattcccaatcactgccgctcttgggccccaggtgaggtacttatctgggagtctcagtttccctgcccgagatcggcaggctacaagtgccccccaggygtttgggcaggaccctgggacccttctctgggctggcaattgggtgtgatcgcgggaagaggcttcttgggcctgctccgtgtctactgtcacctaggct

SEQ ID NO: 66566 - DNA, 201 bp, Homo sapiens
tttttgtgtttcttggagttattaacagtttttgtcccagctgctcagtttcttttgtaactgttatgtgtgtgtgtgtaacattatcttcgtgccccaaracccatacccgttatcaatcactccccatttcccaccctgtccccagacttaggcaatcccaaatctgatttctgcctcgatggagtttcctattctgga

SEQ ID NO: 66567 - DNA, 201 bp, Homo sapiens
ggagacccttgggccaccctctctgtccccacctcccaggccctgaaatcctgctctaagtccaggtgcctctcttccaggggacggttactacctggccrtgggcggggccgtggcccagcacaactggtcccacatcaccaccgtgctgcaggaccagaagtcccagtgccagctcatcgacagctccgaggacctggg

SEQ ID NO: 66568 - DNA, 201 bp, Homo sapiens
gtgtccaactttttgtgtttcttggagttattaacagtttttgtcccagctgctcagtttcttttgtaactgttatgtgtgtgtgtgtaacattatcttcrtgccccaagacccatacccgttatcaatcactccccatttcccaccctgtccccagacttaggcaatcccaaatctgatttctgcctcgatggagtttcc

SEQ ID NO: 66569 - DNA, 201 bp, Homo sapiens
atagcaaaagccaccagtgtgaggtcactgactgtggagttgggaagaggtttatccctgggctcctgagagctgatgcgagccggctcccacaagccacygctccaactcttgctcttgccttctcactggccccctagctgggctgtcatagcctcttccctgacgtttcgccagccacacccctggcctgccacctct

SEQ ID NO: 66570 - DNA, 201 bp, Homo sapiens
agaggaggaagcagggtggggagaagttattgtccgctcagcagccagcagaccagctgtccttgctccccaaatatcttgcctcgaggccagcaagattycccgtgggtcagtgctctcccggcgtgtctcccagagctccgctcggccagacacggtgttcccagggcccctgccgaggacgggccccgccgcgaagca

SEQ ID NO: 66571 - DNA, 201 bp, Homo sapiens
tcttccctgacgtttcgccagccacacccctggcctgccacctctcacattcagctgctggagggcatcctttgttggggagagtgcagatttaagcttcmttcagtagtgggttggtgtctcggcgccccctccactcacctgctctgtgatcttggccacagaactgttggtgccacttgaacttgatctataagagaa

SEQ ID NO: 66572 - DNA, 201 bp, Homo sapiens
tggccacggccagctccccctgtagggggcctcacaggcaggtgggagatgggagttgagtcagccacagacactggggggtttgggaccaaagcatccaygttacccaaggctcggtggagctcaggccagaagcctggcttcccatcctgcccggtccttctgcgggtcgcctctctgggcctcagtgtccccacctgt

SEQ ID NO: 66573 - DNA, 201 bp, Homo sapiens
ctctctgctggctggctggctgtctaggcctatgtgtcaccacctggcacttgctctcattgtcttgtgcgagtgcttttgccagcagtttggagtgcagrcccatcacccctcactggggccccccatgaggcctgcctgactgcatgccccacccgggcccatggcagcgcacctggaagcggacggctgaggacttgt

SEQ ID NO: 66574 - DNA, 201 bp, Homo sapiens
gaaatagcatggggcccgccgggttcgtgctggacaccaccgggggctgccgtggccacacactgtgtccccagcctcgaaggaacaaacccaaaactatygcagccacatcatctccggtcccaggcgctggattgggcagccgctccccagacacagctgggattttcccccagagactctgtacctcttgggtccctg

SEQ ID NO: 66575 - DNA, 201 bp, Homo sapiens
gcctcatcaacgcagggtaccgcgccattgactccctgagcattgagaaaggtgagtgcagggtctggacagcatggggcgggggcgggcgcagtgggggscagtgacgctcgagacacctggaggccgagaagctgtttaccttccctgtgttgtcacccggcttccttctttccacaccatgatttcctcccctacacc

SEQ ID NO: 66576 - DNA, 201 bp, Homo sapiens
agacgggtggggatacagccactggccacggccagctccccctgtagggggcctcacaggcaggtgggagatgggagttgagtcagccacagacactgggkggtttgggaccaaagcatccatgttacccaaggctcggtggagctcaggccagaagcctggcttcccatcctgcccggtccttctgcgggtcgcctctct

SEQ ID NO: 66577 - DNA, 201 bp, Homo sapiens
ggataaattagatgccttcgaataccagtgggtctcagataaggaggaaaaaaccagctcgcagcttcagactggttcgtttcttaccttcccctcccctrgtgctttatttttaggcaggttagtgcgccctgctcacaccacctgcatttggcattcggtacagtgtggaggtgtcaccagagagggtgcctgccctcc

SEQ ID NO: 66578 - DNA, 201 bp, Homo sapiens
gcaagttactctactcttctgtacagcactgaggccaccatagccagctcctctctcgggccgtggctaccaaagcagcagctgaggcccctctggcctcygaagagttggaaacctggagaggcctggggatgtggattgtggattgtggacctggtccagatgctctgttcctcctggcctgtgggcttcaagggcatt

SEQ ID NO: 66579 - DNA, 201 bp, Homo sapiens
ttgagaagcaggtccttctcctaacccccatggctcagaggatactctgcaaggcgtggccctgggggacccagggagggacagatacggttcctgggcaytgtgaaggcacaggcccctgagagggcatttgttttctcagccgggagacccttgggccaccctctctgtccccacctcccaggccctgaaatcctgctc

SEQ ID NO: 66580 - DNA, 201 bp, Homo sapiens
ccattcacctagtcaggaacctgggagtcatccaggcctctccccgcctctgtccccacccaatttaatcattcaccctagtgtagcaaccagagcccctkgctgcaggctctgatattttttagctatctcttcccctcaaggctacaccaaatgccaagttttcaaccccatcagacgtccaccccacactattctcag

SEQ ID NO: 66581 - DNA, 201 bp, Homo sapiens
atagcgagatcctatctctaaaaaaacaacaaaaaaatttttcaattagctcagcacggtggtgcacacctgtagtcgcagctacttgggagcccaaggcyggaggatcgcttgagcccaggaggtcaaggctgcagcgagctgtgattgtgccactgcaagccgccctgggagacagggtgaccttgtctcaagccaaaa

SEQ ID NO: 66582 - DNA, 201 bp, Homo sapiens
aagtctgtcaccgctctggttccctttcctgcaaaatgggtcataaccatccctactgcctcaggctgtgctgcaggaaggacagagtgatgcagctgggmgtggtgcccggcatacagcaggtgctcatgaggtggtagctgtgtgatgacaaggacaaggacagagggttgtgaagtcgtcaccagctggcgcttcgga

SEQ ID NO: 66583 - DNA, 201 bp, Homo sapiens
cgagtacaccttcgccttcccgccccaccacgacacggtgcgtagctggggtccaccgtgggggtccgtccttctgcctgtccctcagataagccattgcrccggccctcggctggccctgcaggggctcccctcccccaggagtctcttcgggctctgcattcacgcttttttcggctgactccattttgaggaggaatc

SEQ ID NO: 66584 - DNA, 201 bp, Homo sapiens
agggctcaggtctcacgtgtggttcatctttcttcttgggtggctggagggctgtgtggccccaaggacctcccttttctgaggatctgtcccaggcctgkgtcctagagagctctgcccacagcttcctttgtggctagggctcatctcttccctctctgagctatcattaaagcaggtggctcgggcgctgttaggggg

SEQ ID NO: 66585 - DNA, 201 bp, Homo sapiens
gtgggtacaaccaatgtgagagacaccctggcaggagactgtgggatcttggacaacgagtacctgcccaagacctagggagtcagggagggcttcctggrggaggtgacagctgagccaagagctgaaggatgacaaagggttaagtggtgacaggggaaggggtgagaatgcgaaggggcacaagagggctaggcctgg

SEQ ID NO: 66586 - DNA, 201 bp, Homo sapiens
ggagagagaacctggctgcgctccctgtcccgaggagagagaacccagcacccctccctgtcccctgtgtgcttcccccgcccctgtggagagagaacctkgcccctcggggagggcactgggcattgatgtgagcgcagcctccacaactcacctcccaagctcatcacctgcgggctccatccctgcgctgccagaggt

SEQ ID NO: 66587 - DNA, 201 bp, Homo sapiens
ttgggggtgggtacaaccaatgtgagagacaccctggcaggagactgtgggatcttggacaacgagtacctgcccaagacctagggagtcagggagggctycctgggggaggtgacagctgagccaagagctgaaggatgacaaagggttaagtggtgacaggggaaggggtgagaatgcgaaggggcacaagagggctag

SEQ ID NO: 66588 - DNA, 201 bp, Homo sapiens
catcccttttactcactcgaagcccgagccctgctgtccaggccaggtgctgggctggctctggggaccagcgtagtcctagtaggccagccctatctgcstggagccacggttgggtgtgcatcatgcagccccccattctcctccaggccgctgtggacgcgtccccaccctgcggtttctggggccccagctttctct

SEQ ID NO: 66589 - DNA, 201 bp, Homo sapiens
ttactctgggtgaccttggcacctaactttaggtctctgagcctcagtttcctcctccatcaatggaaacagaaactacatggcttcacgagattgccacrgctgtgcatagcctcagtgtggggcaagtggcaactctcagcaaccacggggttacgcttatctgggtgtaggaggtgcgggtactgctggagcggggta

SEQ ID NO: 66590 - DNA, 201 bp, Homo sapiens
ggtgggggtggggttgtcgctgtggcaggttccagagctggctaggattcccaatcactgccgctcttgggccccaggtgaggtacttatctgggagtctyagtttccctgcccgagatcggcaggctacaagtgccccccaggtgtttgggcaggaccctgggacccttctctgggctggcaattgggtgtgatcgcggg

SEQ ID NO: 66591 - DNA, 201 bp, Homo sapiens
cacccacaccctctcagccatgcaggggaccctgggggaagaaggctggattggaccgtggtctcaggcaggggcgtggtctggccccttcatcctgggcrtgcagggctgttccatggggatcgtcgcagagtagagtgcacagtgccggtgtgagcccacagggacagcatggaggagggggaggagtaggtcccccct

SEQ ID NO: 66592 - DNA, 201 bp, Homo sapiens
ttccttcccttggtgctgaggatgtttgacttagcagttaatctggctcccaaatgcttctgggaaggatcttcctggatctccaggctgcggcaccttaygcgactaactctgcataggccctggcctcctgaccacagcccagtgggcccaggataaattagatgccttcgaataccagtgggtctcagataaggagga

SEQ ID NO: 66593 - DNA, 201 bp, Homo sapiens
ccatgtagctgggattaaatgtgcccgtcaccacacccggctgatttttttttgtattttagtagagacggagtttcaccatgttgccaaggctggtctcraactcctgagctcaggcaatccacccatctcggacttccaaagtgctaggattacaggcgtgagccaccatgcttagctgattatgtaaacattgttaat

SEQ ID NO: 66594 - DNA, 201 bp, Homo sapiens
cgcctctccccacagtctcctgctcattggtgtaaaatcactggtgttgtaaaaagcacatcacggctgcataaaatactgctcattgctcggtttccaaycatcactgcgcgtgggtttcagcacaggggctgagtgcagacctcgcttctagcagtttccaaccatcactgcgcatgggtttcagcacaggggctgagt

SEQ ID NO: 66595 - DNA, 201 bp, Homo sapiens
ttctctgggctggcaattgggtgtgatcgcgggaagaggcttcttgggcctgctccgtgtctactgtcacctaggctgtaaagatgacagagggccggagyggctctccaggctggggcctggcatttcacagcgctagcgccgtgacttatggaccacaagaagctgtgatttatacaacgtgaggcagagctcctgggc

SEQ ID NO: 66596 - DNA, 201 bp, Homo sapiens
ccaggctggggcctggcatttcacagcgctagcgccgtgacttatggaccacaagaagctgtgatttatacaacgtgaggcagagctcctgggctcgtgasttcccttctgtgatgaagtgaagtgccttgcagaagcagcagccgcttagctgatgcgaggggactccgaggcccatccatctccctctctccccatgag

SEQ ID NO: 66597 - DNA, 201 bp, Homo sapiens
ttccacaccccggcccagcatggtgcctgtcccagaagccaggccacacccagtgaggcggaacagggctggcggagggctggaccctggaccactgtgcrggctgtccctgcactgagtcagccgggtttaaatggacgaggtcgtggtccactcggtccagggtaggtcaacagggcacccacaccctctcagccatgc

SEQ ID NO: 66598 - DNA, 201 bp, Homo sapiens
gtctgtaatcccagcactttgggaggctgaggtgggcagatcacttgaggtcaggagttcgagaccagcctggccaacatgatgaaaccccatctctattraaaatacaaaattagccgggcatggtggtgggtgcctgtaatcccagctactccggaggctgaggcaggagaatcgtttgaacctgggaggcggaggttg

SEQ ID NO: 66599 - DNA, 201 bp, Homo sapiens
tgttgttaaaggcagaaaggcagagagagtttgctctttttttttttttttttttgagacggagtctcactctattgcccaggctggagtgcagtggcgcratctcggctcactgcaacctccgcctcccaggttcaagtgattctcctgcctcagcctcccaagtagctgggattacaggcgtgcaccaccacacccagc

SEQ ID NO: 66600 - DNA, 201 bp, Homo sapiens
atctggccaggtcacatgttgttaaaggcagaaaggcagagagagtttgctctttttttttttttttttttgagacggagtctcactctattgcccaggcyggagtgcagtggcgcgatctcggctcactgcaacctccgcctcccaggttcaagtgattctcctgcctcagcctcccaagtagctgggattacaggcgtg

SEQ ID NO: 66601 - DNA, 201 bp, Homo sapiens
tgtgttatgcatccgaagttccttcctttttaaggctgaataacattccttcatgtggatagaacactttttgtctgttcatcatctgtttttggtgtgtktttttttttttaatttcagacagggtcttagtctgtcacccaggctggagtgcagcggtgcgatctcagctcactgcctcaacctcctggtctcaagtga

SEQ ID NO: 66602 - DNA, 201 bp, Homo sapiens
gggctgagtgcagacctcgcttctagcagtttccaaccatcactgcgcatgggtttcagcacaggggctgagtgcagacctcgcttctagcagtttccaaycatcactgcgcgtgggtttcagcacaggggctgagtgcagacctcacttctaccaagcccactttgggcacgacccttgccccctcagaacaaggatgct

SEQ ID NO: 66603 - DNA, 201 bp, Homo sapiens
acgacggtaccatggaccccgctggcacctgtaccaccctcgccagggcagcttctgcccgaggagcacaggtactgatggccgcctggctctgggtcccytgttcccagcccactcctcctgccttagaaccctgagagcagaagggaagagaacaagagccattctctgactgctgtgtgactttgggccagtgaggac

SEQ ID NO: 66604 - DNA, 201 bp, Homo sapiens
gctggagtgcaatggcgcgatctcagctcactgcaacctccgcctcctgggtccaagtgattctcatgcctcagcctcctgagtagctgggattacaggckcacaccaccatgcccaactattttttctatttttagtagagacggggtttcgccatattggccaggctggtctgaaactcctgacctcaggtgatcctcc

SEQ ID NO: 66605 - DNA, 201 bp, Homo sapiens
gtcacacagctggcgagggtcggattggcacaggcggcctggccccggagcctgcctcagtgccctgctccttaactcttatgctgaagcggattcaaggracaggctccgggggcgtggggaccggctaaggcttctgggagaaagtgaggctggggtttgcggtggatgcccagttggggaggggagtggcccaggggt

SEQ ID NO: 66606 - DNA, 201 bp, Homo sapiens
ttatatattgaccttgtatcctgcaacctcgttgaactattttattagttctaacagttttttttcttttttttcttttttttttttagtggattccttargatttcctatatacaagatactgttttggcaaatagggatgtttttatttcttcttttctgatctggatgccttttatttttcttttcctgcctaattgc

SEQ ID NO: 66607 - DNA, 201 bp, Homo sapiens
ccccttcacgagcccctccctgacgcccccacctgagggtgcagagggctgcagtgctgatgggcagtctgctcgggggggcggtcgccccagggaacctyctggagttggggatgcccctgcctcctgcccaggtgactaagcagctctgagagtgtggctaggggctggagggggtgggtttaggcagcatcctcatgc

SEQ ID NO: 66608 - DNA, 201 bp, Homo sapiens
agttctcattctcctaactaaccagggggcatatattaagcacctatggtgtgcatgtcccaggacagccaaccttctgccttcaccatttcagccatggrtgtcctggcaaactggatctcctgacctgcagtgttggccagttcctgtggtgtgaacactcccaccctggccaatagcaaaagccaccagtgtgaggtc

SEQ ID NO: 66609 - DNA, 201 bp, Homo sapiens
tttctccatgttggtcaggctggtctcgaactcctgaccccaggtgatccacccgcctcagcctcccaaagtgctgggattacaggcatgagccaccgcasccgactgtctttttattattgagttgcaaatttttttatagtttagttacaagtctcttatcagatctgtaatgtgcacacactctccccatcctgtggt

SEQ ID NO: 66610 - DNA, 201 bp, Homo sapiens
gagtgggagagaagcacaatgctttctaggctggggtccctgcgtgtgggatgggggggaggggaaacacaggggaggtgggacatgagcgtcaactggcrtgcgcgatcgtggggacacaggaaataggcggcggggaggtgctacacgcataaggaggcccagctgctgggaaacacgccgcgcaccggccgtggcagt

SEQ ID NO: 66611 - DNA, 201 bp, Homo sapiens
ctgggattacaggcatgcaccaccacgcccagctaattttgtatttttagtagagatggggtttctccatgttggtcaggctggtctcgaactcctgaccycaggtgatccacccgcctcagcctcccaaagtgctgggattacaggcatgagccaccgcacccgactgtctttttattattgagttgcaaatttttttat

SEQ ID NO: 66612 - DNA, 201 bp, Homo sapiens
cacctctctgctttggaagtggccccgggaggaacttcccttgaacaccgtcctcccagtagatgctgactgttggtctgagagagggtagagctgggccyaccaggtcggaggtatgtgcggttcatggtcccgggtcactctgtggtgtgttcttctctgtccttccgtatttctgcgcccctcgcttgcccagtgcta

SEQ ID NO: 66613 - DNA, 201 bp, Homo sapiens
atgccccctcccctggcttcccattcacctagtcaggaacctgggagtcatccaggcctctccccgcctctgtccccacccaatttaatcattcaccctartgtagcaaccagagcccctggctgcaggctctgatattttttagctatctcttcccctcaaggctacaccaaatgccaagttttcaaccccatcagacgt

SEQ ID NO: 66614 - DNA, 201 bp, Homo sapiens
gacagagcctgctgcataccaggcccttaatacatacacacagaatgaatgaatgaatgaatgagtgaatgaatgaatgaatgagtgaatgaatgaatgartgaatgaatgagtgaatgaatgaatgagtgaatgaatgaatgagtgaatgaatgaatgagtgaatgaatgaatgaatgagtgaatgaatgaatgccatgg

SEQ ID NO: 66615 - DNA, 201 bp, Homo sapiens
catacagtgaagaatagaagattctcaaaacctcacccaggcatttgtaaacctggggaaggaaatagggagtgatgttgtttatgtgtgtgtgtgtgtgygcgtgcgtgtgtgtgtgtgtgctttgaaaacagctttattgagatctaattcgcatactatatgatttattcatttaaaaggtacaactcagtgtttttt

SEQ ID NO: 66616 - DNA, 201 bp, Homo sapiens
agcgttttgctgaagtggctgaacacaagtgcatctgttactgtctccagaaaccatcaaagagctgaacttgtccctgagaggcagctcagagggcaggmaggggagacccacccaggccagctgaggcagcttcaggacgctcagggggaagcacttggtaccacgcctggcacagggaggaggctcaggagcaagctt

SEQ ID NO: 66617 - DNA, 201 bp, Homo sapiens
cactgacagagcctgctgcataccaggcccttaatacatacacacagaatgaatgaatgaatgaatgagtgaatgaatgaatgaatgagtgaatgaatgartgagtgaatgaatgagtgaatgaatgaatgagtgaatgaatgaatgagtgaatgaatgaatgagtgaatgaatgaatgaatgagtgaatgaatgaatgcc

SEQ ID NO: 66618 - DNA, 201 bp, Homo sapiens
ccgtgacttatggaccacaagaagctgtgatttatacaacgtgaggcagagctcctgggctcgtgagttcccttctgtgatgaagtgaagtgccttgcagmagcagcagccgcttagctgatgcgaggggactccgaggcccatccatctccctctctccccatgaggctgggcagcgttttgctgaagtggctgaacaca

SEQ ID NO: 66619 - DNA, 201 bp, Homo sapiens
tcctctgtcctcagtcccctccccatcctccctgcccggcctcacggggcagcccactttcctcaggtctcactttggatctctgccagccacgccacccmctcttctctacctccccttgtggccccgacccccacttctacccagagcttggcgctccctgtcttttctgtgggctggcagagacctatcctcaccaag

SEQ ID NO: 66620 - DNA, 201 bp, Homo sapiens
tattggtcctctgtcctcagtcccctccccatcctccctgcccggcctcacggggcagcccactttcctcaggtctcactttggatctctgccagccacgycacccactcttctctacctccccttgtggccccgacccccacttctacccagagcttggcgctccctgtcttttctgtgggctggcagagacctatcctc

SEQ ID NO: 66621 - DNA, 201 bp, Homo sapiens
cggggcatggggaaccaagtccccacccagttctggatgatgccaaggcctctctctctgccttccagaacatgcccaatgtccgtgatcatgatgcctcygtctacctccgcctccaaggggatgccttgtctgtgggtggctatgaggccaaccccatcttttgggaggaggtaagatgccagggccctgggataatgg

SEQ ID NO: 66622 - DNA, 201 bp, Homo sapiens
caaggatgaaggctcagagcgggctttgggcggttccccagcgtgttgggcacccagcttgggcgtcaggcagctcccctgggtgttgggcacccagcttrggcattgggaagctcccccttcacgagcccctccctgacgcccccacctgagggtgcagagggctgcagtgctgatgggcagtctgctcgggggggcggt

SEQ ID NO: 66623 - DNA, 201 bp, Homo sapiens
ccaggctgggttggaattgagggccttggtttctctgagagctgtgaagaatggagccagggagcaggtgctgtggcctctggaagaagcccagaccctgwccagagcaaggatgaaggctcagagcgggctttgggcggttccccagcgtgttgggcacccagcttgggcgtcaggcagctcccctgggtgttgggcacc

SEQ ID NO: 66624 - DNA, 201 bp, Homo sapiens
cgaatgtcgtgactgttcccctgttcctttgaacgttccccgagaaccacttggaacgccctcagctgcgtctccagtgccctgctcatgtgtttcacacmgggtccacctctctgctttggaagtggccccgggaggaacttcccttgaacaccgtcctcccagtagatgctgactgttggtctgagagagggtagagct

SEQ ID NO: 66625 - DNA, 201 bp, Homo sapiens
gtcactctgtggtgtgttcttctctgtccttccgtatttctgcgcccctcgcttgcccagtgctaccctaggtctcaggcggagtgggagagaagcacaaygctttctaggctggggtccctgcgtgtgggatgggggggaggggaaacacaggggaggtgggacatgagcgtcaactggcgtgcgcgatcgtggggacac

SEQ ID NO: 66626 - DNA, 201 bp, Homo sapiens
ggcggccgggcagaggcgcccctcacctcccggacggggcggctggccgggcggggggctgaccccccacctccctcccggacggggcggctggccgggcrgggggctgaaccccccacctccctcccggaaggggcggctgccgggcggagacgctcctcacttcccagacggggtggctgccgggtggagggtctcctc

SEQ ID NO: 66627 - DNA, 201 bp, Homo sapiens
tgcaccatggaaatgggcaaatgctacagtcacacccacctcaccccagagctggttgttaaacattttctagcacccaagtggggtaacggaggtttctkcctaagatagggaaacctgctcattgatgggaaaggctccgagatggggaaggcgtttctgcctcgtaggtatctgttagcaaggccagatgcccgcttt

SEQ ID NO: 66628 - DNA, 201 bp, Homo sapiens
ccagatgcccgctttgagttgtgcctgcccgtggacatctgaaggccaccagctctccatgctgcctgcctgcggggggcagctcagagctctcagccctrcaggtgcacacatggctcagaagcaccactcctaaagctcctgtcgcagaaaaagcttggtttgttttttatttttttcatccagtcctgagctgctagg

SEQ ID NO: 66629 - DNA, 201 bp, Homo sapiens
caggaagtggtggcctgggcctggacctcagccatcttacatggccacatctaagccatgaccttgtcccccaggtccgagccatgcggctgtcctttgtsggggagctgggctgggagctgcacattccaaaggcgtcctgcgtgcctgtgtaccgggctgtgatggccgcgggtgccaagcacggcctcatcaacgcag

SEQ ID NO: 66630 - DNA, 201 bp, Homo sapiens
aacgttccccgagaaccacttggaacgccctcagctgcgtctccagtgccctgctcatgtgtttcacaccgggtccacctctctgctttggaagtggcccygggaggaacttcccttgaacaccgtcctcccagtagatgctgactgttggtctgagagagggtagagctgggcccaccaggtcggaggtatgtgcggttc

SEQ ID NO: 66631 - DNA, 201 bp, Homo sapiens
ctctcaaggctggcgggacggcccccgcccagccccagcctctcgctgtctgtgatctgggggtgagtgtccctgagaccggagcccctcctttccagctrttggtcctctgtcctcagtcccctccccatcctccctgcccggcctcacggggcagcccactttcctcaggtctcactttggatctctgccagccacgcc

SEQ ID NO: 66632 - DNA, 201 bp, Homo sapiens
tggattgcagtcaccacggttgctgcgtccccaggacatggtgactcctttgactgcctgtcctgcctcgcctgcacccaaggagacatccgtcttcatcrgcgccttctctcctgagaaggagggctccctcttgcattctcattgttattggatttttctggctgggcagatctgggagggtttcctgaaggaggaggg

SEQ ID NO: 66633 - DNA, 201 bp, Homo sapiens
aggtgctcgggaggaggctccctcgagagtggaagggtcgtctccggagcctgcagaggaagcgtggctcgcccacatggtgattttggattttgagcctscagaaccgagagagagtttactgttattgttttaagccaccagttgtggtcgtttgttatgacaggtaggaaactaacccagtcctggagaagacctgag

SEQ ID NO: 66634 - DNA, 201 bp, Homo sapiens
cttaaaatctccaccgaggggtgtgtttttttactattagaatgagcaaagggtcagtttgaggacaggtaaaatcaatgtgcacatgccctctccagggraaaggccctactgcagacagctttgcttgaacgagctcagttaacacgagctcagttacagtgcaaacgtggaggctgattgtgtggattgcagtcacca

SEQ ID NO: 66635 - DNA, 201 bp, Homo sapiens
acaagccaaggggtgccgggaggtgctcgggaggtgctcgggaggaggctccctcgagagtggaagggtcgtctccggagcctgcagaggaagcgtggctygcccacatggtgattttggattttgagcctccagaaccgagagagagtttactgttattgttttaagccaccagttgtggtcgtttgttatgacaggtag

SEQ ID NO: 66636 - DNA, 201 bp, Homo sapiens
ctggcctagaagccccaactaagctggcctagaagccgcagtggtgggcggtacgctccgcccagatcctgggcggagacatggggctggcagcgagggtsgggggcgggggaggcctggagttccggccaggccactgcttgggaagcaagaaggtgaaggcacctctgctgggccaagcactcttagggccgaggggca

SEQ ID NO: 66637 - DNA, 201 bp, Homo sapiens
aaaatagaaccaagctgttgttattttgtgattttttttttttaccaagcagtagactgcaaacatctttctgttaatcaaatatcttgcttttttttaawaaaaaaaaagtcagctactttttcacgttatgaaaagagggttccccccacaagtcaagtgaaagaacttgcccaactttcaagttctccaagtcaaggc

SEQ ID NO: 66638 - DNA, 201 bp, Homo sapiens
ccctgagttgagtgtggggcagcccaggagctaccggtgaccccagagcaccagcattccttcatgagggcattcattctacattaagtggcacttcgtckgtggtggaggcaggcacgctcagggccagcgccctccttctggcaggggagacccaatgcaagtcactgatcacagcccgtgggtgggtgctctgacacg

SEQ ID NO: 66639 - DNA, 201 bp, Homo sapiens
ccggagtggctctccaggctggggcctggcatttcacagcgctagcgccgtgacttatggaccacaagaagctgtgatttatacaacgtgaggcagagctsctgggctcgtgagttcccttctgtgatgaagtgaagtgccttgcagaagcagcagccgcttagctgatgcgaggggactccgaggcccatccatctccct

SEQ ID NO: 66640 - DNA, 201 bp, Homo sapiens
cctactggcctggggagcccggaaggctctgccccagggggcgggtgtggggctgaggctgctggcctggggagcccggaaggctctgccccagggggcgkgtgtggggctgaggctgctggcctgggccctggcaaaggtgcactctctgggaagcaggaggggctgcagctgaccttggcaccccagtgtttataacca

SEQ ID NO: 66641 - DNA, 201 bp, Homo sapiens
tgagagcaagagtgtgagtggggggtgaggtgggggtggggttgtcgctgtggcaggttccagagctggctaggattcccaatcactgccgctcttgggcmccaggtgaggtacttatctgggagtctcagtttccctgcccgagatcggcaggctacaagtgccccccaggtgtttgggcaggaccctgggacccttctc

SEQ ID NO: 66642 - DNA, 201 bp, Homo sapiens
aagaggctggagcaaaaaggtgggctcagctcccagatgccccacgtgggtcatccacagcgcagctcagccccaccccaccctactggcctggggagccyggaaggctctgccccagggggcgggtgtggggctgaggctgctggcctggggagcccggaaggctctgccccagggggcgtgtgtggggctgaggctgct

SEQ ID NO: 66643 - DNA, 201 bp, Homo sapiens
atgcgttttcctctccccctcctccctctgtgccgagattttgccagcagccaggcctgagcggaagtggtgctgctggggatggggtgaggtgggggcgraggcaacgggctggggcccggtggggctgcaccgctctgagcctccgcctcccgctctccggagctgcgccgaggctggcatgagacgtggtgggggaag

SEQ ID NO: 66644 - DNA, 201 bp, Homo sapiens
tgaggaggaatcatgcgttttcctctccccctcctccctctgtgccgagattttgccagcagccaggcctgagcggaagtggtgctgctggggatggggtraggtgggggcggaggcaacgggctggggcccggtggggctgcaccgctctgagcctccgcctcccgctctccggagctgcgccgaggctggcatgagacg

SEQ ID NO: 66645 - DNA, 201 bp, Homo sapiens
tggagtacagtggcacagtgtcagctcactgcaacctccgcctcccgggttcaagcaattctcgtgcctcagcctcccatgtagctgggattaaatgtgcycgtcaccacacccggctgatttttttttgtattttagtagagacggagtttcaccatgttgccaaggctggtctcgaactcctgagctcaggcaatccac

SEQ ID NO: 66646 - DNA, 201 bp, Homo sapiens
cctaaagctcctgtcgcagaaaaagcttggtttgttttttatttttttcatccagtcctgagctgctaggaacaagaaggagccctctgactcccagagcrgagcccgagactccctcctgtggccctgaccttgggtttaattgctgtaaaggaagaacagcttccctgagtggcctagcctgccctcctcatagcagct

SEQ ID NO: 66647 - DNA, 201 bp, Homo sapiens
tcatccagtcctgagctgctaggaacaagaaggagccctctgactcccagagcggagcccgagactccctcctgtggccctgaccttgggtttaattgctstaaaggaagaacagcttccctgagtggcctagcctgccctcctcatagcagctgcagcaaaagtgccaggcgtcaccagctgtgccaggctggaggtgac

SEQ ID NO: 66648 - DNA, 201 bp, Homo sapiens
tgtgatggccgcgggtgccaagcacggcctcatcaacgcagggtaccgcgccattgactccctgagcattgagaaaggtgagtgcagggtctggacagcayggggcgggggcgggcgcagtggggggcagtgacgctcgagacacctggaggccgagaagctgtttaccttccctgtgttgtcacccggcttccttctttc

SEQ ID NO: 66649 - DNA, 201 bp, Homo sapiens
gaccttgggtttaattgctgtaaaggaagaacagcttccctgagtggcctagcctgccctcctcatagcagctgcagcaaaagtgccaggcgtcaccagcwgtgccaggctggaggtgacaccctcctcctgcctaagagcacctgcacctggggctgactggctcccgagcgcttgctggggagcccgagccagggtgtg

SEQ ID NO: 66650 - DNA, 201 bp, Homo sapiens
gaacctgtgaatggggccttgtttggaaataggatctttgcaggtgtaattaaggtcaggatctccagatgatattatctagggctagggaaggtcctaartccagtgacaagtgtccttagaagacagagacacaaaggggaggctgtgagggctgaggcagaaatcgcagtggtgcagccacaagccaaggggtgccgg

SEQ ID NO: 66651 - DNA, 201 bp, Homo sapiens
ctgcagcaaaagtgccaggcgtcaccagctgtgccaggctggaggtgacaccctcctcctgcctaagagcacctgcacctggggctgactggctcccgagsgcttgctggggagcccgagccagggtgtgggatggggagcatgcagaggccaagctgtctagaaggctgttccagccgcccctgccccgagggattcgag

SEQ ID NO: 66652 - DNA, 201 bp, Homo sapiens
ttattgaccgtgttcccaccgttgcaagggccgtggagggacgagatgaagcttagcccagagcacccgataatcggcactgtcacttctgcagggcttgrgccatcgtgtctttcacagtcaggtatccacagccccacaggcctttctctcctgcctcccaccatgtccgctgcccaacgctgggcctttgcacctcac

SEQ ID NO: 66653 - DNA, 201 bp, Homo sapiens
tgcttgcccgggtccggggaagccaccgtgttgctgctgtttcccaggcatctggaattgctggggtgggaggtgtgttgtccggtggaagtcatattggytgccagaccttggctttgccggaccccagatgcccatgtccaactcaagatcacatggacacgaactgcacctgctctggggcaatgcctgggttcagaa

SEQ ID NO: 66654 - DNA, 201 bp, Homo sapiens
tgctctggggcaatgcctgggttcagaaaggagtccctggcacagggatgagtttgcccacagggcaggtagcaagaccaagaccccctcctccagagaarcaggcagacgtgagccctgtacctaccaacagagagtgatcctcatccccacctctgctcctaggtctcgctggactttgtgaagagcggggactatgcc

SEQ ID NO: 66655 - DNA, 201 bp, Homo sapiens
ccattccttccccctctccctggccatctcgtgctggacgctttgctttctggggaacaggggctatgtcctaggcactctggttcctgagcattgaggtrctcgggggatgtttgttgaacagatggatgggcggggaggcaagagggaggctcagggagcaggtggcgtttaaactgaagaaggggcctccctcacctg

SEQ ID NO: 66656 - DNA, 201 bp, Homo sapiens
tcatttctcacctgggtgaccccaacctccgcatctctggggtagagggaggggtgtcaaggcctggtccttggaatcctctggcttcattgccacgccarccttggacagggagtggggatatttttagtgtgggggaggcaggtgggccgtggagggaggaggtggcagatggaccgatcaaggtgcggcccgggggcg

SEQ ID NO: 66657 - DNA, 201 bp, Homo sapiens
ggatatcctttagatgggtggtcagggcagggtttttcagggaggggacatccaagcagagccctgcaccgcgacaacaaaccagcgtgccaggtctgggygaagaactgccccattgaggggtgaaggccttgagctcacacaagcttgctcttcccaaagagctgcaggaaggtcagggtggcgggcccagtggtagag

SEQ ID NO: 66658 - DNA, 201 bp, Homo sapiens
cgtgcatgatgaagagtggagggtgctggccgcagctgccgggaaagggactgggatgcggtggaatcatgcagtccccagcctggcccacaggcagccgygatgctgtgtgcttttcatttctcacctgggtgaccccaacctccgcatctctggggtagagggaggggtgtcaaggcctggtccttggaatcctctggc

SEQ ID NO: 66659 - DNA, 201 bp, Homo sapiens
cttctagcagtttccaaccatcactgcgcgtgggtttcagcacaggggctgagtgcagacctcacttctaccaagcccactttgggcacgacccttgcccmctcagaacaaggatgctgggtctgtgggcaggtctcgtgagctgcggcacgaagctcatctggctgggacatggtggtcagcggcatctcagaggaccgt

SEQ ID NO: 66660 - DNA, 201 bp, Homo sapiens
aggcagggatgccaggagggagtgatgagctgagtccatgcggctcacgggcgagggtttggcgttgtggtggttcccatggactgggcgaggctcatagyacccgacagtggatggggtgtgctgagagggtcgggggagggtaggggacagagacagcttccgcgtgcatgatgaagagtggagggtgctggccgcagc

SEQ ID NO: 66661 - DNA, 201 bp, Homo sapiens
cccagcctggcccacaggcagccgcgatgctgtgtgcttttcatttctcacctgggtgaccccaacctccgcatctctggggtagagggaggggtgtcaakgcctggtccttggaatcctctggcttcattgccacgccagccttggacagggagtggggatatttttagtgtgggggaggcaggtgggccgtggagggag

SEQ ID NO: 66662 - DNA, 201 bp, Homo sapiens
ctgctcccagcagtggtaacagcaggtgcaaaggccccgtggcaggccagtgcgtatgtctgaggcacgcattgaggctgggatggagcaggccaggagcygggctcagagggcagcagggtgagatactggaggcccagcagctgctcctctgagggaggggtgctgagcagaggaggaacatggtcgggcttgggcttt

SEQ ID NO: 66663 - DNA, 201 bp, Homo sapiens
acgcttatctgggtgtaggaggtgcgggtactgctggagcggggtaggggggacacggctgctgtctctgcaagaggaagaggataaccagcctgagagcragagtgtgagtggggggtgaggtgggggtggggttgtcgctgtggcaggttccagagctggctaggattcccaatcactgccgctcttgggccccaggtg

SEQ ID NO: 66664 - DNA, 201 bp, Homo sapiens
tccctgggctcctgagagctgatgcgagccggctcccacaagccactgctccaactcttgctcttgccttctcactggccccctagctgggctgtcatagmctcttccctgacgtttcgccagccacacccctggcctgccacctctcacattcagctgctggagggcatcctttgttggggagagtgcagatttaagctt

SEQ ID NO: 66665 - DNA, 201 bp, Homo sapiens
tgggagagacggtgtcgtgcagcccagaactggccatcgctgtggtcatggttagcaccaggggctttgtgtgctttcttgctggttcctcacagtggccygtggcatcacagatgagggactggggcttggtagggttcaggggtaagtacagggcctgggactagaaccggggcctctgactgggaagctcgtggaccc

SEQ ID NO: 66666 - DNA, 201 bp, Homo sapiens
tgcaaaatagaaccaagctgttgttattttgtgattttttttttttaccaagcagtagactgcaaacatctttctgttaatcaaatatcttgctttttttwaaaaaaaaaaaagtcagctactttttcacgttatgaaaagagggttccccccacaagtcaagtgaaagaacttgcccaactttcaagttctccaagtcaa

SEQ ID NO: 66667 - DNA, 201 bp, Homo sapiens
ggagagacggtgtcgtgcagcccagaactggccatcgctgtggtcatggttagcaccaggggctttgtgtgctttcttgctggttcctcacagtggcccgyggcatcacagatgagggactggggcttggtagggttcaggggtaagtacagggcctgggactagaaccggggcctctgactgggaagctcgtggacccct

SEQ ID NO: 66668 - DNA, 201 bp, Homo sapiens
agagccctacccggggcatggggccatgcaacctgtccagcgcagctggccccacagccgagaagagtgtgccatatcagcggaccctgaaggagggacarggcacctcggtggtggcccaaggcccaagccggcccctgcccagcacggccaacgtggtggtcattggtggaggcagcttgggctgccagaccctgtacc

SEQ ID NO: 66669 - DNA, 201 bp, Homo sapiens
gccttggaccaggtggcagctccaggcttctgccccagggtcccttccgtgcggctgccactcaaggctgcagagagcatgtgcttgtcaggtctgaggcrctggtatcactctccagggcttggcaccacgtgggtgctgagtggttacataagggtcttggccaactgtaccacagctgagcacctcaggctgacgtgg

SEQ ID NO: 66670 - DNA, 201 bp, Homo sapiens; identical to SEQ ID NO: 41069

SEQ ID NO: 66671 - DNA, 201 bp, Homo sapiens; identical to SEQ ID NO: 44679

SEQ ID NO: 66672 - DNA, 201 bp, Homo sapiens; identical to SEQ ID NO: 44681

SEQ ID NO: 66673 - DNA, 201 bp, Homo sapiens; identical to SEQ ID NO: 41072

SEQ ID NO: 66674 - DNA, 201 bp, Homo sapiens; identical to SEQ ID NO: 44682

SEQ ID NO: 66675 - DNA, 201 bp, Homo sapiens; identical to SEQ ID NO: 41074

SEQ ID NO: 66676 - DNA, 201 bp, Homo sapiens; identical to SEQ ID NO: 44683

SEQ ID NO: 66677 - DNA, 201 bp, Homo sapiens; identical to SEQ ID NO: 41075

SEQ ID NO: 66678 - DNA, 201 bp, Homo sapiens; identical to SEQ ID NO: 41076

SEQ ID NO: 66679 - DNA, 201 bp, Homo sapiens; identical to SEQ ID NO: 41522

SEQ ID NO: 66680 - DNA, 201 bp, Homo sapiens; identical to SEQ ID NO: 41078

SEQ ID NO: 66681 - DNA, 201 bp, Homo sapiens; identical to SEQ ID NO: 41080

SEQ ID NO: 66682 - DNA, 201 bp, Homo sapiens; identical to SEQ ID NO: 41082

SEQ ID NO: 66683 - DNA, 201 bp, Homo sapiens; identical to SEQ ID NO: 39802

SEQ ID NO: 66684 - DNA, 201 bp, Homo sapiens; identical to SEQ ID NO: 40115

SEQ ID NO: 66685 - DNA, 201 bp, Homo sapiens; identical to SEQ ID NO: 39324

SEQ ID NO: 66686 - DNA, 201 bp, Homo sapiens; identical to SEQ ID NO: 43268

SEQ ID NO: 66687 - DNA, 201 bp, Homo sapiens; identical to SEQ ID NO: 42499

SEQ ID NO: 66688 - DNA, 201 bp, Homo sapiens; identical to SEQ ID NO: 39441

SEQ ID NO: 66689 - DNA, 201 bp, Homo sapiens; identical to SEQ ID NO: 39443

SEQ ID NO: 66690 - DNA, 201 bp, Homo sapiens; identical to SEQ ID NO: 39444

SEQ ID NO: 66691 - DNA, 201 bp, Homo sapiens; identical to SEQ ID NO: 39445

SEQ ID NO: 66692 - DNA, 201 bp, Homo sapiens; identical to SEQ ID NO: 39446

SEQ ID NO: 66693 - DNA, 201 bp, Homo sapiens; identical to SEQ ID NO: 39449

SEQ ID NO: 66694 - DNA, 201 bp, Homo sapiens; identical to SEQ ID NO: 39451

SEQ ID NO: 66695 - DNA, 201 bp, Homo sapiens; identical to SEQ ID NO: 45217

SEQ ID NO: 66696 - DNA, 201 bp, Homo sapiens; identical to SEQ ID NO: 41139

SEQ ID NO: 66697 - DNA, 201 bp, Homo sapiens; identical to SEQ ID NO: 41828

SEQ ID NO: 66698 - DNA, 201 bp, Homo sapiens; identical to SEQ ID NO: 41829

SEQ ID NO: 66699 - DNA, 201 bp, Homo sapiens; identical to SEQ ID NO: 41830

SEQ ID NO: 66700 - DNA, 201 bp, Homo sapiens; identical to SEQ ID NO: 41831
  misc_feature (1)...(201): n = A,T,C or G, or insertion/deletion polymorphism (see Tables 1-2)

SEQ ID NO: 66701 - DNA, 201 bp, Homo sapiens; identical to SEQ ID NO: 41832

SEQ ID NO: 66702 - DNA, 201 bp, Homo sapiens; identical to SEQ ID NO: 41833

SEQ ID NO: 66703 - DNA, 201 bp, Homo sapiens; identical to SEQ ID NO: 41835

SEQ ID NO: 66704 - DNA, 201 bp, Homo sapiens; identical to SEQ ID NO: 41837

SEQ ID NO: 66705 - DNA, 201 bp, Homo sapiens; identical to SEQ ID NO: 43567

SEQ ID NO: 66706 - DNA, 201 bp, Homo sapiens; identical to SEQ ID NO: 40245

SEQ ID NO: 66707 - DNA, 201 bp, Homo sapiens; identical to SEQ ID NO: 40248

SEQ ID NO: 66708 - DNA, 201 bp, Homo sapiens; identical to SEQ ID NO: 40251

SEQ ID NO: 66709 - DNA, 201 bp, Homo sapiens; identical to SEQ ID NO: 39764

SEQ ID NO: 66710 - DNA, 201 bp, Homo sapiens; identical to SEQ ID NO: 41369

SEQ ID NO: 66711 - DNA, 201 bp, Homo sapiens; identical to SEQ ID NO: 39696

SEQ ID NO: 66712 - DNA, 201 bp, Homo sapiens; identical to SEQ ID NO: 39699

SEQ ID NO: 66713 - DNA, 201 bp, Homo sapiens; identical to SEQ ID NO: 39891

SEQ ID NO: 66714 - DNA, 201 bp, Homo sapiens; identical to SEQ ID NO: 39491

SEQ ID NO: 66715 - DNA, 201 bp, Homo sapiens; identical to SEQ ID NO: 39892

SEQ ID NO: 66716 - DNA, 201 bp, Homo sapiens; identical to SEQ ID NO: 39492

SEQ ID NO: 66717 - DNA, 201 bp, Homo sapiens; identical to SEQ ID NO: 41854

SEQ ID NO: 66718 - DNA, 201 bp, Homo sapiens; identical to SEQ ID NO: 39893

SEQ ID NO: 66719 - DNA, 201 bp, Homo sapiens; identical to SEQ ID NO: 39493

SEQ ID NO: 66720 - DNA, 201 bp, Homo sapiens; identical to SEQ ID NO: 41855

SEQ ID NO: 66721 - DNA, 201 bp, Homo sapiens; identical to SEQ ID NO: 39894

SEQ ID NO: 66722 - DNA, 201 bp, Homo sapiens; identical to SEQ ID NO: 41856

SEQ ID NO: 66723 - DNA, 201 bp, Homo sapiens; identical to SEQ ID NO: 39895

SEQ ID NO: 66724 - DNA, 201 bp, Homo sapiens; identical to SEQ ID NO: 41857

SEQ ID NO: 66725 - DNA, 201 bp, Homo sapiens; identical to SEQ ID NO: 39896

SEQ ID NO: 66726 - DNA, 201 bp, Homo sapiens; identical to SEQ ID NO: 44088

SEQ ID NO: 66727 - DNA, 201 bp, Homo sapiens; identical to SEQ ID NO: 41859

SEQ ID NO: 66728 - DNA, 201 bp, Homo sapiens; identical to SEQ ID NO: 39898

SEQ ID NO: 66729 - DNA, 201 bp, Homo sapiens; identical to SEQ ID NO: 41861

SEQ ID NO: 66730 - DNA, 201 bp, Homo sapiens; identical to SEQ ID NO: 39899

SEQ ID NO: 66731 - DNA, 201 bp, Homo sapiens; identical to SEQ ID NO: 39902

SEQ ID NO: 66732 - DNA, 201 bp, Homo sapiens; identical to SEQ ID NO: 39904

SEQ ID NO: 66733 - DNA, 201 bp, Homo sapiens; identical to SEQ ID NO: 42923

SEQ ID NO: 66734 - DNA, 201 bp, Homo sapiens; identical to SEQ ID NO: 39728

SEQ ID NO: 66735 - DNA, 201 bp, Homo sapiens; identical to SEQ ID NO: 39912

SEQ ID NO: 66736 - DNA, 201 bp, Homo sapiens; identical to SEQ ID NO: 41877

SEQ ID NO: 66737 - DNA, 201 bp, Homo sapiens; identical to SEQ ID NO: 41878

SEQ ID NO: 66738 - DNA, 201 bp, Homo sapiens; identical to SEQ ID NO: 41879

SEQ ID NO: 66739 - DNA, 201 bp, Homo sapiens; identical to SEQ ID NO: 41880

SEQ ID NO: 66740 - DNA, 201 bp, Homo sapiens; identical to SEQ ID NO: 44112

SEQ ID NO: 66741 - DNA, 201 bp, Homo sapiens; identical to SEQ ID NO: 44113

SEQ ID NO: 66742 - DNA, 201 bp, Homo sapiens; identical to SEQ ID NO: 43519

SEQ ID NO: 66743 - DNA, 201 bp, Homo sapiens; identical to SEQ ID NO: 43049

SEQ ID NO: 66744 - DNA, 201 bp, Homo sapiens; identical to SEQ ID NO: 44677

SEQ ID NO: 66745 - DNA, 201 bp, Homo sapiens; identical to SEQ ID NO: 41067

SEQ ID NO: 66746 - DNA, 201 bp, Homo sapiens
agcccggcctcagcttcctggccagagcgtctggcatggaatgtgctctgcagctttgtctctggggggacacccccctatgatgggacaaagccatcacygagcacatcccgcgctgcagagagctgacctttggctccatctggccctggggctactaatgtggaaggaggccctgggccaaaccagctgcccggctac

SEQ ID NO: 66747 - DNA, 201 bp, Homo sapiens
atctagtagtcggggagatcaagagaggtatgggacctgaagaggatggcagactgtgcagtgcggtgcacaccggtctccaggttgttttcaccctcctrtctcctcccaggagctaacgtgtaagcaaacatgtttggatagagggctggtgccacgccccaggctcaccccgcccgcacagccgtcgtccacccctcc

SEQ ID NO: 66748 - DNA, 201 bp, Homo sapiens
tgtttggaagtcatgctctgcccattcccctgccccagccaccctccccgcagcccatcctccctccctgaggaacctgccccttcacagctgttcacacrtccctgggcagcctctagtgcagcagcgatgccatgaaaccaccgtggagggcaccatcagccttggcactgctgccttaggaggtgcagcatgtccaca

SEQ ID NO: 66749 - DNA, 201 bp, Homo sapiens
cagcagatggccttgaaaatagaagccaccagagcagatgtctccgagcacctttacctgtgccctcctctgtgtctgtgcccaacatgctgcccccccccaagaagaactgcccatgtcgccagcccagggtacccctcacgtgtggcaggccccactccagccggcctcctccaggttatcagctggcctgcatcgtca

SEQ ID NO: 66750 - DNA, 201 bp, Homo sapiens
acctggctgctgtaagcttggcagttgccatggactccctgggagagatggcgtggcctggaacgtcccccgccctgaggtggggcagggctggtggggtytggtcatccccctggtgggtccatgcatggcagcctgggcaggatacatgtgagtgcctacctgggctggggtggcctgaccctctctgggcctcacagc

SEQ ID NO: 66751 - DNA, 201 bp, Homo sapiens
tgtaatcccagcactttgggaggccaaggtgggtggatcatgaggtcaggagttcgagaccagcctgaccaacatgatgaaaccccgtctctactaaaaawaaaaaaattagccaggcgtggtggcaggcacctgtactcccagctactcaggaggctgaggcaggagaattgcttgaacccaggaggcggaggttgcagt

SEQ ID NO: 66752 - DNA, 201 bp, Homo sapiens
ttcttgccccagcctggagagctgttttcttcaggaaggttctggagatggagacttgtttgcgaattcaccacaactccaggctgggaggctgggtctcygctctcagagccgagacaccagggaggatagccaggctgccctgcctgggaattctgctgggccgtcaaattcaacccgcaccaacgtgggcaggagggc

SEQ ID NO: 66753 - DNA, 201 bp, Homo sapiens
gagacagaaaccaacatagatgaaagtaagtgtgcgggtccaacctggccagaggtgtctggacaagtgttgaggcagcgcgtccaccagggagtcactcygaagcccctgtgcccgccacagacgccgggcccctccgcgtgactcggccagggctccttcagatgacctcccactcgtcctccaggtcctcagggtggg

SEQ ID NO: 66754 - DNA, 201 bp, Homo sapiens
gggactggcatgtccaagcagcaggacagcgtataaaaaggcctggaagccaagagaacgagctctgcagcgtagggttctcacgggaggtcctgtgcggycagccttttgcaccctgtggactccgggccagggagggcacacagggctggcaggcccgcggtggctggtgttgaggcatgaacaaattgtaccgggtat

SEQ ID NO: 66755 - DNA, 201 bp, Homo sapiens
ccgcgctggcagcggctgctgggtgaggacaagttccagtggctggcgggcctggcgccgccctcgctcttcgcgcgcgccatgcaggtgctggtcaccgscatctctccaggccgcttccccgaggccctggacgagctgccgctgcccccattcctgcagccgttggacctcactggcaaaggctaggcccggagcacc

SEQ ID NO: 66756 - DNA, 201 bp, Homo sapiens
gctgctgcgccagctgggccgcgacgccggggccactccctccgccgccggagcccccgcctcagctcccggggagccgcgccagcgccgcctgctgctgmtggacctcctggcgctgtacacccccgtgggtgccgccggctcggcccgccaggagctgctgggcgaccggccgcgctggcagcggctgctgggtgagga

SEQ ID NO: 66757 - DNA, 201 bp, Homo sapiens
ccagggatctgtggttcaggaccccctgcaaccccctcccagacccctgtactggtgggaggagaggacctagaggaaaggtgctgggcagataagcagcygagggaggccctgggtttagcttatcagtcttctgggccctcctgccccaggaagggcagcgaggaccatggtgttgcccctgtcatcgttatcgtcctg

SEQ ID NO: 66758 - DNA, 201 bp, Homo sapiens
tcttccaggtgctcagctttcccctaatacccgggaggcctcctagattctcctcttctgctcacaccctcacctataggtcaggggcctggcaggaggcrgcacttctctccagggaccgctggtgccctccgcctgctccagcacagttggcttcagtggctgcggcctctccgtctccctgcagtgcatactcaacta

SEQ ID NO: 66759 - DNA, 201 bp, Homo sapiens
cccccgcgccgcgcccgcggccgccgccccctcctcctccggcacacgcgcacgcaggtgcagccctcgctgcgccggccacctgcgcgcggacgccccgytcggccccgcgaccctccgccgcccgacgtctggccgtgcaggccgggaggggacgggtaggaggtggcgggtggccccgggcgcggcgctgccttcaat

SEQ ID NO: 66760 - DNA, 201 bp, Homo sapiens
ttacccttgaaagaaggcagtagggaggttgggacggagccagaggtcagacgcctaggctcaggtcggggctggggactcagagggcagggtcagggccyaagctcgattgcctgtgggttgggggtccccaccaattctggaatgagcccaaactgagacgcaggggacctgagttctaggcctggctctgccgtggct

SEQ ID NO: 66761 - DNA, 201 bp, Homo sapiens
cccctaatacccgggaggcctcctagattctcctcttctgctcacaccctcacctataggtcaggggcctggcaggaggcagcacttctctccagggaccsctggtgccctccgcctgctccagcacagttggcttcagtggctgcggcctctccgtctccctgcagtgcatactcaactagagttgtcgagaaaacctaa

SEQ ID NO: 66762 - DNA, 201 bp, Homo sapiens
ggagggagtagtagtggctcctggtgcaggtgccagtcttaaaggccaggtgagctttggtctggtctggccaggcagtggaaggacagaacctgcatgargtggggcaagtgttgggacacccccaggctctcacccggtcctagccactccgcatgctggccttgccagtcttgccacatgaaacaccttccctctgac

SEQ ID NO: 66763 - DNA, 201 bp, Homo sapiens
cttacccttgaaagaaggcagtagggaggttgggacggagccagaggtcagacgcctaggctcaggtcggggctggggactcagagggcagggtcagggcytaagctcgattgcctgtgggttgggggtccccaccaattctggaatgagcccaaactgagacgcaggggacctgagttctaggcctggctctgccgtggc

SEQ ID NO: 66764 - DNA, 201 bp, Homo sapiens
gcactgcagcaggagggcagcctgggccattagctcctgatgtcatcgatttgggtgaggggacagggaagtcagaggaagctggccagtggctctcacgmagacttacagcagcggagtggtgcctgattcctggtacagctgctcccactgagtctccagggatctgtggttcaggaccccctgcaaccccctcccaga

SEQ ID NO: 66765 - DNA, 201 bp, Homo sapiens
tcctgatgtcatcgatttgggtgaggggacagggaagtcagaggaagctggccagtggctctcacgcagacttacagcagcggagtggtgcctgattcctrgtacagctgctcccactgagtctccagggatctgtggttcaggaccccctgcaaccccctcccagacccctgtactggtgggaggagaggacctagagga

SEQ ID NO: 66766 - DNA, 201 bp, Homo sapiens
gctgccactcggagccagcccgcaggtcccgtgaccgccctgccagtcaagtctgtgcggggatgcctgcccctctgaggctgcaggcgaggacagtgcargctcaggacaaacccgggaaggaacaaagggcttccactgttttcggaaaacatatctctcttctaaatttgtaagatttgatttgaaatgaggtatttt

SEQ ID NO: 66767 - DNA, 201 bp, Homo sapiens
ggaattctgctgggccgtcaaattcaacccgcaccaacgtgggcaggagggccacagtgtcctgccaggagcagagggctgaaggtctgcaggaggaagarccactatcctggtggggggcacctgctgcccaccctgcccccagcgtgcctggggggagcacacctgggcatggaggagtccagggtgctgggccacaca

SEQ ID NO: 66768 - DNA, 201 bp, Homo sapiens
cagaacaaaactcacttttttggggggtgaagcaccttggttcatttgtttagttcgttaattccagcagtctgtttctaagggaaacatggctgcagccsgtcctgcccctccacccacccaccaggtgcccagtgttcccaagggccccgaatcccaaccttattcaggcgtcagcatctctgcaccccaaatgcctgt

SEQ ID NO: 66769 - DNA, 201 bp, Homo sapiens
cagaaggcatgggctgccactcggagccagcccgcaggtcccgtgaccgccctgccagtcaagtctgtgcggggatgcctgcccctctgaggctgcaggcraggacagtgcaggctcaggacaaacccgggaaggaacaaagggcttccactgttttcggaaaacatatctctcttctaaatttgtaagatttgatttgaa

SEQ ID NO: 66770 - DNA, 201 bp, Homo sapiens
gaggctgaggcaggagaattgcttgaacccaggaggcggaggttgcagtgagccaagattgcgccattgcactccagcctgggcgacagagcaagactccrtctcaaaaaaaaaaaaaaaaaagatggaaagacagatttctattggtgattcttaaaagtaatttatttatttatgtatttatttatttatttgagatgt

SEQ ID NO: 66771 - DNA, 201 bp, Homo sapiens
atgccagtgggcggggtgggcactgcccattgtctgaaggggccacagcagccgtccatagaggcactggtttcaacctgtcaagtgtcaacccatacccygcagaaggcatgggctgccactcggagccagcccgcaggtcccgtgaccgccctgccagtcaagtctgtgcggggatgcctgcccctctgaggctgcagg

SEQ ID NO: 66772 - DNA, 201 bp, Homo sapiens
ggcctgggtgaggtgggcagggaccaaggcctggcgcctgggcctcgctggccttgctctgcgtgctgacttcatcctgatagtaccttgattttcctacygtgacttccccttctgtcgacttcctcaccaactttaaaattccgtattgagagcagtttcctaagttacctcaaatcctattcagaagaaggttcttcc

SEQ ID NO: 66773 - DNA, 201 bp, Homo sapiens
gggcaggctaaaaaaagcagccagcctggtgtcctgtcctgaagctgcctccgggagggggcgggatgtgtggcagggcggcctagccctcacacgcagaygccagtgggcggggtgggcactgcccattgtctgaaggggccacagcagccgtccatagaggcactggtttcaacctgtcaagtgtcaacccataccccg

SEQ ID NO: 66774 - DNA, 201 bp, Homo sapiens
gtgcaggtgccagtcttaaaggccaggtgagctttggtctggtctggccaggcagtggaaggacagaacctgcatgaggtggggcaagtgttgggacaccmccaggctctcacccggtcctagccactccgcatgctggccttgccagtcttgccacatgaaacaccttccctctgacacccaaaatccacctgacccatg

SEQ ID NO: 66775 - DNA, 201 bp, Homo sapiens
cgctcggccccgcgaccctccgccgcccgacgtctggccgtgcaggccgggaggggacgggtaggaggtggcgggtggccccgggcgcggcgctgccttcratggcccaacccccttattcacgagccgcggccgtgactctgcccggtgacgtggggaggccgaactttacgtaacccgcccggcgccccacgcgtgccg

SEQ ID NO: 66776 - DNA, 201 bp, Homo sapiens
ctgcagtgcatactcaactagagttgtcgagaaaacctaagccggccataccacccctccgagggcccttcccactccccagcgtcctcacacactttccrgggcctctgtgcttgcagccccagcctccccctactgcctgtggctccctgcctgggcacacacagacccctgccctggtgggacaagccctcccagagg

SEQ ID NO: 66777 - DNA, 201 bp, Homo sapiens
ctattctcagcagatggccttgaaaatagaagccaccagagcagatgtctccgagcacctttacctgtgccctcctctgtgtctgtgcccaacatgctgcycccccccaagaagaactgcccatgtcgccagcccagggtacccctcacgtgtggcaggccccactccagccggcctcctccaggttatcagctggcctgc

SEQ ID NO: 66778 - DNA, 201 bp, Homo sapiens
tggaggctgtgggttctggaacgagacagaaaccaacatagatgaaagtaagtgtgcgggtccaacctggccagaggtgtctggacaagtgttgaggcagygcgtccaccagggagtcactccgaagcccctgtgcccgccacagacgccgggcccctccgcgtgactcggccagggctccttcagatgacctcccactcg

SEQ ID NO: 66779 - DNA, 201 bp, Homo sapiens
accaggacggcagcacgtgggtaatcggagtgcatgcagccgggcagtcgccactgtcctgagctaggaggcgccactgctgcagcaatcacgccagccaygggtggaggctgtgggttctggaacgagacagaaaccaacatagatgaaagtaagtgtgcgggtccaacctggccagaggtgtctggacaagtgttgagg

SEQ ID NO: 66780 - DNA, 201 bp, Homo sapiens
acgccccatgcaccctcctgtgccgtccctacctgggacacacgtgcacacatccaggttccatttgcacccatcaggctttactgtttcagctgaagtgygctctccaggaggcgggcagcctgcgccgtgtgtgggcagtgaggtgtggtgtggtgtggtgtggtgagatgtggcgaggtacggtgcggtgcggtgcgg

SEQ ID NO: 66781 - DNA, 201 bp, Homo sapiens
ccacgccccatgcaccctcctgtgccgtccctacctgggacacacgtgcacacatccaggttccatttgcacccatcaggctttactgtttcagctgaagwgtgctctccaggaggcgggcagcctgcgccgtgtgtgggcagtgaggtgtggtgtggtgtggtgtggtgagatgtggcgaggtacggtgcggtgcggtgc

SEQ ID NO: 66782 - DNA, 201 bp, Homo sapiens
agagcccaggtgtccagccccttccctccctgggacacactcctggctttgccctcagttcttgctttgagagattggagcccagtggggtcggcttcttygagagccccccgacatcgtccacaggagccctgggaaccccaaggggccttaagcccactggccccgggcacctgcctgtgaaacacgacacgctgccgg

SEQ ID NO: 66783 - DNA, 201 bp, Homo sapiens
tgtttctaagggaaacatggctgcagcccgtcctgcccctccacccacccaccaggtgcccagtgttcccaagggccccgaatcccaaccttattcaggcrtcagcatctctgcaccccaaatgcctgttagggaggatagtgaaggctgagccctcctgggctcatcaaaagccagcagtgagagaacacccccatctct

SEQ ID NO: 66784 - DNA, 201 bp, Homo sapiens
ccgtgcgagtggctgaacgtctttgtcagccgttggaggaggtagccgggcgggcccacagcccacagctcatctgacgcagtcactgcagggacaagagycaatcacatacttgtcaatcacacagcctgtggggtgggcacagatggagctgggagcttgggcacagatggagctgggagcttgggcgcaggtctgggc

SEQ ID NO: 66785 - DNA, 201 bp, Homo sapiens
ctaacgtgtaagcaaacatgtttggatagagggctggtgccacgccccaggctcaccccgcccgcacagccgtcgtccacccctcccctttcttacagatraagctgaggctcggccagggactgtgatatacccacatccccggaactaggtgatcgcggtgcaggaaccaggtaggtctgagtctggatcatgcctctg

SEQ ID NO: 66786 - DNA, 201 bp, Homo sapiens
agggacaagagccaatcacatacttgtcaatcacacagcctgtggggtgggcacagatggagctgggagcttgggcacagatggagctgggagcttgggcrcaggtctgggcttgccacattctaggtgggggacactggacaagccaccatctccatgtgaacttcgtaccctcagctgtaagtggatgtcaacagcacc

SEQ ID NO: 66787 - DNA, 201 bp, Homo sapiens
actcggagccagcccgcaggtcccgtgaccgccctgccagtcaagtctgtgcggggatgcctgcccctctgaggctgcaggcgaggacagtgcaggctcargacaaacccgggaaggaacaaagggcttccactgttttcggaaaacatatctctcttctaaatttgtaagatttgatttgaaatgaggtattttatgcag

SEQ ID NO: 66788 - DNA, 201 bp, Homo sapiens
ggggccacagcagccgtccatagaggcactggtttcaacctgtcaagtgtcaacccataccccgcagaaggcatgggctgccactcggagccagcccgcargtcccgtgaccgccctgccagtcaagtctgtgcggggatgcctgcccctctgaggctgcaggcgaggacagtgcaggctcaggacaaacccgggaaggaa

SEQ ID NO: 66789 - DNA, 201 bp, Homo sapiens
ctgggcctgggccaggggcaggctaaaaaaagcagccagcctggtgtcctgtcctgaagctgcctccgggagggggcgggatgtgtggcagggcggcctakccctcacacgcagatgccagtgggcggggtgggcactgcccattgtctgaaggggccacagcagccgtccatagaggcactggtttcaacctgtcaagtg

SEQ ID NO: 66790 - DNA, 201 bp, Homo sapiens
gtttcttttcacccctcttgctcctccccggagttatgaaaaatttcaaacctgccaaaagtttgaagtttacaacaaataccctccaacgtttgggttgyctccctcccccttctctccctttctccctctgatttcttacagaaccacgctttcatgaccatgcccgggaacttcacgctggcgcggtgaggtcctgcg

SEQ ID NO: 66791 - DNA, 201 bp, Homo sapiens
gggcagcctgggccattagctcctgatgtcatcgatttgggtgaggggacagggaagtcagaggaagctggccagtggctctcacgcagacttacagcagyggagtggtgcctgattcctggtacagctgctcccactgagtctccagggatctgtggttcaggaccccctgcaaccccctcccagacccctgtactggtg

SEQ ID NO: 66792 - DNA, 201 bp, Homo sapiens
ttaaaggccaggtgagctttggtctggtctggccaggcagtggaaggacagaacctgcatgaggtggggcaagtgttgggacacccccaggctctcacccrgtcctagccactccgcatgctggccttgccagtcttgccacatgaaacaccttccctctgacacccaaaatccacctgacccatgtcacagataagtgac

SEQ ID NO: 66793 - DNA, 201 bp, Homo sapiens
ggcccaacccccttattcacgagccgcggccgtgactctgcccggtgacgtggggaggccgaactttacgtaacccgcccggcgccccacgcgtgccggcwcagggcatatctggggcccggaggcccaggcttggggaaggggctccagtcacggtgttgcccacgggccacagcctacccgcaccgcgccgctctcttt

SEQ ID NO: 66794 - DNA, 201 bp, Homo sapiens
gaaacaccttccctctgacacccaaaatccacctgacccatgtcacagataagtgactggtgctcagcccagtcccaccactggtgggtggctgattaggsgggatccagcatgtctggtgccagcccctccctgaggaagctgcctgccctcctgcctgcacctgtggtgccttcctggccgcggccacctgtcccatcc

SEQ ID NO: 66795 - DNA, 201 bp, Homo sapiens
cgggtggaggctgtgggttctggaacgagacagaaaccaacatagatgaaagtaagtgtgcgggtccaacctggccagaggtgtctggacaagtgttgagrcagcgcgtccaccagggagtcactccgaagcccctgtgcccgccacagacgccgggcccctccgcgtgactcggccagggctccttcagatgacctccca

SEQ ID NO: 66796 - DNA, 201 bp, Homo sapiens
ggcgcggcgctgccttcaatggcccaacccccttattcacgagccgcggccgtgactctgcccggtgacgtggggaggccgaactttacgtaacccgcccrgcgccccacgcgtgccggcacagggcatatctggggcccggaggcccaggcttggggaaggggctccagtcacggtgttgcccacgggccacagcctacc

SEQ ID NO: 66797 - DNA, 201 bp, Homo sapiens
ctggccgctcctctctttgaggccacctctctgagccctgatttgctggcgggtgaactggggatcatcgtgtccactgtggctggtggtcgtgaaacgawgtggaaacatgagtgttgaggccgagatgggcgcagtgcgcgctcctaaacagctgtccccatccgtccgcccctccctcccttgcgcgggtcagctgga

SEQ ID NO: 66798 - DNA, 201 bp, Homo sapiens
cagcccacatgggcaccatctccccaagatgtcccccagggtttggggctcccaaaggccgattgttgactccaggaccttcactcactttgctctccccrccatcgtactcagaggcatccagaaccggcagatgggagaagccctagggagataggcctagatacaggaggagacatgtggagctgaggcaaaggcggg

SEQ ID NO: 66799 - DNA, 201 bp, Homo sapiens
ctgtatctcaactccagccttcgaagagggcaagagagcaggggagccttgagccacagacagcccacatgggcaccatctccccaagatgtcccccaggktttggggctcccaaaggccgattgttgactccaggaccttcactcactttgctctccccgccatcgtactcagaggcatccagaaccggcagatgggaga

SEQ ID NO: 66800 - DNA, 201 bp, Homo sapiens
tgcaccaccaggcctaattttgtgtttttagtagcgacagggtttcaccatgttggtcaggctggtcttgaactcctgacctcaggtgatctgtccgcctyggactcccaaagttctgggattacaggtgtgagccaccacatctgaatctgtcccagccgaccgctcccttatttttgggacaccttggcttcgggaagc

SEQ ID NO: 66801 - DNA, 201 bp, Homo sapiens
ctgggttcaagcgattctcctgcctcagcctaccgagtagctgggattacaggcatgcaccaccaggcctaattttgtgtttttagtagcgacagggtttyaccatgttggtcaggctggtcttgaactcctgacctcaggtgatctgtccgcctcggactcccaaagttctgggattacaggtgtgagccaccacatctg

SEQ ID NO: 66802 - DNA, 201 bp, Homo sapiens
atctgccgggcccccaagcatgtgagttttccctgctggtggggcaagtgcctgagtcctaacccggccagcacgggctttcccagtctactcagttttcrccaggagcctgtacacgtgctgattcctggcaaagctgaatgtctatctccacgtgtctgttggccagcatgtggataacctatggtgccctcgcccatc

SEQ ID NO: 66803 - DNA, 201 bp, Homo sapiens
aggtgtccagccccttccctccctgggacacactcctggctttgccctcagttcttgctttgagagattggagcccagtggggtcggcttcttcgagagcmccccgacatcgtccacaggagccctgggaaccccaaggggccttaagcccactggccccgggcacctgcctgtgaaacacgacacgctgccgggaatttt

SEQ ID NO: 66804 - DNA, 201 bp, Homo sapiens; identical to SEQ ID NO: 49577

SEQ ID NO: 66805 - DNA, 201 bp, Homo sapiens
agccagctccagatgtagaaagaccctttggggtcatggctggagggcaagctggtggaggggactggactggagggggacccaaaaggccagataagaggttgagatagaccaggcgcggtggctcatgcctgtaatcccagcactttgggaggccgaggtgggtggatcatgaagtcaagagattgaggccatcctggc

SEQ ID NO: 66806 - DNA, 201 bp, Homo sapiens; identical to SEQ ID NO: 49579

SEQ ID NO: 66807 - DNA, 201 bp, Homo sapiens; identical to SEQ ID NO: 49578

SEQ ID NO: 66808 - DNA, 201 bp, Homo sapiens; identical to SEQ ID NO: 49581

SEQ ID NO: 66809 - DNA, 201 bp, Homo sapiens; identical to SEQ ID NO: 49580

SEQ ID NO: 66810 - DNA, 201 bp, Homo sapiens; identical to SEQ ID NO: 49582

SEQ ID NO: 66811 - DNA, 201 bp, Homo sapiens; identical to SEQ ID NO: 49585

SEQ ID NO: 66812 - DNA, 201 bp, Homo sapiens; identical to SEQ ID NO: 49584

SEQ ID NO: 66813 - DNA, 201 bp, Homo sapiens
ttgcccagtggagaggggtcctggtcctgtgaccttgaatgtctctaatcatgtccttaagcataatgccattctgtgtgtgtgtgtgtgtgtgtgtgtgkacatgcacgtgtgcagtgggtatacaaggccctgtatgttcacatcctctccacatgcatgagccagatccccatatgtgaaacccaatcagtgactcca

SEQ ID NO: 66814 - DNA, 201 bp, Homo sapiens
atcaggggtgcttcatcagtacctgcctaggctggttaggaggaggagcacgtgcgatcgtgacgggaagcgctcagcacagacctggcaccgaggaagtyccaggggctcggctcctttccctcgtcaccaccgcgccccaacagagggaggcggctgcaggggtggcggcgaaagggcccaccgggcgttccggagtcg

SEQ ID NO: 66815 - DNA, 201 bp, Homo sapiens; identical to SEQ ID NO: 49586

SEQ ID NO: 66816 - DNA, 201 bp, Homo sapiens
cagcactttgggaggccgaggtgggtggatcatgaagtcaagagattgaggccatcctggctaacacggtgaaaccctgtctctacttaaaaaaaaaaaawttccaaaaaattagccgggcacggtggtgggcgcctgtagtcccagctactcgggaggctgaggcgggagaatggtgtgaacctgggaggtggagcttgc

SEQ ID NO: 66817 - DNA, 201 bp, Homo sapiens; identical to SEQ ID NO: 49589

SEQ ID NO: 66818 - DNA, 201 bp, Homo sapiens
cacttttgtccttgaaagtgaggctggagccaggcaactcatgcctgtaatcccagcactttgggaggctgaggcgggtggatcactagaggtcaggagtwcaagaccagcctggccaacatggtgaaactccgtctctactaaaattacaaaaattagctgggcgtggtggcacacacctgtaatcccaattgcttggga

SEQ ID NO: 66819 - DNA, 201 bp, Homo sapiens
tgtccttgaaagtgaggctggagccaggcaactcatgcctgtaatcccagcactttgggaggctgaggcgggtggatcactagaggtcaggagttcaagaycagcctggccaacatggtgaaactccgtctctactaaaattacaaaaattagctgggcgtggtggcacacacctgtaatcccaattgcttgggaggctga

SEQ ID NO: 66820 - DNA, 201 bp, Homo sapiens
ccttgaaagtgaggctggagccaggcaactcatgcctgtaatcccagcactttgggaggctgaggcgggtggatcactagaggtcaggagttcaagaccagcctggccaacatggtgaaactccgtctctactaaaattacaaaaattagctgggcgtggtggcacacacctgtaatcccaattgcttgggaggctgaggc

SEQ ID NO: 66821 - DNA, 201 bp, Homo sapiens; identical to SEQ ID NO: 49591

SEQ ID NO: 66822 - DNA, 201 bp, Homo sapiens; identical to SEQ ID NO: 49592

SEQ ID NO: 66823 - DNA, 201 bp, Homo sapiens
gtcctggtcctgtgaccttgaatgtctctaatcatgtccttaagcataatgccattctgtgtgtgtgtgtgtgtgtgtgtgtgtacatgcacgtgtgcagkgggtatacaaggccctgtatgttcacatcctctccacatgcatgagccagatccccatatgtgaaacccaatcagtgactccacagatctggcttggggg

SEQ ID NO: 66824 - DNA, 201 bp, Homo sapiens; identical to SEQ ID NO: 49595

SEQ ID NO: 66825 - DNA, 201 bp, Homo sapiens
gccgggcacggtggtgggcgcctgtagtcccagctactcgggaggctgaggcgggagaatggtgtgaacctgggaggtggagcttgcagtgagccgacatygtgccactgcactccagcctgggtgacagagtgagactccgtctcaaaaaaaaaaaaaagttgggacaggggtccttggtgatgatggagagagatccag

SEQ ID NO: 66826 - DNA, 201 bp, Homo sapiens; identical to SEQ ID NO: 49596

SEQ ID NO: 66827 - DNA, 201 bp, Homo sapiens
aaggctgtgagcaggggaggggcggggtgatctccaagtgcagagagaccctctagggccacgtggtgaccgacaggaggctgtcctcccggacaggaggrgcgagggtccagagagagaggaggacgtctgagctggagccaggccaaggggacagagaggaggggacggggcagagagaggcaggggccgaagggacaa

SEQ ID NO: 66828 - DNA, 201 bp, Homo sapiens
gggcgtggtggtggtcgcctgtaatcccagctactcaggaggctgaggcaggagaatctattgagcccaggaagtggaggttgcagtgatctgagatcgcrctattgcactccagcctgggtgacaagagcgaaacttcatctcagaaaaaaaaaaaaaaaaagaatccagaccccacaattcaaaatcccaaatctacca

SEQ ID NO: 66829 - DNA, 201 bp, Homo sapiens; identical to SEQ ID NO: 49597

SEQ ID NO: 66830 - DNA, 201 bp, Homo sapiens
caaggtcagtgccaagggcgtctggccgaataactgggtggtcggtgacgctgcccctgagatgaagaacgtggaagaacagggaaggagggtttggggamatagagcaatgagttgggactcggtaagtgagaggggcctagggacagtggtgcagggggcgcccaggagcaggtggctgcccaagccggagttcagggt

SEQ ID NO: 66831 - DNA, 201 bp, Homo sapiens
agcgccctcagtgtccccgtctgtatcaggggtgcttcatcagtacctgcctaggctggttaggaggaggagcacgtgcgatcgtgacgggaagcgctcakcacagacctggcaccgaggaagtcccaggggctcggctcctttccctcgtcaccaccgcgccccaacagagggaggcggctgcaggggtggcggcgaaag

SEQ ID NO: 66832 - DNA, 201 bp, Homo sapiens
cccataaagatgatgactttccacacatggggagagaccacgcttacaacaggtcccatccttcactgggtgacctgagtgaggtcagtccctcctgtctygggacctcctcattaattaagccaaaatagactctagataattgcttggggccctctggggttctgagacattggaagccagcctcaaatacccaaagcc

SEQ ID NO: 66833 - DNA, 201 bp, Homo sapiens
gggagccgagcgcagaccgggtgcgcgcctgggttcggcgcggcgggagcgccctcagtgtccccgtctgtatcaggggtgcttcatcagtacctgcctargctggttaggaggaggagcacgtgcgatcgtgacgggaagcgctcagcacagacctggcaccgaggaagtcccaggggctcggctcctttccctcgtcac

SEQ ID NO: 66834 - DNA, 201 bp, Homo sapiens
acccaaagccttgggtcatctcagtgatcatctccagcctctgggatgcagaatccagatttcaagctctagaacccagaaataagactacaggaccagartagagaccctgggttcccagactctaaattcagactctagagtcaagattctagcaatctcagaatcgtgaaagccaggtccctgtctctcaattcagcc

SEQ ID NO: 66835 - DNA, 201 bp, Homo sapiens
aaggaacggaggccgtggtgagactaagttagaagagggccagcacctcatggggaggcccttcgggcaccacgagtccagtcccgctccggaggtgggcrgtctgcaggccccctgagaagggggtttgaggggaggctttttcctgctggggaatctcaaagggcttaaaactgcagaccgagaagccgggaccttgcc

SEQ ID NO: 66836 - DNA, 201 bp, Homo sapiens; identical to SEQ ID NO: 49598

SEQ ID NO: 66837 - DNA, 201 bp, Homo sapiens; identical to SEQ ID NO: 49600

SEQ ID NO: 66838 - DNA, 201 bp, Homo sapiens; identical to SEQ ID NO: 49602

SEQ ID NO: 66839 - DNA, 201 bp, Homo sapiens
tcagcctcccaaaggcatgagtcactgggcccagccacagtccaggttttcaatgcaaaaacagatttgaaactccagactgtatgttccaaagtctactyctgaaagctcagaggctagatccaccctgtagaatccagaccccaagcctggcatggtggctcacgcctgtaatcccagcactttaggaggctgagtcag

SEQ ID NO: 66840 - DNA, 201 bp, Homo sapiens; identical to SEQ ID NO: 49603

SEQ ID NO: 66841 - DNA, 201 bp, Homo sapiens
tcttgaacccagaaggcagaggttacagtgagcggagatcacgccactccactccaacctgggctacagagccagactccgtctcaaaaaaaaaaaaaaaraagaaaaaaaaagaaagaaagtgaatttgaagagctggactttatcctggtggtgccaaggatccatggagggtggtgagcaggggaggggcacagccag

SEQ ID NO: 66842 - DNA, 201 bp, Homo sapiens; identical to SEQ ID NO: 9323

SEQ ID NO: 66843 - DNA, 201 bp, Homo sapiens; identical to SEQ ID NO: 49605

SEQ ID NO: 66844 - DNA, 201 bp, Homo sapiens; identical to SEQ ID NO: 9313

SEQ ID NO: 66845 - DNA, 201 bp, Homo sapiens
agtgctgaggtcacagaaagaacctgacctgagccccatcttcaagacccccagatggagaaaagaacaggccagacctcagcaagtatggggcatctgcrctgtaatggagacagaatgggtgctgtgggattcaggggagacacctgttaggtgttggggcctcccagaagaggtgggggcagagtgtcagaggacaaa

SEQ ID NO: 66846 - DNA, 201 bp, Homo sapiens; identical to SEQ ID NO: 9314

SEQ ID NO: 66847 - DNA, 201 bp, Homo sapiens
acacctgttaggtgttggggcctcccagaagaggtgggggcagagtgtcagaggacaaagatgaatttggaagatatggggaagaaggatttcaattcacyctcaaagcttcctgaggcctcccgtgggtcgggccctgcagtactggagacccagagtggagtcagaccagctcctcggggagctgccagtctcgtaggg

SEQ ID NO: 66848 - DNA, 201 bp, Homo sapiens; identical to SEQ ID NO: 49609

SEQ ID NO: 66849 - DNA, 201 bp, Homo sapiens; identical to SEQ ID NO: 49610

SEQ ID NO: 66850 - DNA, 201 bp, Homo sapiens; identical to SEQ ID NO: 49614

SEQ ID NO: 66851 - DNA, 201 bp, Homo sapiens
aaatcttaccttccagagtgtcctccactgccagaatgtcttagggcctgtgcttttagaatctgaaagtctgatattctagaaattccaggggcctgtarttctagaatggctgaatccttcccataaagatgatgactttccacacatggggagagaccacgcttacaacaggtcccatccttcactgggtgacctgag

SEQ ID NO: 66852 - DNA, 201 bp, Homo sapiens; identical to SEQ ID NO: 49612

SEQ ID NO: 66853 - DNA, 201 bp, Homo sapiens; identical to SEQ ID NO: 49618

SEQ ID NO: 66854 - DNA, 201 bp, Homo sapiens; identical to SEQ ID NO: 49616

SEQ ID NO: 66855 - DNA, 201 bp, Homo sapiens; identical to SEQ ID NO: 9317

SEQ ID NO: 66856 - DNA, 201 bp, Homo sapiens; identical to SEQ ID NO: 49620

SEQ ID NO: 66857 - DNA, 201 bp, Homo sapiens
ctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactcca

SEQ ID NO: 66858 - DNA, 201 bp, Homo sapiens; identical to SEQ ID NO: 49619

SEQ ID NO: 66859 - DNA, 201 bp, Homo sapiens
cagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcccaggtagtgccccttcaggtg

SEQ ID NO: 66860 - DNA, 201 bp, Homo sapiens; identical to SEQ ID NO: 49622

SEQ ID NO: 66861 - DNA, 201 bp, Homo sapiens; identical to SEQ ID NO: 49621

SEQ ID NO: 66862 - DNA, 201 bp, Homo sapiens
agactccagcttgagtcccacacctgccactccctgtctcttacagggtctttgaggggattaaatgtggttgtgtgtgaggcagaagcataagcctggcycaggtagtgccccttcaggtgtgcaagccaggcacggtgcttagagcttacatacaacgtctatgtgtggtgggcaccaccgacctcatttgacaaggga

SEQ ID NO: 66863 - DNA, 201 bp, Homo sapiens; identical to SEQ ID NO: 49624

SEQ ID NO: 66864 - DNA, 201 bp, Homo sapiens; identical to SEQ ID NO: 49623

SEQ ID NO: 66865 - DNA, 201 bp, Homo sapiens
ggggattaaatgtggttgtgtgtgaggcagaagcataagcctggcccaggtagtgccccttcaggtgtgcaagccaggcacggtgcttagagcttacatacaacgtctatgtgtggtgggcaccaccgacctcatttgacaagggaaggggctgtggctcagagggacggccacaacatcaaggtcaccttgggtgtcagg

SEQ ID NO: 66866 - DNA, 201 bp, Homo sapiens; identical to SEQ ID NO: 49625

SEQ ID NO: 66867 - DNA, 201 bp, Homo sapiens
tctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcc

SEQ ID NO: 66868 - DNA, 201 bp, Homo sapiens; identical to SEQ ID NO: 49626

SEQ ID NO: 66869 - DNA, 201 bp, Homo sapiens
tgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactcta

SEQ ID NO: 66870 - DNA, 201 bp, Homo sapiens; identical to SEQ ID NO: 49627

SEQ ID NO: 66871 - DNA, 201 bp, Homo sapiens; identical to SEQ ID NO: 49628

SEQ ID NO: 66872 - DNA, 201 bp, Homo sapiens; identical to SEQ ID NO: 49632

SEQ ID NO: 66873 - DNA, 201 bp, Homo sapiens; identical to SEQ ID NO: 49631

SEQ ID NO: 66874 - DNA, 201 bp, Homo sapiens; identical to SEQ ID NO: 49633

SEQ ID NO: 66875 - DNA, 201 bp, Homo sapiens; identical to SEQ ID NO: 49634

SEQ ID NO: 66876 - DNA, 201 bp, Homo sapiens; identical to SEQ ID NO: 49635

SEQ ID NO: 66877 - DNA, 201 bp, Homo sapiens; identical to SEQ ID NO: 49637

SEQ ID NO: 66878 - DNA, 201 bp, Homo sapiens; identical to SEQ ID NO: 49638

SEQ ID NO: 66879 - DNA, 201 bp, Homo sapiens; identical to SEQ ID NO: 49639

SEQ ID NO: 66880 - DNA, 201 bp, Homo sapiens; identical to SEQ ID NO: 49640

SEQ ID NO: 66881 - DNA, 201 bp, Homo sapiens; identical to SEQ ID NO: 49641

SEQ ID NO: 66882 - DNA, 201 bp, Homo sapiens; identical to SEQ ID NO: 49642

SEQ ID NO: 66883 - DNA, 201 bp, Homo sapiens; identical to SEQ ID NO: 49643

SEQ ID NO: 66884 - DNA, 201 bp, Homo sapiens
ttgtccttgaaagtgaggctggagccaggcaactcatgcctgtaatcccagcactttgggaggctgaggcgggtggatcactagaggtcaggagttcaagrccagcctggccaacatggtgaaactccgtctctactaaaattacaaaaattagctgggcgtggtggcacacacctgtaatcccaattgcttgggaggctg

SEQ ID NO: 66885 - DNA, 201 bp, Homo sapiens
gtggggcagggtctgtccgagtgcctagaggaagagtaaaccttccagagatgggggacccagaaggaagcgcagagtggggttgggggaaggggataccrgtggtcagaagaaatttattaacagtggatgggataagtctgtgtctggagggatcctggtggaggcagaagggtcctgcctcacctggattctctcact

SEQ ID NO: 66886 - DNA, 201 bp, Homo sapiens; identical to SEQ ID NO: 49650

SEQ ID NO: 66887 - DNA, 201 bp, Homo sapiens; identical to SEQ ID NO: 49655

SEQ ID NO: 66888 - DNA, 201 bp, Homo sapiens; identical to SEQ ID NO: 49658

SEQ ID NO: 66889 - DNA, 201 bp, Homo sapiens; identical to SEQ ID NO: 49662

SEQ ID NO: 66890 - DNA, 201 bp, Homo sapiens; identical to SEQ ID NO: 49664

SEQ ID NO: 66891 - DNA, 201 bp, Homo sapiens; identical to SEQ ID NO: 49663

SEQ ID NO: 66892 - DNA, 201 bp, Homo sapiens; identical to SEQ ID NO: 49665

SEQ ID NO: 66893 - DNA, 201 bp, Homo sapiens; identical to SEQ ID NO: 49667

SEQ ID NO: 66894 - DNA, 201 bp, Homo sapiens; identical to SEQ ID NO: 49666

SEQ ID NO: 66895 - DNA, 201 bp, Homo sapiens; identical to SEQ ID NO: 49668

SEQ ID NO: 66896 - DNA, 201 bp, Homo sapiens; identical to SEQ ID NO: 49669

SEQ ID NO: 66897 - DNA, 201 bp, Homo sapiens; identical to SEQ ID NO: 49670

SEQ ID NO: 66898 - DNA, 201 bp, Homo sapiens; identical to SEQ ID NO: 49671

SEQ ID NO: 66899 - DNA, 201 bp, Homo sapiens; identical to SEQ ID NO: 49672

SEQ ID NO: 66900 - DNA, 201 bp, Homo sapiens; identical to SEQ ID NO: 49673

SEQ ID NO: 66901 - DNA, 201 bp, Homo sapiens; identical to SEQ ID NO: 49674

SEQ ID NO: 66902 - DNA, 201 bp, Homo sapiens
ccaggatccagattccagacccccagcccaagaactcagactttgaaatccatattccagactgcaggtcattaatctccaactcaagatcctcaaatccrgaatccaagacccagatccagaaccagatccggatccagaacccgggatccagaactctgccccaagcccaagaacagggactttaggatccagtttcca

SEQ ID NO: 66903 - DNA, 201 bp, Homo sapiens; identical to SEQ ID NO: 49677

SEQ ID NO: 66904 - DNA, 201 bp, Homo sapiens; identical to SEQ ID NO: 49675

SEQ ID NO: 66905 - DNA, 201 bp, Homo sapiens
gccacttttgtccttgaaagtgaggctggagccaggcaactcatgcctgtaatcccagcactttgggaggctgaggcgggtggatcactagaggtcaggakttcaagaccagcctggccaacatggtgaaactccgtctctactaaaattacaaaaattagctgggcgtggtggcacacacctgtaatcccaattgcttgg

SEQ ID NO: 66906 - DNA, 201 bp, Homo sapiens; identical to SEQ ID NO: 49678

SEQ ID NO: 66907 - DNA, 201 bp, Homo sapiens
ccacttttgtccttgaaagtgaggctggagccaggcaactcatgcctgtaatcccagcactttgggaggctgaggcgggtggatcactagaggtcaggagytcaagaccagcctggccaacatggtgaaactccgtctctactaaaattacaaaaattagctgggcgtggtggcacacacctgtaatcccaattgcttggg

SEQ ID NO: 66908 - DNA, 201 bp, Homo sapiens; identical to SEQ ID NO: 49680
  misc_feature (1)...(201): n = A,T,C or G, or insertion/deletion polymorphism (see Tables 1-2)

SEQ ID NO: 66909 - DNA, 201 bp, Homo sapiens; identical to SEQ ID NO: 49681

SEQ ID NO: 66910 - DNA, 201 bp, Homo sapiens; identical to SEQ ID NO: 49683

SEQ ID NO: 66911 - DNA, 201 bp, Homo sapiens
gccagtctcgtaggggaggcagacaccactgagggtcaggggaggtcagagaaggcctcaaggaggaagcggggctggaagggaatggcgttggatatgcrgtgggaggaatagcctaagcatgaaatggcaggagggaaaatggcagcactggctgcgtctaggacaaggtcatgggagacccagggagaggggctggaa

SEQ ID NO: 66912 - DNA, 201 bp, Homo sapiens; identical to SEQ ID NO: 9320

SEQ ID NO: 66913 - DNA, 201 bp, Homo sapiens; identical to SEQ ID NO: 49685

SEQ ID NO: 66914 - DNA, 201 bp, Homo sapiens; identical to SEQ ID NO: 49686

SEQ ID NO: 66915 - DNA, 201 bp, Homo sapiens
gcgcggcgggagcgccctcagtgtccccgtctgtatcaggggtgcttcatcagtacctgcctaggctggttaggaggaggagcacgtgcgatcgtgacggraagcgctcagcacagacctggcaccgaggaagtcccaggggctcggctcctttccctcgtcaccaccgcgccccaacagagggaggcggctgcaggggtg

SEQ ID NO: 66916 - DNA, 201 bp, Homo sapiens; identical to SEQ ID NO: 49688

SEQ ID NO: 66917 - DNA, 201 bp, Homo sapiens; identical to SEQ ID NO: 49687

SEQ ID NO: 66918 - DNA, 201 bp, Homo sapiens; identical to SEQ ID NO: 49690

SEQ ID NO: 66919 - DNA, 201 bp, Homo sapiens
taacgttctgccacaaatgaccctcactcctgggggcccctgagacccccacgcctccagcctcccctccggctctctctgtgcactcacctacctgcctygcgcctgcctgctgcgcccagctggggcctccaccttcctctggcttggactggccaggtgcagcctcggtgcccagctgttcagcccgtaccctccgcc

SEQ ID NO: 66920 - DNA, 201 bp, Homo sapiens
aagaaattaattgtaacctgatgcctctcttctggagaaattggggggtggactttcattaacgttctgccacaaatgaccctcactcctgggggcccctsagacccccacgcctccagcctcccctccggctctctctgtgcactcacctacctgcctcgcgcctgcctgctgcgcccagctggggcctccaccttcctc

SEQ ID NO: 66921 - DNA, 201 bp, Homo sapiens; identical to SEQ ID NO: 49691

SEQ ID NO: 66922 - DNA, 201 bp, Homo sapiens
ctgtggttctaggctattctaaaatcttaccttccagagtgtcctccactgccagaatgtcttagggcctgtgcttttagaatctgaaagtctgatattcyagaaattccaggggcctgtagttctagaatggctgaatccttcccataaagatgatgactttccacacatggggagagaccacgcttacaacaggtccca

SEQ ID NO: 66923 - DNA, 201 bp, Homo sapiens
ccaagaaattaattgtaacctgatgcctctcttctggagaaattggggggtggactttcattaacgttctgccacaaatgaccctcactcctgggggcccytgagacccccacgcctccagcctcccctccggctctctctgtgcactcacctacctgcctcgcgcctgcctgctgcgcccagctggggcctccaccttcc

SEQ ID NO: 66924 - DNA, 201 bp, Homo sapiens
aggcagaagcataagcctggcccaggtagtgccccttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctg

SEQ ID NO: 66925 - DNA, 201 bp, Homo sapiens
agtcccacacctgccactccctgtctcttacagggtctttgaggggattaaatgtggttgtgtgtgaggcagaagcataagcctggcccaggtagtgcccyttcaggtgtgcaagccaggcacggtgcttagagcttacatacaacgtctatgtgtggtgggcaccaccgacctcatttgacaagggaaggggctgtggct

SEQ ID NO: 66926 - DNA, 201 bp, Homo sapiens
ttgaacccagaaggcagaggttacagtgagcggagatcacgccactccactccaacctgggctacagagccagactccgtctcaaaaaaaaaaaaaaaaaagaaaaaaaaagaaagaaagtgaatttgaagagctggactttatcctggtggtgccaaggatccatggagggtggtgagcaggggaggggcacagccagct

SEQ ID NO: 66927 - DNA, 201 bp, Homo sapiens
gcggggctggaagggaatggcgttggatatgcggtgggaggaatagcctaagcatgaaatggcaggagggaaaatggcagcactggctgcgtctaggacarggtcatgggagacccagggagaggggctggaagggaagaagccacttttgtccttgaaagtgaggctggagccaggcaactcatgcctgtaatcccagca

SEQ ID NO: 66928 - DNA, 201 bp, Homo sapiens
tgtagtctaggccccaggcttctcatagcaggtgcaaaggtttccagcctcgattgccagattccaaacaccagattccaggctcctattgtgggttctarattcgaatgccccgggatccagaatcaaggttcacgatctgtcactcaaaggcccgactccaggatccagattccagacccccagcccaagaactcagac

SEQ ID NO: 66929 - DNA, 201 bp, Homo sapiens
ctgggcgtggtggtggtcgcctgtaatcccagctactcaggaggctgaggcaggagaatctattgagcccaggaagtggaggttgcagtgatctgagatcrcgctattgcactccagcctgggtgacaagagcgaaacttcatctcagaaaaaaaaaaaaaaaaagaatccagaccccacaattcaaaatcccaaatctac

SEQ ID NO: 66930 - DNA, 201 bp, Homo sapiens
gtaatcccagcactttaggaggctgagtcaggtggatcacttgagatgaggagttcgacaccagcctggccaacatggtgaaaccctgtctctactaaaartataaaaattagctgggcgtggtggtggtcgcctgtaatcccagctactcaggaggctgaggcaggagaatctattgagcccaggaagtggaggttgcag

SEQ ID NO: 66931 - DNA, 201 bp, Homo sapiens
acagatttgaaactccagactgtatgttccaaagtctactcctgaaagctcagaggctagatccaccctgtagaatccagaccccaagcctggcatggtgkctcacgcctgtaatcccagcactttaggaggctgagtcaggtggatcacttgagatgaggagttcgacaccagcctggccaacatggtgaaaccctgtct

SEQ ID NO: 66932 - DNA, 201 bp, Homo sapiens
ccgctgaaagtttagaaaacaaagagcaggagagcccagatctgtggaaggtccggccccagtccgcgtcccactcggcagtaaacacgcgaaccacgatmtgctctcgttccgtcgcggactcatttcttaccagacgtttaaggatttgtttatagaaacagcctttctgaattgccccggtgatggggccatacaacc

SEQ ID NO: 66933 - DNA, 201 bp, Homo sapiens
tcgccgtcttgcacaaagaatatccttcaagaagaacgctccaaaagaaaaacagcctattttaaaatgcccgactcctgcgtcggcgaaggccatccctrctgttttgaatttcagaacattaaaaacacaaaactagagaagctatacagttcaactgcataacataacaaaatggattatttctcccgtgtcttctaa

SEQ ID NO: 66934 - DNA, 201 bp, Homo sapiens
aacactctttctactgccatcacactcaaagaggaaactctaatctctcaatacgccagcaaaatacctgcaactgaaccaacaccctgtctttatttctycaccagacaacagctgaaagaacgccctccctgatagggctcagcagcttatttctatcagagttaagtggtctagcaccttcccggctaaaaactgaac

SEQ ID NO: 66935 - DNA, 201 bp, Homo sapiens
ataaacaacactctttctactgccatcacactcaaagaggaaactctaatctctcaatacgccagcaaaatacctgcaactgaaccaacaccctgtctttwtttctccaccagacaacagctgaaagaacgccctccctgatagggctcagcagcttatttctatcagagttaagtggtctagcaccttcccggctaaaaa

SEQ ID NO: 66936 - DNA, 201 bp, Homo sapiens
aaaagaaaccctgtgcccaccagcagtcactccccattccatccgcccccagcccctggcaaccactcatctaccttctgcctctatggatttgtttattytagacatttcacataaaccggatcatacgatatgtggtcttttgtgactgacttctttcactttttgtgatatttttaagcttcatctattcaaccttag

SEQ ID NO: 66937 - DNA, 201 bp, Homo sapiens
tacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctc

SEQ ID NO: 66938 - DNA, 201 bp, Homo sapiens
cctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataa

SEQ ID NO: 66939 - DNA, 201 bp, Homo sapiens
taggtgttcatccctcaccataaaagaaactactttctgttgtggtccagtgaaaacagaagagcaatctatgagtttacaaattcttgtaggctgggggyggtggctcgcacctgtgatcccagccctccgggaggccgaggtgagtggatcgcttgagtccaacctgagcaacatagcaaaacctcgtctgtactaaaa

SEQ ID NO: 66940 - DNA, 201 bp, Homo sapiens
ctttcccagtgtgctcactccatcctcactcataaaagcatctggttccattccacagctgggcacaccttatcttctcaagagacaatgtaagctctttwtaaaacaggggctgcattttacacacctcacatacctcctgcaggtccccgaacatccaaacactccaaatttgtctctgtctccaaatcctacaaaacc

SEQ ID NO: 66941 - DNA, 201 bp, Homo sapiens
ctccaggagggtttaaaagcacactacagacataaatcggtgccaatgaattattcattacatcttatctatagggaacttatggaacaaagtctccatcyacagggatgaggtgatcttgacacaaggccagactcacaaattacccttccaggagttctaattttttttattcacctcaatgtgcaaaaagcctaatca

SEQ ID NO: 66942 - DNA, 201 bp, Homo sapiens
agttcatggaaaagggaagagaaaacctcacatgggtttgtatacccttcatttaagcacactgtcttcaggcagcagaggtttcaaggtgcatgctaaamacccttgcgcaggtttcagagagcagataaaaggggctaaccaggctctcaggaagcccaatccgcacacgcacggagccgagccagtggaaaccataag

SEQ ID NO: 66943 - DNA, 201 bp, Homo sapiens
gcactacacatgaagaattaaagtccagtctactaatttttaaatatttcttaagttctctgcatgaggttggtcttgattcctgcagatccactctggarttaaatgcaaaggaatattgatatataatttcattatacttgatttcagaatttttaatacatacttgtaagacaaaaatttagagctgatttttaaaag

SEQ ID NO: 66944 - DNA, 201 bp, Homo sapiens
ataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattctagacatttcacataaaccg

SEQ ID NO: 66945 - DNA, 201 bp, Homo sapiens
tcagccccagcagcggagacgcggtgcggcccagggtgctgtcgctgctgcctgcgcgccgcagggggatcagcgctgtgtgcggagaggctcgtgcgcayggaaggggcgaggtgcgggtcgcggggcccgggaaccgcggagcccgccccggcaccaacttccctaccgagtcctcgcgcctagccgggaaacacggct

SEQ ID NO: 66946 - DNA, 201 bp, Homo sapiens
ctgtctttatttctccaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaa

SEQ ID NO: 66947 - DNA, 201 bp, Homo sapiens
taatccccaagaatgctacgtggcacagtagctcatgtctatcagcccaactacttgggaggttgaggcaagaggatcacttgagcccaggagttcaaggytacagtgagccatgatcacaccactgcactccagccaggataataaagacctcatttttttaaaaaaaagtaaaataaaataaaaagatgctcccatgtg

SEQ ID NO: 66948 - DNA, 201 bp, Homo sapiens
tgcccggtcagccccagcagcggagacgcggtgcggcccagggtgctgtcgctgctgcctgcgcgccgcagggggatcagcgctgtgtgcggagaggctcktgcgcacggaaggggcgaggtgcgggtcgcggggcccgggaaccgcggagcccgccccggcaccaacttccctaccgagtcctcgcgcctagccgggaaa

SEQ ID NO: 66949 - DNA, 201 bp, Homo sapiens
gggatcctggggggaagctttggtatcatggagtaaaaacatacattaaaacaccccctccctcctgcctgtgttctcaaaaatcgccgtcttgcacaaasaatatccttcaagaagaacgctccaaaagaaaaacagcctattttaaaatgcccgactcctgcgtcggcgaaggccatccctgctgttttgaatttcaga

SEQ ID NO: 66950 - DNA, 201 bp, Homo sapiens
cagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagccc

SEQ ID NO: 66951 - DNA, 201 bp, Homo sapiens
taacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccac

SEQ ID NO: 66952 - DNA, 201 bp, Homo sapiens
agtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaag

SEQ ID NO: 66953 - DNA, 201 bp, Homo sapiens
gtgctgagtaagctgtagttctttcgacttatcgccttcatacttgcctgtccaaacaaaaagatctcaagaattccactgaaatagtccaaacaagagcytaaacttacaaagctgtttttcagagctcaatagtacaacaacaggaagtagaacttctgggatggggattttgctatttattttttctttcaatggcca

SEQ ID NO: 66954 - DNA, 201 bp, Homo sapiens
ccatctctctctctgcctagtatcttgagatctgaaggctggaagggcctgtgaaatgacctaggtccaccctgtaactcaaggtcagcaggtgtgcaagyaccctacccacccaactttctgagatgccaccctggccctctgcaccaggccactccggagaccaccaggcagccgagtccagcctgcagatgcttcctc

SEQ ID NO: 66955 - DNA, 201 bp, Homo sapiens
aaggcgaagcctctagcccttttctacttttaggatgctcagattcttgcctgcagaggtcaatccctttctttcaagggctcccccctctgtaatgaggsagtccatttacaataaaaaaaaaattgagctgtcaaaacaaatgaaaaacttccagtataatcataatcagtgagggaatcaaacatctaaacaaatctc

SEQ ID NO: 66956 - DNA, 201 bp, Homo sapiens
atcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgact

SEQ ID NO: 66957 - DNA, 201 bp, Homo sapiens
gaatggtgtcatgaaacaagactggggggaaaagggagaaggcctgctttctagtcgagaaaagcggagaccgtctgaaactctacttgctccaacaggtsaacgtgattgaaaattcagaattcactctcctaatagcaggaaagtgttacaaaagcccacaggccaaatgataccaccctcccaggaagtctcttgcag

SEQ ID NO: 66958 - DNA, 201 bp, Homo sapiens
tttctagtcgagaaaagcggagaccgtctgaaactctacttgctccaacaggtgaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtgg

SEQ ID NO: 66959 - DNA, 201 bp, Homo sapiens
ggcgcgtgcacgctgcgggtctccgaagctcggggggcgtgtccgggtcccggggcgccgaggagggggtggaggctggggccgggaagcctcccttggcygcggtcccgacccgggaacacgccgcatgcactcgggatcagcggctactgcggaaacccacccgcacctgtctcgggtcctcccaggcacgttcctctt

SEQ ID NO: 66960 - DNA, 201 bp, Homo sapiens
ttgacacaaggccagactcacaaattacccttccaggagttctaattttttttattcacctcaatgtgcaaaaagcctaatcaaacaatgattttaaagawaattttattgctttcaagttccatgcagcagtaactggtgtgataaaatgttttggctagcagaggtgcaatgatcagatgaaaataaatttgttgtaca

SEQ ID NO: 66961 - DNA, 201 bp, Homo sapiens
agaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccct

SEQ ID NO: 66962 - DNA, 201 bp, Homo sapiens
aatgtgcaggaggagaggtttccccaaagcgagactcccctaggactgccatctaatgaataaatgctgcggagaccaggtcctcaaagagggaaacagcycagcagtggcaggagagaggagtttgaaatacgtggacttttacaaacagtgattggaccatgtgtcgcccttaatgtggtccggtttcatgactcaggc

SEQ ID NO: 66963 - DNA, 201 bp, Homo sapiens
tcctcccaggcacgttcctcttgcttcgtttgctacgtaagtgactggaaaccagtaccgaccctaagtctccgcggttgttttcttgaatgtgcaggagsagaggtttccccaaagcgagactcccctaggactgccatctaatgaataaatgctgcggagaccaggtcctcaaagagggaaacagcccagcagtggcag

SEQ ID NO: 66964 - DNA, 201 bp, Homo sapiens
accacccatcaggtttccaggaactaaccactgtaaagggatcctggggggaagctttggtatcatggagtaaaaacatacattaaaacaccccctccctyctgcctgtgttctcaaaaatcgccgtcttgcacaaagaatatccttcaagaagaacgctccaaaagaaaaacagcctattttaaaatgcccgactcctgc

SEQ ID NO: 66965 - DNA, 201 bp, Homo sapiens
ttttggagctttaaatttattaaagtcctgtaaaattatcttaaaactctaactgtaaaagacacactaggtgttaacagctctgccatggagttgcagtrcgcctgtctgcatcacttaggaagaccctaattctctcaggacagctcgcactgacacagtagagtaaccttaatccaaaactgtagcccagtgatttct

SEQ ID NO: 66966 - DNA, 201 bp, Homo sapiens
gtctatctgtcccccaatcctgactccatcgagagaccagagcagcctccccagaacacccttctcagcgggtccactgcaatggtgcaaaggtttcagcrctcctcattctctagccagcagtcaattccttcccaccacacaaacaccggattctgacaccctctccactccatcagtgcacactgccacccacaccac

SEQ ID NO: 66967 - DNA, 201 bp, Homo sapiens
tctgagatgccaccctggccctctgcaccaggccactccggagaccaccaggcagccgagtccagcctgcagatgcttcctcctcaggaacccagctccargagggtttaaaagcacactacagacataaatcggtgccaatgaattattcattacatcttatctatagggaacttatggaacaaagtctccatccacagg

SEQ ID NO: 66968 - DNA, 201 bp, Homo sapiens
aaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggag

SEQ ID NO: 66969 - DNA, 201 bp, Homo sapiens
gtaagctttcttctgtccagaggtcgggagctggcctcaccgtcgccctaccaggacactgtcaaaggccttcaccagcaaccaaaaccggcagggttggrgagggtgcttcaatgatagagagacctgtaagaccttgctactgtccctcccaggagtgaggcaaaagcttactggcctcaccaagaaaacaatgcaaaa

SEQ ID NO: 66970 - DNA, 201 bp, Homo sapiens
agctgtttttcagagctcaatagtacaacaacaggaagtagaacttctgggatggggattttgctatttattttttctttcaatggccacttttaagcaaragagaaaaaagtctacaggcattacaaatcctggaagctatgaatcaggaagtgggaaatggctgatcctgaaatggccagcctgaaaatcctggctctt

SEQ ID NO: 66971 - DNA, 201 bp, Homo sapiens
aatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgcaa

SEQ ID NO: 66972 - DNA, 201 bp, Homo sapiens
aaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgca

SEQ ID NO: 66973 - DNA, 201 bp, Homo sapiens
aaatgtaatgtatatcatatacatcaagtgcaaacgtgagaaacagcacaacaattgacaagtatcaagtaatacagtatattgtgatgtattcgcagaarggaatgttagcagcaaaagtgaataaactacagccccacacaacatgggcagatctttgaaacacactgagtaaaaatatacaaatatcaaaaacgcaca

SEQ ID NO: 66974 - DNA, 201 bp, Homo sapiens
caactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctatacca

SEQ ID NO: 66975 - DNA, 201 bp, Homo sapiens
gtgattctcccacctcagcctcccgagtagctgggactacaggcgcacaccaccacacgcggctaatttttgtattgtatttttcgtagagacggggtttygccgtgctcgccaggctggtctcaaactcccgaccacaggtgatccgcccgcctcggcctcccaaagtgctgggattacaggcgtgagccatggcaccca

SEQ ID NO: 66976 - DNA, 201 bp, Homo sapiens
atgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtgaacgtgattga

SEQ ID NO: 66977 - DNA, 201 bp, Homo sapiens
aaatgctgcggagaccaggtcctcaaagagggaaacagcccagcagtggcaggagagaggagtttgaaatacgtggacttttacaaacagtgattggaccrtgtgtcgcccttaatgtggtccggtttcatgactcaggctaattgatgccagtaataaatttttttaagatagctaataaaagagttgtgaattgtcgag

SEQ ID NO: 66978 - DNA, 201 bp, Homo sapiens
caaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgc

SEQ ID NO: 66979 - DNA, 201 bp, Homo sapiens
gcaaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatg

SEQ ID NO: 66980 - DNA, 201 bp, Homo sapiens
agtcttgctctgtcactcaggctggagtgcaatggcgccatcttgtctcgctgcaacctctgcctcccaggttcaagtgattctcccacctcagcctcccragtagctgggactacaggcgcacaccaccacacgcggctaatttttgtattgtatttttcgtagagacggggttttgccgtgctcgccaggctggtctca

SEQ ID NO: 66981 - DNA, 201 bp, Homo sapiens
ttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtggg

SEQ ID NO: 66982 - DNA, 201 bp, Homo sapiens
ggggtgggcggggagtgcggggctgggagaggttcattgaaaacaacaacagcgcggctggaaagcgcgtttccccggttcttgaaaagcttcattgtttmttgcagctgttgcaaaataaataaatgcgtgcatgcggcatttttttcgctgcgtactggaaagcccgaacgtggcggaaggggcgcacctgggagaaag

SEQ ID NO: 66983 - DNA, 201 bp, Homo sapiens
caaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtatta

SEQ ID NO: 66984 - DNA, 201 bp, Homo sapiens
ttaatactttgagtcaaataaaaccaaagcaatttaacaaaagaaaacatcatgccgaggaagtatgcttctcttgagataacaatctaacttgttttaaagatcctttgtttactaaccattttatattccaaatatatgttccttcctcagaacaaatcaattcttttccagaccctcggggatgggggtgcaggcatg

SEQ ID NO: 66985 - DNA, 201 bp, Homo sapiens
gatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgt

SEQ ID NO: 66986 - DNA, 201 bp, Homo sapiens
ttgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggc

SEQ ID NO: 66987 - DNA, 201 bp, Homo sapiens
gggtgaaattacagctaactcttaaaggagcttgccagagggcaagctggtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaa

SEQ ID NO: 66988 - DNA, 201 bp, Homo sapiens
ggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaagagacacgaatgagtacagcctgaactgttcaaaatgtctgggaggaagg

SEQ ID NO: 66989 - DNA, 201 bp, Homo sapiens
ttaaataataaaataatatttttcctttgttttgcttttgttttagcaaaagaattaatgaaggatgtgaattcctttggagaggatgagaagcccatagscacatgggtttccattgtaatttggaaatgagttcactcttggattgagtgacggatttacaaatttccattttataagtatgcttaataactaacacat

SEQ ID NO: 66990 - DNA, 201 bp, Homo sapiens
gagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctc

SEQ ID NO: 66991 - DNA, 201 bp, Homo sapiens
tatccttagcaacaatagtatcagctaactcctagtgtttataaaccctaggttctaagaaatgtgtatgtattcactcatgaagtattggtaacgatccyccaagatgggtgacactttttttttttttttttgacatggagtctcactctcgcccaggctggagtgcagtggcgcgatcttggctcactgcaacctcca

SEQ ID NO: 66992 - DNA, 201 bp, Homo sapiens
tggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggg

SEQ ID NO: 66993 - DNA, 201 bp, Homo sapiens
gcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttta

SEQ ID NO: 66994 - DNA, 201 bp, Homo sapiens
ggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtattttttttttt

SEQ ID NO: 66995 - DNA, 201 bp, Homo sapiens
gcggcccagggctcggcggagtcgggaacccgaggcgcgccggggcggactgtcggcgtcgtcggcctccattttcaaacccggagaggcaggaagggggraaaactgcaaagaaagggggcaaagcccaaatctgcctaggcgaggaaaaacaagcccggccctggccgcgcgggaggcggccggacgcccgagcttccg

SEQ ID NO: 66996 - DNA, 201 bp, Homo sapiens
ccgaggagcccgaggggcaaaagcacgttgggcgacgggaggcagcgacgggcgcttggagacgtgtcctggggcttcggggcctctccgcagggcacctsccccctcgagggcaactcgcaccccgcgggccgggcggctgcccgctccccactgcccggtcagccccagcagcggagacgcggtgcggcccagggtgct

SEQ ID NO: 66997 - DNA, 201 bp, Homo sapiens
gtggcgctccccggaagagacaagctgaggaagactcccggcctcgcacttcccggggggctgcccagagagcgcttcccctcaccccaccgcccagcccygggacgccgggggcaggtaacccaacgaggagcgggccaaagtgacgggcaaggccaggaacccgaggagcccgaggggcaaaagcacgttgggcgacgg

SEQ ID NO: 66998 - DNA, 201 bp, Homo sapiens
tgtgaccttaaataagccatgcatgctttctgaatccttttttcttatttggtgagtgacgtgctagttaaaatggtgtctccagccctttcccgtcctcrctgctgtgattcaagccccctccttctctgtggggcttcctccgacctctcgatttcactgtcacctttctctcttcctctctctcctgcttcctccctg

SEQ ID NO: 66999 - DNA, 201 bp, Homo sapiens
tctcatctgtgaggtgaaagtgtcatcacgtcattgacataaagtataagtacagggaacataatcatctgggagattttaatttgagttaataagagatragattttcaggctaaaagtcttggggctggacaaagaatatttaaaaggagggttggtggataaagaaactgtggtatatttatacgatggaagactact

SEQ ID NO: 67000 - DNA, 201 bp, Homo sapiens
tacatcatgaggagggagtggagaaagtggaattcttatgtaaattcatacagctttggaaaatggtttagcagtacctactaaagctgagcatatgcaaaccagtgacccaggaatgtcatgggtacataacctacaaaaatgtagacagatgcgctaaaagacatgtacaacatgttcactgcagcccagttcatcatc

SEQ ID NO: 67001 - DNA, 201 bp, Homo sapiens
acaacatccatcatatatctacaaaattgggatttttttatcgtaaaatttcatctaaaacaaaaaattcacatctgttcttggtatccattaggtgtagyggacacctctagatattcttgatgccagcatcctgtagacccgccatctcctttcccaggccatggggtgtttctgttttctattagacactgtctctta

SEQ ID NO: 67002 - DNA, 201 bp, Homo sapiens
acagcccagggaacaaggcagtcctgtggcgctctccttgcagaaatgaccggagtctcccaatccagccagcccgtggacctctcttcatgcccacgggrgagtgcacacgcctgtagcattcaacagtcactctcccattgataacggtggctctcgaaaatccaataccacaaagatactttattgcacaaactttgc

SEQ ID NO: 67003 - DNA, 201 bp, Homo sapiens
tttcacaagagactggtatttgaacttcggaagtcctctttccagatggccggggtacctagcaggagggggtgggaaaccactccaataaatgttatgcrttggttcaagaaaccagctgttcaacctgcaagagaaaaatgtgttaacggagtaatacatacatagtagtttagatttttttcttctaattgctttact

SEQ ID NO: 67004 - DNA, 201 bp, Homo sapiens
gtcattgacataaagtataagtacagggaacataatcatctgggagattttaatttgagttaataagagataagattttcaggctaaaagtcttggggctkgacaaagaatatttaaaaggagggttggtggataaagaaactgtggtatatttatacgatggaagactacttggccataaaaaggaatgaattaacagca

SEQ ID NO: 67005 - DNA, 201 bp, Homo sapiens
ctataaagaagatttttaaaaaagcccaggtgcggtggctcacgcctgtaatctcagcactttgggaggccaaggtgggtggatcatgaggtcaagagatygagaccatcttggccaacatggtgaaaccccatctctactaaaaatacaaaagttagctgggtgtggcagcgcgtgcctatagtcccagctactcaggag

SEQ ID NO: 67006 - DNA, 201 bp, Homo sapiens
ttcttaaaagaattcagcaggcttgaggtgtgctctcaaagggcaactggaacgtcaaggacttggacaccaggcacagatggttcatttcccatggacargaagagggcacggagtgctccctcttccctccaccttctccagcctagtccccctcagcctgtgccactcctgaatcatcttttatagcaccacgtccag

SEQ ID NO: 67007 - DNA, 201 bp, Homo sapiens
acttccccttcaggtctcagttgagccgtcactgacagctctgcgacaccccaaatctagctgtgcacataataccaagtgtgtcccctactgaaacactwacacaatcattctgcacatatttgttcacaacttggtatgtgtcaggccctgttagagtggctggggacacatgtagggacaaaatgccagccctcatgg

SEQ ID NO: 67008 - DNA, 201 bp, Homo sapiens
ttgtttcttggtcacagttgatccctcaactcaagcatctcaccctcaaaatgtttgtttgggacccaagaggcaaaccttgagatgggttatttctttcrccttggattggctcatctgctgggagtggagccaagctgacatttcctttcctttttgtctgcctatcactacgtagaggcagcacataagagagggaaa

SEQ ID NO: 67009 - DNA, 201 bp, Homo sapiens
gcggtttaaagcaaatgcttgatggttagactaatctggatggtccaactaacctgactctaccactgactggttataagacctggacaaggggctctacyccttgagcctcagtttcctcatctgaaaaactggaataataataatatctaatttataaaggcttttggaggttaaatgaagcagtaatgcctcttacat

SEQ ID NO: 67010 - DNA, 201 bp, Homo sapiens
caatttccactagaaaatagaaaaggtgtaggtcagaaagaatgtttgtggggtgttccttttttactttaaacatgaaaacccatgtcagaagagttttytcttgagaagaacactgttaattgttgcaattttcaaaagttgatgaaaatggggcccagtggcctctgttgttgcaaccagggcagttgtggttgaaga

SEQ ID NO: 67011 - DNA, 201 bp, Homo sapiens
ctaccctaaataaagacatgagtgatgtataaagtctagtgtcaatttattcagaaaatatcaaaattattctgggagctatgggtcaaagttgataggcmcaaacaaacaaaaacgaaaggtattttaaattcacagcttggataagtaaaagggagatgttgtcatttctcttcttcaatccaactttagattttcaag

SEQ ID NO: 67012 - DNA, 201 bp, Homo sapiens
tgctgtgattcaagccccctccttctctgtggggcttcctccgacctctcgatttcactgtcacctttctctcttcctctctctcctgcttcctccctgtscacccccatctctgtccccccagggccgagtttgttttatatctcttttggtatctcctctggttttctggcaccatgtcttacgtagagcaaataataa

SEQ ID NO: 67013 - DNA, 201 bp, Homo sapiens
ggctgaggcgggtggatcgcttgaggctgggagtttgagaccagcctggccaacatggcaaaatcgtgtctctcctaaaaatacaaaaattagctgggtgwtgtggcacgtgccagtaatcccagctactcagaaggctgaggcaggagaatcgtttgaacctgggaggaggaggttgcagtgagctgagatctcaccact

SEQ ID NO: 67014 - DNA, 201 bp, Homo sapiens
ataggtaggtccactttggaaaagttcatctagctgtgtatttgtgacttgcagtcttttctgcatgtgtcaattccagtaaaaagattacttgaaaatcragtataatattattgtatttacaaagccctttctacgtagccagaaacagggttggtttcccaggtgactgagaggtcgtcaggagcttagtgagtggag

SEQ ID NO: 67015 - DNA, 201 bp, Homo sapiens
cactttattctcaacaactactcatttctgaatcataaggttcctcatggaggtggagataaccctacctaccgggacattctgtttatgttttagggacwgtcctttccatggcttccctagtccctcaggtgctgtgtgagttgtatttcctccattaattctacactagaaaaaggtgtatatgctcaagctgggata

SEQ ID NO: 67016 - DNA, 201 bp, Homo sapiens
gggaaggagcaccaggatggctcatggtgctatttttatgacttgatgtaggggataggtaataggtaggtccactttggaaaagttcatctagctgtgtrtttgtgacttgcagtcttttctgcatgtgtcaattccagtaaaaagattacttgaaaatcaagtataatattattgtatttacaaagccctttctacgta

SEQ ID NO: 67017 - DNA, 201 bp, Homo sapiens
gcgctcttgcgcccgcttggttccatttcctactccgcctgctcacccggcagccctcaccccttcccggaggctctccgaggggcctgggtagcccttcycgccacgggtctcggcccctccagcccgctccctcccggcggcggcgcggggcgcggggccctacctggagcgagcacggcgccgctgctgcccggtggc

SEQ ID NO: 67018 - DNA, 201 bp, Homo sapiens
gctaaaagacatgtacaacatgttcactgcagcccagttcatcatcaccccaaagtggaaacatctcaagcgtccaccagctggaggctgcacaataaaastgtggtactttcgtcggtagaaacatgccacagcttgaacacacgctgaaaacataacgtcaagtgaaagaagccaggtcccaaaaaaagacatactgta

SEQ ID NO: 67019 - DNA, 201 bp, Homo sapiens
aattcttcccggtgcgctcttgcgcccgcttggttccatttcctactccgcctgctcacccggcagccctcaccccttcccggaggctctccgaggggccygggtagcccttctcgccacgggtctcggcccctccagcccgctccctcccggcggcggcgcggggcgcggggccctacctggagcgagcacggcgccgct

SEQ ID NO: 67020 - DNA, 201 bp, Homo sapiens
aagggagaagaaaggaggaagcgcccccaggccggcggcccccacccggctaaggtcgccagcatcccgcatcccgtgcgacctgcgtcccagaaacccascggggaaattcttcccggtgcgctcttgcgcccgcttggttccatttcctactccgcctgctcacccggcagccctcaccccttcccggaggctctccga

SEQ ID NO: 67021 - DNA, 201 bp, Homo sapiens
caggaggaagggactaacaagagccttctgcggtaagcacctgcatcaaacaatggcactgatctcagagggattttaaacagctgtgcataaacttcaamagtaatttgcaaccatattagtaaatgtcactcttcttcccgctagacacagcacttttaaaagagattaagcatccgcagtaagcctgccattttacaa

SEQ ID NO: 67022 - DNA, 201 bp, Homo sapiens
aataatcgaacaccatccccttgttgcctgaaggagaagtgagacagcaaaacaaatcaaatttccaggagctgcaccgtgtatggtgagcgaagacgcartgaggacatgtctgtaggagaacagaggtagaagttagctcctcaagtaacagttgccatcccgaggcaccacagcacaagacagtagcggaaatgaaca

SEQ ID NO: 67023 - DNA, 201 bp, Homo sapiens
ctctttcaggttctgccctgatgtttcctggaataatgctgaggactgcctttcgggtagccgccctattcagttcacttcatctcggaaatacctgaccyctgccttggatccagcggccctcctgagagctgaggaaggaggaaatcctatgtgtctgctcccggagctgccacaacccatcttcccacaactcggaac

SEQ ID NO: 67024 - DNA, 201 bp, Homo sapiens
ttgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagttt

SEQ ID NO: 67025 - DNA, 201 bp, Homo sapiens
ccctaactttcagctgtgtacttcttttcctctttcaggttctgccctgatgtttcctggaataatgctgaggactgcctttcgggtagccgccctattcmgttcacttcatctcggaaatacctgacccctgccttggatccagcggccctcctgagagctgaggaaggaggaaatcctatgtgtctgctcccggagctg

SEQ ID NO: 67026 - DNA, 201 bp, Homo sapiens
ctgtgtcttcaagcagtctctctcttctcttttaattcaaattctgggaagcctaaagaaaatgtcttttcaggcagtccttctcatacccaagtagctcyaagaatcccttttcagatcccatcttgaagcaaattagcttgttcaaatagcatttcctctgtagcaattaccttcacagttattttcagctactggttc

SEQ ID NO: 67027 - DNA, 201 bp, Homo sapiens
ggacaggaagagggcacggagtgctccctcttccctccaccttctccagcctagtccccctcagcctgtgccactcctgaatcatcttttatagcaccacrtccagcccgcacaggggcaggacagcccagggaacaaggcagtcctgtggcgctctccttgcagaaatgaccggagtctcccaatccagccagcccgtgg

SEQ ID NO: 67028 - DNA, 201 bp, Homo sapiens
aataccggtgatctgaggcagaccctctgtgacggataacaggtgagtctcttgcatgtttttgcatcatgtactgattacccagacaaaactgagttggyacagctgctaaatccaggatcaagtgctgggatagtagtcattcaaggaggaggtgtcctgaggggctcatccctcagtagccagctgtgcccagagcag

SEQ ID NO: 67029 - DNA, 201 bp, Homo sapiens
ctattcagttcacttcatctcggaaatacctgacccctgccttggatccagcggccctcctgagagctgaggaaggaggaaatcctatgtgtctgctcccrgagctgccacaacccatcttcccacaactcggaacttggaaaaaggaacccaggacacgactttgcttttcttttggacctagttggtgattatactctg

SEQ ID NO: 67030 - DNA, 201 bp, Homo sapiens
tctttggcaaaagaaaaggtcaaagaggccggagttgacagaaagcatgggcggacttctcagatcttgtaggtggttcttaaaagaattcagcaggcttraggtgtgctctcaaagggcaactggaacgtcaaggacttggacaccaggcacagatggttcatttcccatggacaggaagagggcacggagtgctccctc

SEQ ID NO: 67031 - DNA, 201 bp, Homo sapiens
tataaacagtccccatctggaggataacgtatatggttcacctgcttacaggtcctatgtgatctggcacagctgactcctccagctccacccagcaatascccacacactggcacatgctcctttctcgcagcatcactgctatcagagatcacaattttcttcactttgcaaatggagagaatgacactccaagaagtt

SEQ ID NO: 67032 - DNA, 201 bp, Homo sapiens
ctttcactctataaacagtccccatctggaggataacgtatatggttcacctgcttacaggtcctatgtgatctggcacagctgactcctccagctccacycagcaatagcccacacactggcacatgctcctttctcgcagcatcactgctatcagagatcacaattttcttcactttgcaaatggagagaatgacactc

SEQ ID NO: 67033 - DNA, 201 bp, Homo sapiens
aacaaaagacagcgttgctgagaatgtggaataattgggaccctttctaccactggtgggaatgtaaaacggtccagccactgtggaaaacaatatggcakttcctcaaaaaattaaacatagaattaccctacgaccccacaattctactgctgggtacataccccaaagaattgaaagcaggacctcaaacagatatct

SEQ ID NO: 67034 - DNA, 201 bp, Homo sapiens
tgcctgattatgaagtaataaatattcaccataaatattttgaaaaatataaaactgtctataaaagaaatttgaaatgattgctaatctcaaaatataaagatacctgtcagtactttggcattttatcctccttgtggctgaggtcacatatcttgagactgaagcacaaaatttctataccatacagtttatagttta

SEQ ID NO: 67035 - DNA, 201 bp, Homo sapiens
aatcactcaggtctgcactaggaagcgagttatgatgatgcccctaatctatatgaacccaaataaagccaaaacacacacaccttttaaggataaaactrtattccattaaaattagccccgcatttgtcaatatctaacagcattggactgaccctcaggccagaggctgtagctcttggaagatcctagccaggaggt

SEQ ID NO: 67036 - DNA, 201 bp, Homo sapiens
cttgtgattgcatttggatagaatgaagacctctcctacagttctcaacttaaattctttcttttatttcttagctacgaaagaaaattcaaaaaattcartgctctactttgtaactccctggacatagtgagtccattatgtacatcatgaggagggagtggagaaagtggaattcttatgtaaattcatacagctttg

SEQ ID NO: 67037 - DNA, 201 bp, Homo sapiens
caaaggctaaaagaaagggtcatattccacatgtagattttgagaaatatttgttatttttcttatgataaaggttatgcatacacactcacacacacacwcacacacacacacacacacacacaactagaaattacagaaaagaaaaaagattagccagaatgtcaccacctaaagacagataatattttggtgttttca

SEQ ID NO: 67038 - DNA, 201 bp, Homo sapiens
ccacctgctgcaaaggctaaaagaaagggtcatattccacatgtagattttgagaaatatttgttatttttcttatgataaaggttatgcatacacactcwcacacacacacacacacacacacacacacacacaactagaaattacagaaaagaaaaaagattagccagaatgtcaccacctaaagacagataatatttt

SEQ ID NO: 67039 - DNA, 201 bp, Homo sapiens
tatgtacacattacagatgagaacttgaggctcggagaaagtaaataacttacacaagatcacaaagcaagtgactgccagagccaggatcagaacccagwcaggcttcattaggagctctgctgaactctgtctagagaattctcaccacctgctgcaaaggctaaaagaaagggtcatattccacatgtagattttgag

SEQ ID NO: 67040 - DNA, 201 bp, Homo sapiens
tggtttttacttgatttgctgatgttttattttttagaaaattgcagatgtgatttttaggcagctgattggaatgttctggttgctctgaataggactarctactttgttttttactgaaggacaaatattattcctacacacataaaaaacctcaaagaatgagtaatgatactgtttaaatctgcccttataactcca

SEQ ID NO: 67041 - DNA, 201 bp, Homo sapiens
ttattgttgaaagggatctttgagattacagaaggagctgaggtgtgaataatcgaacaccatccccttgttgcctgaaggagaagtgagacagcaaaacwaatcaaatttccaggagctgcaccgtgtatggtgagcgaagacgcaatgaggacatgtctgtaggagaacagaggtagaagttagctcctcaagtaacag

SEQ ID NO: 67042 - DNA, 201 bp, Homo sapiens
ttctcaaagtgttgattttaaaattagtaaaaggagggtatattcatatcacatcctggcatttttataggcaagattgagcagctataacctctaaagtrctttgatccctataagcctcaagaagagaatggtgcaatttgaattaataactacccattatagagcatttgtatcacagtattttccaaatactatctt

SEQ ID NO: 67043 - DNA, 201 bp, Homo sapiens
agggggcttctgatgcctggcgttaacaagagacagagagtattattgttgaaagggatctttgagattacagaaggagctgaggtgtgaataatcgaacrccatccccttgttgcctgaaggagaagtgagacagcaaaacaaatcaaatttccaggagctgcaccgtgtatggtgagcgaagacgcaatgaggacatgt

SEQ ID NO: 67044 - DNA, 201 bp, Homo sapiens
catctgtatttctattagcttccgtttctatttttaatatttgtataatattaaaagtaattttaaaaatgaactaatctttttacatctcttatgagaayttaatggagatatgatgtttgaagatcaaagatacgtggtatttgaaatcagaaaatgtgtttgcttttctacacagattacaaatatcatgcattattt

SEQ ID NO: 67045 - DNA, 201 bp, Homo sapiens
tgaccagtgacaagccggctatgtaagggggcttctgatgcctggcgttaacaagagacagagagtattattgttgaaagggatctttgagattacagaargagctgaggtgtgaataatcgaacaccatccccttgttgcctgaaggagaagtgagacagcaaaacaaatcaaatttccaggagctgcaccgtgtatggt

SEQ ID NO: 67046 - DNA, 201 bp, Homo sapiens
tcagcgatgggggatgtactgctatttgcttctagtggtactcactgctcatttcctatattcactggtataaaaaaatttcaaacaccctcaaaaaagcmtatactggtggtaccaggaaaacgctgaaaatcattactttctgtgtggtgtccagctcttttggttacatcatcacttcgaccattcacttttaaagaa

SEQ ID NO: 67047 - DNA, 201 bp, Homo sapiens
tcctttgtccatagcctggctttattctgccattaacacacacacacacacacacacacacacacacacaaattgggaagaggatttctcattttacagaragtatgctgggctacacaggatattctatcaggtttcttccagctataaaattctgagactaaatatcaaattaaagaaagtactaattgtcagcgatgg

SEQ ID NO: 67048 - DNA, 201 bp, Homo sapiens
aaaacatctaattcattgcagagaagaatttagtcttttccacggaagagacagcatgtgttagaatgagaatactttatagaaatgaccagtgacaagcyggctatgtaagggggcttctgatgcctggcgttaacaagagacagagagtattattgttgaaagggatctttgagattacagaaggagctgaggtgtgaa

SEQ ID NO: 67049 - DNA, 201 bp, Homo sapiens
tttctaaagatccacagacacagttctcctggatttgggaagcctagagatattagcacaataattaaggcccaagtgagtataaaattttatctgaaatygaagagatattgattagataatccacagagactactttttagtgattatcttccaccagggtaaaagcaacagcagcctgaaaatgcaaaagaccataca

SEQ ID NO: 67050 - DNA, 201 bp, Homo sapiens
cgaaaccagtgaaaggtgaatggaaaccttaccctaggttaaggtttaaaaaatgttcataatatatatttgaaagttccattatttaaaatattcattaracatgctttgtaatgttaagttacttcaaaaaatcttacacaagggaagggaagtatgtattattccttcatttaagagaaagataatgtgtgaatatta

SEQ ID NO: 67051 - DNA, 201 bp, Homo sapiens
agaaacttggcttgtttagaagcctgagcaatggcacccccgtccgtgctccaatacattcccagaaaaggggttatgctcccctgtggacaggataccayctccagaaaacatgtttcctcacgcatttttttttttttttttaccaagaatacaaaaactttccaccttcttccctccccgcaggccccctttcgttca

SEQ ID NO: 67052 - DNA, 201 bp, Homo sapiens
tcagcaactctaagacatcaatcaaatgcattaaaaacaggaagtactaactctaattcctaatttccagaaaggcaaatataccataattaaataacackttataaggagatttgtctgtgtaggtctacttctgaatccccgaagttacatacttgtaccacaagcccatactcttgaaagaaaattctggacccagtc

SEQ ID NO: 67053 - DNA, 201 bp, Homo sapiens
tgaaaaaaattaaagactgaactccataaaaaggaaatcacctgaaatcaaatataaccttgttaacaaaccagcacattagcaacatttttaggggcaamaacataatcagcaactctaagacatcaatcaaatgcattaaaaacaggaagtactaactctaattcctaatttccagaaaggcaaatataccataattaa

SEQ ID NO: 67054 - DNA, 201 bp, Homo sapiens
aaatcgcaggtcactgaaacaaaggctgatggtgcccagcaggttactcttgaaatcagaaacagaagttcatgagaggcaagaagacagaaacaacaacwgaaaaacttagagtggatcgctaacttgcaggagctgtgcagctttggctttgcaggttttagaagctctccctacgccacgtctttaaatatatgtatg

SEQ ID NO: 67055 - DNA, 201 bp, Homo sapiens
cctcaaaaaattaaacatagaattaccctacgaccccacaattctactgctgggtacataccccaaagaattgaaagcaggacctcaaacagatatctgcrtgttcctcttcacggcagcattattcacaataatcaaaagatagaagcaaccatcaacagatacaaggataagcaaaatgtggtatatccataaatggaa

SEQ ID NO: 67056 - DNA, 201 bp, Homo sapiens
ccaccatctttatcttcatccacagcatgtcctagacattcagtgcctgggccagtctctatagtaaacttgggctgatctggaaacgtctccacttagcwctgtaaggatggcacccttcagggtgcttcagaggaaacttactgaattcaacccaagtgtcctgaaagaaattgaagaagttactcaaagagctgaact

SEQ ID NO: 67057 - DNA, 201 bp, Homo sapiens
ctccacttagctctgtaaggatggcacccttcagggtgcttcagaggaaacttactgaattcaacccaagtgtcctgaaagaaattgaagaagttactcaragagctgaactttaaaacaaggagtagctgagggtgaggcatatcctatcttgagtttctgagcactctggtaccatggaatgtctgtacactgaccttc

SEQ ID NO: 67058 - DNA, 201 bp, Homo sapiens
tgagggtgaggcatatcctatcttgagtttctgagcactctggtaccatggaatgtctgtacactgaccttcgccaaagccaagaaagccctggtaggagkcacagcagccatgggtgagctgaaaggcttttcctgacttcctggggtctcaggaatagccagaggtgaaaagatttgccttttttactacataattgca

SEQ ID NO: 67059 - DNA, 201 bp, Homo sapiens
aatgccccaaaacctaaaaaagcccccccagcaaccaaacatcttctgtaaatatagtttttaaatgatgagtaaggtactgtgccattggcccccatttrgttatgtgcatcatgttagtcagcagtagccattccacgaattcctcatgggtagtgcaaccagttaaaaagtgtataaaacattatacatagaaaaact

SEQ ID NO: 67060 - DNA, 201 bp, Homo sapiens
cttcaggcttaaacagccaaatatacagctgaaactcaactactgcaaaaagcagctcaggtggggtataaacacaggcaggctcttttctgactttgtcraatcacatttttgcaggtgaatgtcctgaaaacaggcctagtaactgataacttaccgacacataggacctcctgaggctcaaatgagctgtgaaaacat

SEQ ID NO: 67061 - DNA, 201 bp, Homo sapiens
aaaaaagagactgcgacacccacatgccctggttattcttttttttttttttttttgaaacggagccttgctctgtcgcccaggctggagtgcagtggtgygatctcggctcattgcgaactctgcctcctgggttcatgccattctcctgcctcagcctcctaagtagctgggactacaggcacccgccaccatgcctgg

SEQ ID NO: 67062 - DNA, 201 bp, Homo sapiens
aatcagtggaatacataagcaaatttacgtttttaaagatcagaccagtaggatgcggcggcttacgcctgtaaccacagcactttgggagggtaaggcargcggatcacctgaggtcaggagtttgagactagcctggccaacatggtgaaacgccatctctactacaaatacaaaaattagctgggcatggtggaggac

SEQ ID NO: 67063 - DNA, 201 bp, Homo sapiens
atagtgaggatattgacatgtgtgaataagcataaaatcaatagctaaaataacaatatgaaaatatatgctaagacattttcaaaggtggcaaagtggtwaaaaggaaagagtagctttgatgaagccttaatgatgtagtagaaatcacagaacggagaatacaaactttactggggcaggattgggaattcctgctgt

SEQ ID NO: 67064 - DNA, 201 bp, Homo sapiens
caccatccagagtgtagtgcatgggactgaattccatgaggcacgaagggggtgatcccatcctcagggtagtccatcatcttcaaggcttaatgccactygctggggagacaaaccaaagaattcatcattagatccataagagttactatttatttagtattgacaaatcacagacttacgttactttaacaggtatta

SEQ ID NO: 67065 - DNA, 201 bp, Homo sapiens
tgctgtctaaaatgccttcttgactcttcttcgtctcctaaccaattcctcacatcccctcctcccatcattttatgtaggaagcctcctctgaccctcargcttggttaggtgcacccttctctgctgcgagcctcctctgtttctttttaccacaacacctaatgtgctgttttatcactgcttacaaatctatctccc

SEQ ID NO: 67066 - DNA, 201 bp, Homo sapiens
cctctctccctcacccctgctttccagtcattaggtagatgctagactcctgtctgccaaaaatggctgaccatgggaaggtgagcccactaacccctgarccagtctattccattgtggacaacagatttaaattctttcctatattaatgtgaaatttgtttgtttatatcttctgacattccctgattccatctcaga

SEQ ID NO: 67067 - DNA, 201 bp, Homo sapiens
atcttcatgcatttcgggaaaaggaattatttactctgaaacatttaatgctaactcatttatattttgtgaaacgatgagtgtatggctggagttcgggkggtagggtggagaggcttgcattcctgtgccatttccccattcccaccagtgcccaactggacagtgattagtatcccctctccagactcaacgtcttca

SEQ ID NO: 67068 - DNA, 201 bp, Homo sapiens
ggggagggagttgaagtgttttttttttttttttacttatgttgatggatagccacaaagcataatcatcttatttacaaaaaacaaatgccccaaaaccyaaaaaagcccccccagcaaccaaacatcttctgtaaatatagtttttaaatgatgagtaaggtactgtgccattggcccccatttggttatgtgcatcat

SEQ ID NO: 67069 - DNA, 201 bp, Homo sapiens
ctgaaaggcttttcctgacttcctggggtctcaggaatagccagaggtgaaaagatttgccttttttactacataattgcacaaaccatggtatctatttyctgatccagatttccaaaggcttttctgaaaactacaagatataccccttgtggactgtgtgaaaataaatttatctttatgtatttgaacagtagccat

SEQ ID NO: 67070 - DNA, 201 bp, Homo sapiens
aataaatcacactggctttcaggatggaaaaatggatggtatggaacaagaggaaaaacaaggaaatctattagaagtctggattaggatggtagcagtcaagagtgaaaataccttttctgttaattcagttcaatatgacagtggcttttattttttagttaccaaaatggtgctcagaatgaatatatacattaatgt

SEQ ID NO: 67071 - DNA, 201 bp, Homo sapiens
aaggggtaggcaaaggatactaagatgtggccagagagataggagaaaaaacatgaaatgttatcatggaagccaaaataagaatatgccaagaaaagagyggctaacagtgttaactactgcttccaggtcaaggaagagcaagactgaaaatgtttaccagatttataatcgaggaggtcctggatgaccttggcaaaa

SEQ ID NO: 67072 - DNA, 201 bp, Homo sapiens
agttaaggagcatacaagcaattacaatgtaaggataagattaccaataaaggaagcacagaggactatggaagcacatgaggtgactcctaatccagtgyagggtccttagggaaatgttcctgaaggaaatgttccagacggaggcccagaactgtgtgattagaatatagagtagtgagtgatgaagctggagacagg

SEQ ID NO: 67073 - DNA, 201 bp, Homo sapiens
ggaataccataatttaaggggtaggcaaaggatactaagatgtggccagagagataggagaaaaaacatgaaatgttatcatggaagccaaaataagaatrtgccaagaaaagagtggctaacagtgttaactactgcttccaggtcaaggaagagcaagactgaaaatgtttaccagatttataatcgaggaggtcctgg

SEQ ID NO: 67074 - DNA, 201 bp, Homo sapiens
gggcagttactttgcccattttctcatctataaaatgggagtggatagtattgatagtatttatctcaccgaattgttgacaaagattgggataatttatrtagaatactggtacacattagggactcagtaatagttcactccccctcattaaagtattacaatgaaacaaaacttaaaagattttttttaaatgaattt

SEQ ID NO: 67075 - DNA, 201 bp, Homo sapiens
actaaaagatgatttgggaaataatccagaagctgtctacagacatgtgtctctctccctgttctttatctttcaatactactagaaacaataaaaacaaygcaagacaaaaagctgaaatgtagcaaatgaaggactctcagaaggcagaaggctcatacctcttttctgatcatgacatcattcttgtaattgctgttg

SEQ ID NO: 67076 - DNA, 201 bp, Homo sapiens
tctacataggacaacccttgaaatttatagatggtgtttgaattcccttccgttcattctgagtgttttcttctccagggtacacatctaactttccccarctagtcctgatgtaatcttgtttgcctcttttccatttcccagataccctcctttggaaagaccctccccagcttcagtacttttcctcatagttatgtg

SEQ ID NO: 67077 - DNA, 201 bp, Homo sapiens
taggccccagtagtgatggtacagttatccgagaaatggacagaggagagacaggttgttgagaatattgatttccagagcttcaaggctatttacctcaygatataaaggaaagagcatgggcttttgtgtatatacagactggagtttgaattctggttctgccacttcctggctatgaccttaggcaagttattcaat

SEQ ID NO: 67078 - DNA, 201 bp, Homo sapiens
ctcttctctacagatttttctgtcacacacatacacatataaacacacacatacacacacagagtctgtgtggtgggccaaacatgccaaaaataaatacyctcacttctctaaattatttatagaactcatctgatttttaaaatatgttaataaataatctaaatgggggagggagttgaagtgttttttttttttttt

SEQ ID NO: 67079 - DNA, 201 bp, Homo sapiens
aacaaaatcctatcaacgatcaaagtccagttggttctgcctccaacagtttcctaaatctttctctccatttctactatctctgtagtcccaaccagtawctttttttttttttttttttgagacagagtcttgctctgtcacccaggctggggtacagtggcactatctcagcttgctgcaacctccgccccaggttca

SEQ ID NO: 67080 - DNA, 201 bp, Homo sapiens
actccagcctgggcaaaaagagcgaaagccgtctcaaaaaaaaaaaaaaaaaaaaggccttccaagtccaaactttttaccgtggtctataaagacctaaraggtgccgctcctacctacctatccgacatcatctcctgctatctcccagctcaccactcttcaaccacactgaccacctgagacacgcctagctcattc

SEQ ID NO: 67081 - DNA, 201 bp, Homo sapiens
caagactgaaaatgtttaccagatttataatcgaggaggtcctggatgaccttggcaaaagcaaccccaatggcatgggaatgaatggtaaggcagaagtwttgggatgcaagtaggcaaaaattgttatcgaagtacagaggtgagttatctaacctagtcttagagaaaagggaaggcttcctggaggaggcattacct

SEQ ID NO: 67082 - DNA, 201 bp, Homo sapiens
ctctatcttcatgcatttcgggaaaaggaattatttactctgaaacatttaatgctaactcatttatattttgtgaaacgatgagtgtatggctggagttmggggggtagggtggagaggcttgcattcctgtgccatttccccattcccaccagtgcccaactggacagtgattagtatcccctctccagactcaacgtc

SEQ ID NO: 67083 - DNA, 201 bp, Homo sapiens
aattgtgagaaatatatttttactgcttacaaattacccagtctcaggcattttgttgcagcaaaaaagagactgcgacacccacatgccctggttattcttttttttttttttttttgaaacggagccttgctctgtcgcccaggctggagtgcagtggtgcgatctcggctcattgcgaactctgcctcctgggttcat

SEQ ID NO: 67084 - DNA, 201 bp, Homo sapiens
tctccctgttctttatctttcaatactactagaaacaataaaaacaatgcaagacaaaaagctgaaatgtagcaaatgaaggactctcagaaggcagaagkctcatacctcttttctgatcatgacatcattcttgtaattgctgttgttggcatatcttaacttccctgtgggggcaaaaaacaatttcaacgtataata

SEQ ID NO: 67085 - DNA, 201 bp, Homo sapiens
gagccttgctctgtcgcccaggctggagtgcagtggtgcgatctcggctcattgcgaactctgcctcctgggttcatgccattctcctgcctcagcctccyaagtagctgggactacaggcacccgccaccatgcctggctaatttttttgtattttcagtacagacagggcttcaccgtattagccaggatggtctcgat

SEQ ID NO: 67086 - DNA, 201 bp, Homo sapiens
tgaggtaggaggataatttgagcctgggaggtcgaggctgtagggaaccatgatcacaccattacactccagcctgggtgacaaagcaagaccctgtctcaaaaaaaaaaaaaaagagaaaaaaagaaaagggaccaggtatcaagcacctaataaatgtcagcccctagggtcaatgggattacctgtgcttgttctttg

SEQ ID NO: 67087 - DNA, 201 bp, Homo sapiens
gtatggaaaaaaaaatgctcttttaaaagtatatggtttggacaggtatatttgttttctcttgtagtttttgtaaaaaagtatcaaaaccttggctttawatatatatatatatatatatatacacacacacacacgtggctttttaaaaattacttttttatagcacaaagtgtttgtaaatgcagagggtttctgcta

SEQ ID NO: 67088 - DNA, 201 bp, Homo sapiens
agacaggagaattgcttgagcccaggaggcggaggttgcaatgagctatgatcctaccactgtactccagcctgggtaacagagtacgaccctgtctcttaaaaaaaaaaaaaaaaaaaagtaatggagatagaaaagtggatggatttgagatggaataccataatttaaggggtaggcaaaggatactaagatgtggcc

SEQ ID NO: 67089 - DNA, 201 bp, Homo sapiens
taaaagtatatggtttggacaggtatatttgttttctcttgtagtttttgtaaaaaagtatcaaaaccttggctttaaatatatatatatatatatatatmcacacacacacacgtggctttttaaaaattacttttttatagcacaaagtgtttgtaaatgcagagggtttctgctaattcttgactgtgcacatggtgc

SEQ ID NO: 67090 - DNA, 201 bp, Homo sapiens
tgaattcaacccaagtgtcctgaaagaaattgaagaagttactcaaagagctgaactttaaaacaaggagtagctgagggtgaggcatatcctatcttgastttctgagcactctggtaccatggaatgtctgtacactgaccttcgccaaagccaagaaagccctggtaggagtcacagcagccatgggtgagctgaaag

SEQ ID NO: 67091 - DNA, 201 bp, Homo sapiens
cgacatcatctcctgctatctcccagctcaccactcttcaaccacactgaccacctgagacacgcctagctcattcccgccctgcagccttgacatctggkattccctttgtgtagaatggtcttccttatgagcttcacaaggctgagcccttcttgttaattaggactcggctgcaatataccctttacagagagctct

SEQ ID NO: 67092 - DNA, 201 bp, Homo sapiens
ttatttacaaagcagtaaaccaaattcctgtgtgaacataaatatccaatataatataatattgcgtatgccatttcccccctcaaatatgacttcaattktggccagttgttctgacttaagccaaaaattagtttcatctatatgaacatatgatggtaagtaacctatttattaccttaaaatgtttccccacataaa

SEQ ID NO: 67093 - DNA, 201 bp, Homo sapiens
tacccggagtttttccttttatttacaaagcagtaaaccaaattcctgtgtgaacataaatatccaatataatataatattgcgtatgccatttccccccwcaaatatgacttcaattttggccagttgttctgacttaagccaaaaattagtttcatctatatgaacatatgatggtaagtaacctatttattaccttaa

SEQ ID NO: 67094 - DNA, 201 bp, Homo sapiens
cacaagtagaaaagagcacttctcccttcctcccccaaggccaagaaaagcaaagaagatgtctataatgaagaacatctatacatatacccggagttttyccttttatttacaaagcagtaaaccaaattcctgtgtgaacataaatatccaatataatataatattgcgtatgccatttcccccctcaaatatgacttc

SEQ ID NO: 67095 - DNA, 201 bp, Homo sapiens
ttgtatgattttcctttcattagattgttgaaataattatgttctatttctctttgtatctccacaatgctttgtccatagtagttagtaagtgagatagscaacaaaagctttaagtggaggagggagtgtggggggtcttatttgtaagatttctgcactacaggataatcaataaaacacacctgccggcccactcgg

SEQ ID NO: 67096 - DNA, 201 bp, Homo sapiens
ttcgtgtcttgacaactgcaacagtctcctaatcaatagccctgtttccactcttgcccattccgcacccaataaccagaatgctttttcaagaagagatmacatttcttctctgcttaaaaccttccaagcccggccgggcgcggtggctcacacctgtaatcccagcactttgggacgccgaggcgggcgtatcacctg

SEQ ID NO: 67097 - DNA, 201 bp, Homo sapiens
ttaaaatgttaaatattttacattatcttcacaatccctgtacccccaacaccttccacagcaaatctccctcaacaatacttcagtaatctggctagagyccaaaacaaatacttcttattcagaacttggctttgaagaaaatgcagccctaacaaaattttaagtaagttactgaaggatgcagaggcttcattttac

SEQ ID NO: 67098 - DNA, 201 bp, Homo sapiens
aatcttgtagtagtcttccccaaaatgtataaaaatgagtttaatgatgagaaacattagaaccaatttggagcattctatgcaacaacctgtccatactmttcaaaaatatcaaggtcatgaaaaacaagcaaagatagacacatttttacagactggagaagactagatatagtaagtaaacacaatgaaggatgttgg

SEQ ID NO: 67099 - DNA, 201 bp, Homo sapiens
aaagatgatgccagcagtcacctcttttccaggaagacagaaacaaaaaccgttctcctcgagaggccaacagtgtagaagccccttttccagaactttccaaggagtaggtgaacttctttgtaagtgtatcagcacaggggagagtggtgctccatgttccaaggaagaaaagcaacccacagctcctcctgcccgtgc

SEQ ID NO: 67100 - DNA, 201 bp, Homo sapiens
taagcttccaacacagcaggttcagagaggttaggaaaaataagcaagggaaagaaacaagtactgatctaacaatgacggaagctgactccatgccttadtggatgcttgcggaggatggcactatcttggctgggctgactgtattagcaatgcatgtatctaaatcagctctaaaacccatagagagactggcacttt

SEQ ID NO: 67101 - DNA, 201 bp, Homo sapiens
agacccatcgtggaataaaacacagaatttaaaatagcatccgatgtgacccaaaccagcaacaataacgagaaaaccacccagtccttccagagatgcamcttgtttctgctgcagtgttgctaatcaaaatcgatctgcccatccaagcaatttaaagaggaagggcggcatttgtagaaaatggtacatgttgataaa

SEQ ID NO: 67102 - DNA, 201 bp, Homo sapiens
aggcctgcctggctccacagaccatggtgccattaaatgagactgtcctcactctcatggggggacacagagaaagctccccaccccaaccacaggaggaraagatgactgtgggagaacacatcaccatacagcatcagtgtcccattagcgcggaaggcaagattgacaggaaaaacaaacaaggaaatagtacagtgg

SEQ ID NO: 67103 - DNA, 201 bp, Homo sapiens
tctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaa

SEQ ID NO: 67104 - DNA, 201 bp, Homo sapiens
taaaggacatcaatccatgtgggggaaaggtaaacaaatattaatcaagtccctagtgattctacataattctctgtaattctttctgcagtcctatagcrtagataacatctccatctatggatgataaaaagcactgcttgtaataactcacttcctaagtacctgcaaggcacgaattcagggccaggcacagttaat

SEQ ID NO: 67105 - DNA, 201 bp, Homo sapiens
tagactacaactatcaatgggccattcaaaaatggagccattgtcaagtcacccacatgaaatagtgaaggtttacaaccaaaagagaatcgctcacttcyacaaaatagctgatggaaatactgtgctccgggggcttacgtggaacaaacattaggaaggtgtctacctgcaaacccgctctaaggctggaccaaacca

SEQ ID NO: 67106 - DNA, 201 bp, Homo sapiens
gagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgtttgtttctgtattttgaaagcactcaacatgcagagtatttgct

SEQ ID NO: 67107 - DNA, 201 bp, Homo sapiens
agaagtctgaggctgcactcccctgcctgggcaacagagcaagactgtctcaaaaaaagaaaaaagaaaagaaatatgaaaaaagagaaacgagacatctrcatactgtgagtatcagccctaagatatcagtaacaatgcgaaaagcagaaaatttacactggagaaacctggcaggcaccacctcaatcaagtgttcaa

SEQ ID NO: 67108 - DNA, 201 bp, Homo sapiens
agaggcctaaaaagccaggtggacagagaccacatgtgaccccaaacagaaacaggctgctggaaactaactctctctctctctagctgatacttattcarcacttactgtatgtcaggtactattctaaaaactttacgtatagtaactcagttttcacacagatgcaattattttccatactttagagatgagaacatt

SEQ ID NO: 67109 - DNA, 201 bp, Homo sapiens
aatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttagtggatgcttgcggaggatggcactatcttggctgggctgactgtattag

SEQ ID NO: 67110 - DNA, 201 bp, Homo sapiens
tgcagcagatgaccagaaagacgagaaagggaaacaaactcccattcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggca

SEQ ID NO: 67111 - DNA, 201 bp, Homo sapiens
ttacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagcccctttt

SEQ ID NO: 67112 - DNA, 201 bp, Homo sapiens
tacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcac

SEQ ID NO: 67113 - DNA, 201 bp, Homo sapiens
ttattgaacctatggatcaattctggtgaaatgtcaaataaggcaaaataaaacagaagtaagtgtgaaggcaagagtttttaccagaatctgaccctttkgtgagataactcacgtgacggaaagctctgatgatattgctgaagctggagtgtttaatgacctccattttctcaagagcattttccctgtaaacaaaga

SEQ ID NO: 67114 - DNA, 201 bp, Homo sapiens
gcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagc

SEQ ID NO: 67115 - DNA, 201 bp, Homo sapiens
gaatgaagaagtcatgctgacattggggaaagagaacttactgaaaatttttaaaatgttaaatattttacattatcttcacaatccctgtacccccaacmccttccacagcaaatctccctcaacaatacttcagtaatctggctagagcccaaaacaaatacttcttattcagaacttggctttgaagaaaatgcagcc

SEQ ID NO: 67116 - DNA, 201 bp, Homo sapiens
ggtacatgttgataaagcatgacctgtcccacatggagagcaataaaaggaaaacaagcctgagaacagtatgctgtgctcaccaggagatggaagagaaraaagccagaataagggcagggatgccgggggaagggaggacggggtgtcaaaggcctgcaggatttttgtaaacagcagcccgtaatggccacggtgaga

SEQ ID NO: 67117 - DNA, 201 bp, Homo sapiens
gagaccacatgtgaccccaaacagaaacaggctgctggaaactaactctctctctctctagctgatacttattcagcacttactgtatgtcaggtactatyctaaaaactttacgtatagtaactcagttttcacacagatgcaattattttccatactttagagatgagaacattgaggcatagagaggttaagtaattt

SEQ ID NO: 67118 - DNA, 201 bp, Homo sapiens
caaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctat

SEQ ID NO: 67119 - DNA, 201 bp, Homo sapiens
cgcaggggctgtatgaaggtggttctagaaaatggggtggcctggcacaggggcagccattccagaactaggaaggcagggtaaggtactccacatgtgtkggggggggcaggggtggagggagtgagaggggaacaaagaccaaggcaggctaaagtcagaccgtgtagaacccaaagccaggccagggtactcgtactg

SEQ ID NO: 67120 - DNA, 201 bp, Homo sapiens
gcgaaagcacctggcccagatgagtaagggagagaagccggagcacacatcactggagcacactttattacagtgtctttctgccttcaatcacttgcccmgttttgtaacttcataagagagtcatgatgcccagaacctcatggccccggggcaaaactctgcaccagctctgacactctccttaacctgctgtcacca

SEQ ID NO: 67121 - DNA, 201 bp, Homo sapiens
tcaatgacaccactttagaatttaactgttccaaaccctttgtttggcagatggggaaaggagaggtagagggagatcagaagagtcaatacaagaatctyggctgattggctggtttttctaatatggttcattcaccacatcatgttattctattgaagttcaggagagggtaccaggggatacctcaacccaaaatga

SEQ ID NO: 67122 - DNA, 201 bp, Homo sapiens
tcagaaaagctcccctggtgaagactatggacgatgcccgtcatatagcctgattggacaattcctgctttaatcaggaaggctacgattgtcctcgtctrcaaggacctgcctccaaggaggggcatggctctggatctttgcagccccagagcttagttgagcacctgccctgcaggcctcccacatatttttgtggag

SEQ ID NO: 67123 - DNA, 201 bp, Homo sapiens
gtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaa

SEQ ID NO: 67124 - DNA, 201 bp, Homo sapiens
ccactctgtcgagagaaacaattactcctaaagaaaatctctacttaaagccacgattaaagtcactctcctcttcatccctcaacaacttgctttgaaarggtaagaagggaaagaagatgagtgcttccacttcgctggtaggggtgaatggtaggtagtcctatctgcactctttccatctagtcccctacacataat

SEQ ID NO: 67125 - DNA, 201 bp, Homo sapiens
cctcctctgtgtctgtgagtggctggctccttctcaaccttcattcaggtctccgctcaaacaccaccctcaccaccatgcccacctgccagctactatcmcacagaccttcattttcttcatgaggtgattctgaagagaaaataagcttgggagctatcaccctaacttacttattccctcagtgatggaatttggggg

SEQ ID NO: 67126 - DNA, 201 bp, Homo sapiens
gccagactgtccaagctgaaaacgtaaacaaaagctccttgcaggaagcaacagggtgcaaacttgccacctggggggcctctctgccaccccttggccarccctctcctccagcatctggccccaccccggccctgcccgcctggcatgtaaagcaccccctcctctccaagcatccgttcctcagccgctgtgttcctg

SEQ ID NO: 67127 - DNA, 201 bp, Homo sapiens
tgggccctggtgattggcgtgttattcggagtggaaagtagtaaacaaccttggtccacggcggcggcgcgggcgcggggtgcccgctccctcttccctcrcccggggcggggtggggcgcgcgcgccagacaaaaggagcctcagcccctcggaggggagagcaggaagggcgcacaccacagccggcggagcgggcgtc

SEQ ID NO: 67128 - DNA, 201 bp, Homo sapiens
agcagtcctaatggcttaaggctactcagacttggagaaggccccttctacagaagcaggcacagctcagcacaccccgtctccctctaaaccgaggctgyggggaaatcactgtgaccttgccactatacagcagcttcatgctttggccaccgtgttgcagcctctacggccactctgctctagtaactggcctccttc

SEQ ID NO: 67129 - DNA, 201 bp, Homo sapiens
gctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcct

SEQ ID NO: 67130 - DNA, 201 bp, Homo sapiens
gggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattact

SEQ ID NO: 67131 - DNA, 201 bp, Homo sapiens
ttcctttctcttaaaaaactaagcaagactggatgtcatttagaataccgacttctaaaaaagggcatttttgaactgaatgccacatgctgtattttgcyattttgcctgcgcttcctgcttggagcctgtgacacagagaagcctcagacactggagctgctccgggccacgcaaactccgctccgcatcttccaggca

SEQ ID NO: 67132 - DNA, 201 bp, Homo sapiens
acacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgc

SEQ ID NO: 67133 - DNA, 201 bp, Homo sapiens
gcaatttagttcctcctctttcctgccctccaccccaaccctccaccttttaagattaatttttagttctgtctttgcagaagttgttttaaatccctgtrctaaaaattgttgctttattcacacaatacgccattaagggcacacgggtgaatcagatgccccgttagtccctttccttgcaagttcctggagctgtga

SEQ ID NO: 67134 - DNA, 201 bp, Homo sapiens
gcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaa

SEQ ID NO: 67135 - DNA, 201 bp, Homo sapiens
gaaaattgccattaaagcatggcagtaataattattgtagataagctccaccaaagcatgacaagatcagtgagtgacaatgtgatgagaaacaggacctyggccagttgtggttgggaggctgaggtgggaggccaggagttcgagaccagactgggcaacatagtgagtttctacaaaaaatttaaaaattggtgaagg

SEQ ID NO: 67136 - DNA, 201 bp, Homo sapiens
gaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgac

SEQ ID NO: 67137 - DNA, 201 bp, Homo sapiens
ttccccgactctgcactctgcgctcggcccgcttcgctccggtggggccccggggctgggatgtgttttggctcctccaccctccacccgctttcttagtsgggggaacacatcttgtttatggggaaggttactcctcctctgctctggtgatcgcctccctaatactcctgctgcatccttgcgggatgcccacttgac

SEQ ID NO: 67138 - DNA, 201 bp, Homo sapiens
ctgagtaaattacaaagctcatatgaagggccgcagaagaaagaatgggagagatgatttaccagacagagaaggggaagtctcagccctaggcacctcakgagcccaggagagtgccaggcaaaatccctaaggcacttcactgagtcctacaacctcgcatagacatcactgtgctcatctcaggcaggggacacccag

SEQ ID NO: 67139 - DNA, 201 bp, Homo sapiens
tgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggca

SEQ ID NO: 67140 - DNA, 201 bp, Homo sapiens
ttggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataat

SEQ ID NO: 67141 - DNA, 201 bp, Homo sapiens
aggggcatggctctggatctttgcagccccagagcttagttgagcacctgccctgcaggcctcccacatatttttgtggagaaagactcagcagtcctaawggcttaaggctactcagacttggagaaggccccttctacagaagcaggcacagctcagcacaccccgtctccctctaaaccgaggctgcggggaaatcac

SEQ ID NO: 67142 - DNA, 201 bp, Homo sapiens
attatttttcctttctcttaaaaaactaagcaagactggatgtcatttagaataccgacttctaaaaaagggcatttttgaactgaatgccacatgctgtrttttgccattttgcctgcgcttcctgcttggagcctgtgacacagagaagcctcagacactggagctgctccgggccacgcaaactccgctccgcatctt

SEQ ID NO: 67143 - DNA, 201 bp, Homo sapiens
tcccctgagccctacactgctgtgttcaactccatcttagcttgccccccctggatgtctgaggcatttctgacctgagagatgcaagacagagctcctgycccatctgccttctccaccacacacttcccaaactacactgctcctccctccccactcctttgcagctcaggaatggaagcctccaccccctgttctgtc

SEQ ID NO: 67144 - DNA, 201 bp, Homo sapiens
aatttggagagttcgagcacgattaattttgtgtgttcagctcaaaggaaaaagcttcctcataggagaaatgcattaatggatgagcgaatgaataagargctttataacccaaccaaccagaagccgaggggctcactatattaaattataccagctctcaatacaatgggtcaaaatgtattttattttaaattctaa

SEQ ID NO: 67145 - DNA, 201 bp, Homo sapiens
ttcgaggtcagtttattcacattctgagcagtggtttacttttagcaaaatattacccatgtcattaaattaatatttgggtttgaatctttttgttttakatgcacttaatgtgtaaaatcatttaacttacagttgtaaaagatctgcaagcgtaaaaaattgacacctaggccttataaggctgtaggtatttaagta

SEQ ID NO: 67146 - DNA, 201 bp, Homo sapiens
agtcagttaccagggaactcacaaaatttggagagttcgagcacgattaattttgtgtgttcagctcaaaggaaaaagcttcctcataggagaaatgcatkaatggatgagcgaatgaataagaagctttataacccaaccaaccagaagccgaggggctcactatattaaattataccagctctcaatacaatgggtcaa

SEQ ID NO: 67147 - DNA, 201 bp, Homo sapiens
aaaaatgcctattactccaatcctgtactcacttgctccctgccagagacaacacaaagagatgagtatacacactcaggaaaacttcgcccgggccttcsaggtagggcgaggactgtgcaccacacgagatgacttgaaaacctgtaggaaggttgtatctcagtgccacttgctttgaggagactcactgggtaactg

SEQ ID NO: 67148 - DNA, 201 bp, Homo sapiens
ggaaatgtagtgacattaaccaaacacacaaagccatctcaagcctaaaaatgcctattactccaatcctgtactcacttgctccctgccagagacaacayaaagagatgagtatacacactcaggaaaacttcgcccgggccttcgaggtagggcgaggactgtgcaccacacgagatgacttgaaaacctgtaggaagg

SEQ ID NO: 67149 - DNA, 201 bp, Homo sapiens
taatcctaggcagccgtatggccagaccaattataaaccccgtagacttttcacacgtcacagagagcaaactgctccaggagcagctcttaatactttaytgcctattcaggtgcacctgcacttttaagatatacttgtcagcaacaaaatacagcacttccctctgtctttatcacattggttgccagacaactgcac

SEQ ID NO: 67150 - DNA, 201 bp, Homo sapiens
tctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttagaaatgtttcctttaaaaattatttaaattgtattgctta

SEQ ID NO: 67151 - DNA, 201 bp, Homo sapiens
ccaaaggaagtctagatttatagcctaaatatgtcttcctctagaatatttaatacacttaagctttagtcattctatacactttgaaaatgcccttcaaygataaattacagtcgttgcatttttcattgcagttcacttaaatatcattttgctttcaggaaaacaattataggacagtaaatcacttttacattgcat

SEQ ID NO: 67152 - DNA, 201 bp, Homo sapiens
atgtctaactaagcctggtctaataactgttttgcatctgtcctctagcagtctgctgctgattggtggtgggaggggaagagggaaacagcttaaaccaktactcctgttttgtgggcatttgaagtagctgccaggcacatgacaccactgctccaattggttcagagtgacatcacttcatgattcaactttgtttgc

SEQ ID NO: 67153 - DNA, 201 bp, Homo sapiens
ataaagaacgaaacagcgtaatagatgatcaagtcttaggagagtgactgcagactacaactgcaacagagtgtttaggaaaaaatagatgttagctagtragtgatgatcaaggaaaaagcatgggaaagaatgccgagcaagtgggagaacacatgagtaacagcagtggggtgggagacaagggcccagccttttggc

SEQ ID NO: 67154 - DNA, 201 bp, Homo sapiens
gaggcaggtggatcatgacgtcaggagtttgagaccagcctaaccaacatggtgaaaccccatctctactaaaaatacaaaaattagccgggtgtggtggygtgcgcatgtaatcccagctactcaggaggctgaggcaggagaatcgcttgaacccggaaggcagaggttgcagtgagctgagattgcgccactgcactt

SEQ ID NO: 67155 - DNA, 201 bp, Homo sapiens
ccatctcaagcctaaaaatgcctattactccaatcctgtactcacttgctccctgccagagacaacacaaagagatgagtatacacactcaggaaaacttygcccgggccttcgaggtagggcgaggactgtgcaccacacgagatgacttgaaaacctgtaggaaggttgtatctcagtgccacttgctttgaggagact

SEQ ID NO: 67156 - DNA, 201 bp, Homo sapiens
tctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttg

SEQ ID NO: 67157 - DNA, 201 bp, Homo sapiens
attactccaatcctgtactcacttgctccctgccagagacaacacaaagagatgagtatacacactcaggaaaacttcgcccgggccttcgaggtagggcsaggactgtgcaccacacgagatgacttgaaaacctgtaggaaggttgtatctcagtgccacttgctttgaggagactcactgggtaactgtttgagggtg

SEQ ID NO: 67158 - DNA, 201 bp, Homo sapiens
aaaatttggagagttcgagcacgattaattttgtgtgttcagctcaaaggaaaaagcttcctcataggagaaatgcattaatggatgagcgaatgaataasaagctttataacccaaccaaccagaagccgaggggctcactatattaaattataccagctctcaatacaatgggtcaaaatgtattttattttaaattct

SEQ ID NO: 67159 - DNA, 201 bp, Homo sapiens
gacctcatccagggtggaggcagcatgtgggcaatggtaccaagaaagcatcagaaagaagaagggcttggaaggcaactacagaacaggctgccccacaycaaacttaggtagaataagactcacttccattgttccttctctagccaaagctagagaagctctgaatttctctgcatttcgaaaacactccaacacaca

SEQ ID NO: 67160 - DNA, 201 bp, Homo sapiens
caaaatggctggtgtcaaaggagaaagggacctccccacagcttgagtatggaagactgttgagcttcagaaatgaacacagggaaggagaaggaatgctrcaaatattttaccatattgacttttaattagttgagaatcaatgtaacaggtctagacctcatccagggtggaggcagcatgtgggcaatggtaccaaga

SEQ ID NO: 67161 - DNA, 201 bp, Homo sapiens
tgccactgggctcagaccagccctgtgcagctcacaacttcaactggaatcaaacctgaccatatccccacttctcacttaaaaagaaatggttttggccrtactggtagagcaaaaccagaaaatagactttgaattagtcttcatgctttgcaaaaaggtactaacttgttaagatgcatcctccatgtctaactaagc

SEQ ID NO: 67162 - DNA, 201 bp, Homo sapiens
ttaagatcaaatgaggtcataagggtgagaccctgatacaattggattaatgtccttaatcagtgaagagacaccacagcttgctctctcccaccactatrtgaggatacagtgagaaggtagctgtttgcaaaccaggaagagagccctcactagaaccagaccttgttgacacctgaccttggactttcagcatccaga

SEQ ID NO: 67163 - DNA, 201 bp, Homo sapiens
tttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgaga

SEQ ID NO: 67164 - DNA, 201 bp, Homo sapiens
acaatgggtcaaaatgtattttattttaaattctaagttaggctccaaactttacatcgggaccttgtaagacgagatcttttatcatgctagacttttaytatcccctaggaaatgtagtgacattaaccaaacacacaaagccatctcaagcctaaaaatgcctattactccaatcctgtactcacttgctccctgcca

SEQ ID NO: 67165 - DNA, 201 bp, Homo sapiens
cctgagttctgcctaattatgtgagccgttcaatactcaccagcaagtgaggagaggaaccaggtggccgtgcacacagggatgtgcatttgctctcttcracctggggagaacgggcagccctgtcaatattctccactcctgtataggctgctgtcaaccagtcagccccgagaatgacaatacttccatgttaccctc

SEQ ID NO: 67166 - DNA, 201 bp, Homo sapiens
agctgagtctaatggttaggacttcacatcacagagaacagggagccaccatggtattttgaacatatgagtaccttacctaaacgagttatttagataaraagaagtctgacaataatttacaggatgtattggagggaaggaaaagctgaaggtgagaccgaaccatgaggctgcaccagagaaaaggcactgggactg

SEQ ID NO: 67167 - DNA, 201 bp, Homo sapiens
aaagagatgagtatacacactcaggaaaacttcgcccgggccttcgaggtagggcgaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaattt

SEQ ID NO: 67168 - DNA, 201 bp, Homo sapiens
agagggaaacagcttaaaccattactcctgttttgtgggcatttgaagtagctgccaggcacatgacaccactgctccaattggttcagagtgacatcacytcatgattcaactttgtttgcatttcggcttcctcctttccaaggggttctcaacttcaccctgccaagtcactttcaaacagaaagagagaggaacagc

SEQ ID NO: 67169 - DNA, 201 bp, Homo sapiens
agcatgggtgacagagcgagaatccgtttcaaaaaaaaaaaagaagaagaaaagttaaaaaataaagaacgaaacagcgtaatagatgatcaagtcttagragagtgactgcagactacaactgcaacagagtgtttaggaaaaaatagatgttagctagtaagtgatgatcaaggaaaaagcatgggaaagaatgccgag

SEQ ID NO: 67170 - DNA, 201 bp, Homo sapiens
gtgccagtacactccagcatgggtgacagagcgagaatccgtttcaaaaaaaaaaaagaagaagaaaagttaaaaaataaagaacgaaacagcgtaatagrtgatcaagtcttaggagagtgactgcagactacaactgcaacagagtgtttaggaaaaaatagatgttagctagtaagtgatgatcaaggaaaaagcatg

SEQ ID NO: 67171 - DNA, 201 bp, Homo sapiens
ttcaacacaggcaagtgctttcgaattactggctccctgaaaagggggatctggacacatatggcaatgcgatgaatgatgattcctggaaagaaaaatgyttaatgaaacaagaaactcacaatttcctgagacctgatatgcacaaggtactgggcagatcttgtagttattgatgggaatttcagagaaaggcctgat

SEQ ID NO: 67172 - DNA, 201 bp, Homo sapiens
acagcttatatattctatcattcagtcttctacagcaaacgttaaatccctgaggaaagtcctaccgttagtttggtttttaaatatttagattatttcarcgtatgcacataagtattagtgcaacaaatatttactgaactcccgcaatatgcagtcatccagatttggggtagaaatttgggaatccccctgatttca

SEQ ID NO: 67173 - DNA, 201 bp, Homo sapiens
ccacttcctctttggttcattaagaatataaacattacttaaatagagcaaagctccctgagctaaggggtcttcatggtatacattcaaacggcatgtgracgaggttacagggcatagtgcagaatccctcctcggattccaaggtggctaaaaatgcctatgtcagtggatttgcctgttttccaagtcatttgctct

SEQ ID NO: 67174 - DNA, 201 bp, Homo sapiens
agaacgggcagccctgtcaatattctccactcctgtataggctgctgtcaaccagtcagccccgagaatgacaatacttccatgttaccctccctagttcygagtgctggctatgcgacaaacatatttttaatgagaaaaactatttttgtttcagttttgtttgaaccacatcattcacaaatgactgagtataagaaa

SEQ ID NO: 67175 - DNA, 201 bp, Homo sapiens
ccccacagatataaggaagcatcatagcaagtcttcttcctgtttccagtaattcggaatggccattctcccaggtagagccacgcttatatcagatacartttcttctccccatttttggtcttccattcatttctctttcactcttctaatttaagtgaaatggaattccaaatggccaagacactaataagctctctg

SEQ ID NO: 67176 - DNA, 201 bp, Homo sapiens
ggcacgctggaccagagggtgaatgcccccagcgggaatctctccctaaagccttgctttttcacatcacgccacctcccctcttccaaattttggaggcktactaccaataggaactcactatctgactgattaatcagctttcagtagacaggagcgggacaggtgtgggagaaaacatttctttccaactcccattct

SEQ ID NO: 67177 - DNA, 201 bp, Homo sapiens
gtttgcatgggcccagcccggcatacacaaaggcctgctttcatgcgccaggcctctccccactgtagaaggatgggcatatttcgccctcctcacttcttcaacaacttcactgaggcaattccattcggaaaggagcaacaggaagaggttgttaccaccaggaataggagcaactcccattaaaaagacagccattgt

SEQ ID NO: 67178 - DNA, 201 bp, Homo sapiens
ttctcactcttgccatggcctacagaccctctctgctctggtcccatctaatactgtgacccatcttataactcgacgctatgaaatcaattgtgtctcayccccggccacctcccacctccaccctgccaattcatatgtaggaaccctaacccctcatgtgactctgttgaaggtagggctgttaaggagacaattaag

SEQ ID NO: 67179 - DNA, 201 bp, Homo sapiens
ttatctcacccaaaatgccaacagtgccaatgctgagaaacctggcactggttcaggactgcacccctaccccccgccctgccactccccaactaattatytcacccaaaacgtcaatactgccaatgctgagaaacccagcactggttcaagccaccaacatctctcatatgcacggtcccagcagcttcctaagcggtc

SEQ ID NO: 67180 - DNA, 201 bp, Homo sapiens
ctagggggcggggtgggtgggcttctggcatctagcaggtagagactagtgaagctgctgaacattttgcaatacacaggacagccccccacaactaattwtctcacccaaaatgccaacagtgccaatgctgagaaacctggcactggttcaggactgcacccctaccccccgccctgccactccccaactaattatttc

SEQ ID NO: 67181 - DNA, 201 bp, Homo sapiens
taaaccattactcctgttttgtgggcatttgaagtagctgccaggcacatgacaccactgctccaattggttcagagtgacatcacttcatgattcaactktgtttgcatttcggcttcctcctttccaaggggttctcaacttcaccctgccaagtcactttcaaacagaaagagagaggaacagcacatcttatgtagt

SEQ ID NO: 67182 - DNA, 201 bp, Homo sapiens
tccaagccaaaatgtctcagaggtatctttcactctcccagtctccattcccttcaggctatattttacaagtcttcaaatattcctaaatctatccactrcaaattgctatgactctggtccagtggttctcaacagggtacaattttggtctccccaccccctaatcccaggttaacatctgtcaatgtctagatacat

SEQ ID NO: 67183 - DNA, 201 bp, Homo sapiens
tcatagtatctccaaatgccttggtttaccaagtctgagggtttcctagaactctccttataagcattagaatgaaatctagtcctggctcttttcccatraccacttcctctttggttcattaagaatataaacattacttaaatagagcaaagctccctgagctaaggggtcttcatggtatacattcaaacggcatgt

SEQ ID NO: 67184 - DNA, 201 bp, Homo sapiens
ggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcag

SEQ ID NO: 67185 - DNA, 201 bp, Homo sapiens
cacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggat

SEQ ID NO: 67186 - DNA, 201 bp, Homo sapiens
gaatgaagttactttcacagtgatgaccctgagtattgagaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgttta

SEQ ID NO: 67187 - DNA, 201 bp, Homo sapiens
ttgcagttcacttaaatatcattttgctttcaggaaaacaattataggacagtaaatcacttttacattgcattccaaaaatatttaagttgcaacatggrcaatgtgtagaatcacaagaaaaatacagcttatatattctatcattcagtcttctacagcaaacgttaaatccctgaggaaagtcctaccgttagtttg

SEQ ID NO: 67188 - DNA, 201 bp, Homo sapiens
gagagcaaactgctccaggagcagctcttaatactttattgcctattcaggtgcacctgcacttttaagatatacttgtcagcaacaaaatacagcacttycctctgtctttatcacattggttgccagacaactgcacagagctaaagtaggtaatgttacagtaaacagctccctaaaacatttacatatgtcactgat

SEQ ID NO: 67189 - DNA, 201 bp, Homo sapiens
gagctaaagtaggtaatgttacagtaaacagctccctaaaacatttacatatgtcactgataaacaatagaaaatttaaaagagatacaaatgtactcttrgaaccttaaatcttcttcccactgaggcctaagaacttaaaatcttcatacacctggctgagaaaaaggaaacaaattccaaaggaagtctagatttata

SEQ ID NO: 67190 - DNA, 201 bp, Homo sapiens
tggtttattctcggtactcaaattcaaatcttagtaacatagcaattacattttaaaataaactatctccttgtgcttgcttctaaggagagtgtttagtrggatatgaaaagagtctaatcctaggcagccgtatggccagaccaattataaaccccgtagacttttcacacgtcacagagagcaaactgctccaggagc

SEQ ID NO: 67191 - DNA, 201 bp, Homo sapiens
ctaaaaaaaaagttcccaacagcagcccttcctgaagctgacggtctgactgtggaagtttagcccgagtatttagggtgctgggaagacatgagaactamcttatgtcctttgttttcttcctaagcaaactgggcagtcttgttcatgcaaaaccactatggagtgatcactgtaacaggcacgctggaccagagggtg

SEQ ID NO: 67192 - DNA, 201 bp, Homo sapiens
aaaatgccaacagtgccaatgctgagaaacctggcactggttcaggactgcacccctaccccccgccctgccactccccaactaattatttcacccaaaaygtcaatactgccaatgctgagaaacccagcactggttcaagccaccaacatctctcatatgcacggtcccagcagcttcctaagcggtctccctgctttt

SEQ ID NO: 67193 - DNA, 201 bp, Homo sapiens
ccctaggaaatgtagtgacattaaccaaacacacaaagccatctcaagcctaaaaatgcctattactccaatcctgtactcacttgctccctgccagagayaacacaaagagatgagtatacacactcaggaaaacttcgcccgggccttcgaggtagggcgaggactgtgcaccacacgagatgacttgaaaacctgtag

SEQ ID NO: 67194 - DNA, 201 bp, Homo sapiens
catcaaacttaggtagaataagactcacttccattgttccttctctagccaaagctagagaagctctgaatttctctgcatttcgaaaacactccaacacrcagagtcacacaaaactctcctttggaccagatggaccctatcctacgcactgagagatttggagtgaatgggacaagaggtaagcccagtctctttcct

SEQ ID NO: 67195 - DNA, 201 bp, Homo sapiens
agcttgccccccctggatgtctgaggcatttctgacctgagagatgcaagacagagctcctgccccatctgccttctccaccacacacttcccaaactacrctgctcctccctccccactcctttgcagctcaggaatggaagcctccaccccctgttctgtccaagccaaaatgtctcagaggtatctttcactctccca

SEQ ID NO: 67196 - DNA, 201 bp, Homo sapiens
cacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttc

SEQ ID NO: 67197 - DNA, 201 bp, Homo sapiens
tatactccatatacatagctacaatgcctcatgcagaatgctcttcccaaaactgtgctcaaggatacaaacccaggctgtccaatttggggaaatcattktttgagggtggcacagacaagcagtcggcttggggtttgctccctgtgcacagctcgatcatcaaggaaaggcctcttccgggcctcaaagctccctttg

SEQ ID NO: 67198 - DNA, 201 bp, Homo sapiens
ttgtagaagcacagtctaaatacacacacgcaagccactgcaaaatgactttctaagttaaaagtcagagaaatcaatgtttgactgactatggagcatamaaattcttcatttgctttcatcagctgaaaaaaaaatgctagaaataactacggagaaatggtaaagaaaaaaatgtaatgtacacagttttgctgaaaa

SEQ ID NO: 67199 - DNA, 201 bp, Homo sapiens
taatgtgacatatttactaatatttctgtcaaaataacaacatctaaactgtcacttcaacaaggaagcttctcttcctgttttagtatagagaagcactrggatatcgtctcttttccttttaaagaaaaatgtattctgactgctggtaaaatcaggagtaacttgagtctgtgacttaaagggcagaactaagcccta

SEQ ID NO: 67200 - DNA, 201 bp, Homo sapiens
aatgtgacacctacctctaagtcatttggatttataaaaatcccaccatgctacaatcaagaaagcatttcactgagcaactgtaagccaggtacagggcrtgagctgaagaatgtcccaggtgagtgaggccgttctaatttcaacacctaaagaacaggtcacatcagacgttataaattctccaattttcttttcttt

SEQ ID NO: 67201 - DNA, 201 bp, Homo sapiens
ctactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagacggca

SEQ ID NO: 67202 - DNA, 201 bp, Homo sapiens
aagagggagttcttaacctctgtggcagagcaacctgaaaacagaattatactccatatacatagctacaatgcctcatgcagaatgctcttcccaaaacygtgctcaaggatacaaacccaggctgtccaatttggggaaatcattgtttgagggtggcacagacaagcagtcggcttggggtttgctccctgtgcacag

SEQ ID NO: 67203 - DNA, 201 bp, Homo sapiens
aagtcacacattacacacctaagtggtcacaaacaggattttaatctatgtgaacagatcaccaatcttggtttcatccttttatgagtaaaatgtcatawaaaaataaactccttaatacatgtaataagttacaagtgaagtaaaaactaaatattagaggaaaagatacaaataagttagttgttgcttttttaagtt

SEQ ID NO: 67204 - DNA, 201 bp, Homo sapiens
ctctccttccttcttctatttcttccctttcaaaccagaccactgaaactctcagtctgtatttatgtgaaataacaggaacgttaaacatgctaccttcyatttgtacagaattgccatgcaacacaaagaatgattatgcattagctacgtcacatttacctgtgaaatttatctcattgtagcactataactctattt

SEQ ID NO: 67205 - DNA, 201 bp, Homo sapiens
gaagagcacctggcacaggtcagggactcagaagcatttgttgaagaaatggaagtgctcacccactgagttcttgcttctgcagcattcctggcaggtaaccctctcgagttggctgaaatctttccaagaatgaaaagctgggcttttacaacaaactaacaagcaaaccccaaccaaccacccccacacacccccagg

SEQ ID NO: 67206 - DNA, 201 bp, Homo sapiens
taatttgtcttcatttgcaaagatgaatcttactctgaaacctcatttgagagtgctctagtctctcaggatgcatagaaatgccttataaatgctaagtyatataataatggttatgtatttgggtgttagtcatctgctcttcttgctgagataaatagctaccatctgaaggtgaacacttcaccttccctacattta

SEQ ID NO: 67207 - DNA, 201 bp, Homo sapiens
acatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaat

SEQ ID NO: 67208 - DNA, 201 bp, Homo sapiens
ctgtgtctgctgagagctgagctgcctgcctgggatcagccagatggagcaggcagagacggcacggaccacactccagaggaacacgccatggatggctrtattgttgatgtttcagatatccaaaaagtaaattataaatcttagcggtgatttagctatcctatttgccaaaggtagtttacacgggtgtttcaaatt

SEQ ID NO: 67209 - DNA, 201 bp, Homo sapiens
aaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagc

SEQ ID NO: 67210 - DNA, 201 bp, Homo sapiens
aaatggcatatcaccttctttgtaaggtataacattttcaatgttgcaatataagctgaccacctcctctaaggcgaggactcggcgtcaggggcagggargtggtgagcaaagaaagggcaaaaacaagaccttgatcacagaagcaagaatctgacattggattatttttgaaacatactacatacataaggaaaatga

SEQ ID NO: 67211 - DNA, 201 bp, Homo sapiens
gaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaag

SEQ ID NO: 67212 - DNA, 201 bp, Homo sapiens
tgactgctggtaaaatcaggagtaacttgagtctgtgacttaaagggcagaactaagccctatactacagtgataacagtaacaggaacatctgattacakataagctggctcctcataaaccctgatacaacctaaggcctccattttcattacacaccttcaaagatgcttttaaaatggacttgtttattgacaacac

SEQ ID NO: 67213 - DNA, 201 bp, Homo sapiens
gctccagcaacccgcctctctgacttcttcctcccatggtgcttttccacccagataactcgcccccaaagctgaggaccctcccaaggccatgaaagggscctgggttcacctccactgtcacagagtttaagaacacatgccctgtatagcctattttgtttgcttgtttctttattaaactataagagcatcatccaa

SEQ ID NO: 67214 - DNA, 201 bp, Homo sapiens
agtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaacttct

SEQ ID NO: 67215 - DNA, 201 bp, Homo sapiens
tgtctgctgagagctgagctgcctgcctgggatcagccagatggagcaggcagagacggcacggaccacactccagaggaacacgccatggatggctataytgttgatgtttcagatatccaaaaagtaaattataaatcttagcggtgatttagctatcctatttgccaaaggtagtttacacgggtgtttcaaattact

SEQ ID NO: 67216 - DNA, 201 bp, Homo sapiens
cagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaacttc

SEQ ID NO: 67217 - DNA, 201 bp, Homo sapiens
tgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgca

SEQ ID NO: 67218 - DNA, 201 bp, Homo sapiens
acaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctg

SEQ ID NO: 67219 - DNA, 201 bp, Homo sapiens
gttgggaggccgagacaggtggatcacgaggtcaggagatcaagaccatcctggctaacacagtgaaaccctgtctctactaaaaatacaaaaaaaattarccaggggtggttgcgggtgcctgcagtcccagctgctcgggaggctgaggcaggagaatggcatgaacccaggaggcggagcttgcagtgagccgagatc

SEQ ID NO: 67220 - DNA, 201 bp, Homo sapiens
gcagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaactt

SEQ ID NO: 67221 - DNA, 201 bp, Homo sapiens
gctcaccaccatgagttttctctcatcagcctccaaagtccaagccatcgctacatctcagagatgacgtacaacatgtgcctttattttatactctcaakatgctggatatagtagttattatccagaaagaatgacttcacaatcaggatccgagactggctataaacagtgatcgaatcctcaactcattccctctcg

SEQ ID NO: 67222 - DNA, 201 bp, Homo sapiens
caggacagttcttccctttgaccttccactggtcccagattatgactcagagactgtctcccactctttacccaaggggagatccctgcacctcctcctcyaacatcctacatctttaaaatgctcctctgaatcccagaactacagaaaccacagcactcgtgctggtgagcagattcctaattgcagaagatgcataca

SEQ ID NO: 67223 - DNA, 201 bp, Homo sapiens
cccacggagaagcctctttcacgttcatatgtgctggggatctgtgtctgctgagagctgagctgcctgcctgggatcagccagatggagcaggcagagayggcacggaccacactccagaggaacacgccatggatggctatattgttgatgtttcagatatccaaaaagtaaattataaatcttagcggtgatttagct

SEQ ID NO: 67224 - DNA, 201 bp, Homo sapiens
aaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagaca

SEQ ID NO: 67225 - DNA, 201 bp, Homo sapiens
ggaggccgaggcgggtggatcacttaaggtcaggagtttgagatcagcctgggcaacatggtgaaacctcatccctactacaaacacaaaaattagtcagscatggtggtgtgtgcgtctagtcccggctactcaggaggctgaggtaagaggatcgcttgagccttggcggtcgaggctgcagtgagctgtgattgcacc

SEQ ID NO: 67226 - DNA, 201 bp, Homo sapiens
ttgtggttttctacattttaaaaaaaggctagccagccgaccttatcatccctgtcattccaatgggaaaaagcgtcatcagcacaattgtagaagcctaraacaatgtgtccctgtcaactcagtgagggttttcttctttcaaagataaatcaagatgccataacctaggaataatataactacttacacacagagaac

SEQ ID NO: 67227 - DNA, 201 bp, Homo sapiens
aaaacccagtgtggtcgtctctgttctcaatgtctaccttggaagagggagttcttaacctctgtggcagagcaacctgaaaacagaattatactccatayacatagctacaatgcctcatgcagaatgctcttcccaaaactgtgctcaaggatacaaacccaggctgtccaatttggggaaatcattgtttgagggtgg

SEQ ID NO: 67228 - DNA, 201 bp, Homo sapiens
ccagccatttctagggaaaatcatctctgacagctggcatgaaatcaatgtccacctgaaaagtacctttgagggccatctaataaaggccaaaactatgsccacgaatccaaaactgcggaagtctagactggcgtttctaaataagctagagaaaaatactcaatgtgcgacatcttgtaaactcacagctgctgaaga

SEQ ID NO: 67229 - DNA, 201 bp, Homo sapiens
cagaaatggggccatcctggagaatcatgatgctgttaactgagctacatggaaggcgcagttttcctcctcttatcactggtcttttccttctcacactmagcaatctgagcaccacggggggcaacacctgctctctaatacagaagagatgggtgtatacctccattctaatacagaatgtctccatatacccagcca

SEQ ID NO: 67230 - DNA, 201 bp, Homo sapiens
ttaacattgtccctatgccatctcaccccccatataagctctctgctaactttccaacacagagaacaaaatccaaattcttcaccatggctccagggccmatgtgatctaatagccctctctgcctgtcactcaccaggctccagccacccaacctcatctcatcctcctcactggacatcccacgtgcatcctgtgtgc

SEQ ID NO: 67231 - DNA, 201 bp, Homo sapiens
cgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgta

SEQ ID NO: 67232 - DNA, 201 bp, Homo sapiens
caattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtct

SEQ ID NO: 67233 - DNA, 201 bp, Homo sapiens
aggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgc

SEQ ID NO: 67234 - DNA, 201 bp, Homo sapiens
agattgctcctctgccaacttctctccttccttcttctatttcttccctttcaaaccagaccactgaaactctcagtctgtatttatgtgaaataacaggracgttaaacatgctaccttctatttgtacagaattgccatgcaacacaaagaatgattatgcattagctacgtcacatttacctgtgaaatttatctcat

SEQ ID NO: 67235 - DNA, 201 bp, Homo sapiens
ggtagcacaattcctatctaggaaaacataataagtttcctgtaggaaaagtaagataaaggaattaagaattcttaggggtctcactcacttaagaccgytaatatatgagaaaaaatatcttgtgctttgagaagtaagcttcaattacctgggaaatcaactcaagcaaaaaactctttcaatgatgctagacaaata

SEQ ID NO: 67236 - DNA, 201 bp, Homo sapiens
tttttaaaagactgaagttaaaatatataatacatatatgaaaagatcccctaatttgggccagccataatcatcttaaaatggtaacctgggtaacaacyacctatcataatttatcctttgaagataaccacagattcatggttttgattttaaaagcttctttccaaacaaataaataggtatcaaatcaaaaggcac

SEQ ID NO: 67237 - DNA, 201 bp, Homo sapiens
aaagactgaagttaaaatatataatacatatatgaaaagatcccctaatttgggccagccataatcatcttaaaatggtaacctgggtaacaactacctaycataatttatcctttgaagataaccacagattcatggttttgattttaaaagcttctttccaaacaaataaataggtatcaaatcaaaaggcacacttta

SEQ ID NO: 67238 - DNA, 201 bp, Homo sapiens
attttaaaagcttctttccaaacaaataaataggtatcaaatcaaaaggcacactttaaaaataggaagattttgctaatttgtcttcatttgcaaagatkaatcttactctgaaacctcatttgagagtgctctagtctctcaggatgcatagaaatgccttataaatgctaagtcatataataatggttatgtatttgg

SEQ ID NO: 67239 - DNA, 201 bp, Homo sapiens
agtaagatgctcagtccattggcttgcagtgtttcagagtccctgcttgctgctagccacggggatgggggctgggagtcatcctgtttaaaagctgcagkgaaaacccagtgtggtcgtctctgttctcaatgtctaccttggaagagggagttcttaacctctgtggcagagcaacctgaaaacagaattatactccat

SEQ ID NO: 67240 - DNA, 201 bp, Homo sapiens
aagaaatagttgaaaaggatgggagtgaaggcactttaagcccacagatgccagcagaggtgggacatgacaagtgaggctggggggctggccccaaactkgtccctcccaagtcagcttggacaccacacagcacttcgtgcgccctcggctggcttagcacatggacaaggcattgccgctggagtcccaccttcttag

SEQ ID NO: 67241 - DNA, 201 bp, Homo sapiens
tgcagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaact

SEQ ID NO: 67242 - DNA, 201 bp, Homo sapiens
cagttttttgttttttttttttaatcaagaaatagttgaaaaggatgggagtgaaggcactttaagcccacagatgccagcagaggtgggacatgacaagkgaggctggggggctggccccaaactggtccctcccaagtcagcttggacaccacacagcacttcgtgcgccctcggctggcttagcacatggacaaggca

SEQ ID NO: 67243 - DNA, 201 bp, Homo sapiens
actgaaccctcatccctgtggagtctgtgctaactccaggtggtgagtgtcagaactgcactgaattgtaaggcccccagttggtgtctggagagttagasaactggttgttggtatggcaaaaccccacacatttggcgtcagaaatgttatgagtagcaacagttcagagtcctttatgtgcgtttacaaaagcaataa

SEQ ID NO: 67244 - DNA, 201 bp, Homo sapiens
cagagggaaacaattgaaacagacaatcgctcagataccaacaccaagttcgcctccccttgagaagtttgctgcagtctcctggtctaatccaaataggyggagggagggctgggagggcatcctgcagagctgttcagtggcggttctaacgctaacacccagcgtgttattaaaggaattcccatctgctgagtcaca

SEQ ID NO: 67245 - DNA, 201 bp, Homo sapiens
agaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccag

SEQ ID NO: 67246 - DNA, 201 bp, Homo sapiens
gaggtcatctaaattcaaaccttaaatataaaaccactcccaaaagagaatgcctttgaatataatggcagtttcaaactttggcaaataattatcctgtwcttcttatctgtgagaatctatcatttattttaaaaattctctgcagcggccgggagtggcggctcatgcctgtaatcccagcactttgggaggccaagg

SEQ ID NO: 67247 - DNA, 201 bp, Homo sapiens; identical to SEQ ID NO: 26729

SEQ ID NO: 67248 - DNA, 201 bp, Homo sapiens; identical to SEQ ID NO: 26730

SEQ ID NO: 67249 - DNA, 201 bp, Homo sapiens; identical to SEQ ID NO: 26732

SEQ ID NO: 67250 - DNA, 201 bp, Homo sapiens; identical to SEQ ID NO: 26731

SEQ ID NO: 67251 - DNA, 201 bp, Homo sapiens; identical to SEQ ID NO: 26734

SEQ ID NO: 67252 - DNA, 201 bp, Homo sapiens; identical to SEQ ID NO: 26733

SEQ ID NO: 67253 - DNA, 201 bp, Homo sapiens; identical to SEQ ID NO: 26738

SEQ ID NO: 67254 - DNA, 201 bp, Homo sapiens; identical to SEQ ID NO: 26736

SEQ ID NO: 67255 - DNA, 201 bp, Homo sapiens; identical to SEQ ID NO: 26322

SEQ ID NO: 67256 - DNA, 201 bp, Homo sapiens; identical to SEQ ID NO: 26739

SEQ ID NO: 67257 - DNA, 201 bp, Homo sapiens; identical to SEQ ID NO: 26741

SEQ ID NO: 67258 - DNA, 201 bp, Homo sapiens; identical to SEQ ID NO: 26374

SEQ ID NO: 67259 - DNA, 201 bp, Homo sapiens; identical to SEQ ID NO: 26375

SEQ ID NO: 67260 - DNA, 201 bp, Homo sapiens; identical to SEQ ID NO: 26113

SEQ ID NO: 67261 - DNA, 201 bp, Homo sapiens; identical to SEQ ID NO: 26378

SEQ ID NO: 67262 - DNA, 201 bp, Homo sapiens; identical to SEQ ID NO: 26115

SEQ ID NO: 67263 - DNA, 201 bp, Homo sapiens; identical to SEQ ID NO: 26381

SEQ ID NO: 67264 - DNA, 201 bp, Homo sapiens; identical to SEQ ID NO: 26383

SEQ ID NO: 67265 - DNA, 201 bp, Homo sapiens; identical to SEQ ID NO: 26385

SEQ ID NO: 67266 - DNA, 201 bp, Homo sapiens; identical to SEQ ID NO: 26386

SEQ ID NO: 67267 - DNA, 201 bp, Homo sapiens; identical to SEQ ID NO: 26387

SEQ ID NO: 67268 - DNA, 201 bp, Homo sapiens; identical to SEQ ID NO: 26648

SEQ ID NO: 67269 - DNA, 201 bp, Homo sapiens; identical to SEQ ID NO: 26649

SEQ ID NO: 67270 - DNA, 201 bp, Homo sapiens; identical to SEQ ID NO: 26471

SEQ ID NO: 67271 - DNA, 201 bp, Homo sapiens; identical to SEQ ID NO: 26650

SEQ ID NO: 67272 - DNA, 201 bp, Homo sapiens; identical to SEQ ID NO: 26475

SEQ ID NO: 67273 - DNA, 201 bp, Homo sapiens; identical to SEQ ID NO: 26651

SEQ ID NO: 67274 - DNA, 201 bp, Homo sapiens; identical to SEQ ID NO: 26652

SEQ ID NO: 67275 - DNA, 201 bp, Homo sapiens; identical to SEQ ID NO: 26654

SEQ ID NO: 67276 - DNA, 201 bp, Homo sapiens; identical to SEQ ID NO: 26057

SEQ ID NO: 67277 - DNA, 201 bp, Homo sapiens; identical to SEQ ID NO: 26391

SEQ ID NO: 67278 - DNA, 201 bp, Homo sapiens; identical to SEQ ID NO: 26754

SEQ ID NO: 67279 - DNA, 201 bp, Homo sapiens; identical to SEQ ID NO: 26756

SEQ ID NO: 67280 - DNA, 201 bp, Homo sapiens; identical to SEQ ID NO: 26694

SEQ ID NO: 67281 - DNA, 201 bp, Homo sapiens; identical to SEQ ID NO: 26759

SEQ ID NO: 67282 - DNA, 201 bp, Homo sapiens; identical to SEQ ID NO: 26228

SEQ ID NO: 67283 - DNA, 201 bp, Homo sapiens; identical to SEQ ID NO: 26334

SEQ ID NO: 67284 - DNA, 201 bp, Homo sapiens; identical to SEQ ID NO: 26695

SEQ ID NO: 67285 - DNA, 201 bp, Homo sapiens; identical to SEQ ID NO: 26335

SEQ ID NO: 67286 - DNA, 201 bp, Homo sapiens; identical to SEQ ID NO: 26336

SEQ ID NO: 67287 - DNA, 201 bp, Homo sapiens; identical to SEQ ID NO: 26697

SEQ ID NO: 67288 - DNA, 201 bp, Homo sapiens; identical to SEQ ID NO: 26699

SEQ ID NO: 67289 - DNA, 201 bp, Homo sapiens; identical to SEQ ID NO: 26572

SEQ ID NO: 67290 - DNA, 201 bp, Homo sapiens; identical to SEQ ID NO: 26573

SEQ ID NO: 67291 - DNA, 201 bp, Homo sapiens; identical to SEQ ID NO: 26704

SEQ ID NO: 67292 - DNA, 201 bp, Homo sapiens; identical to SEQ ID NO: 26430

SEQ ID NO: 67293 - DNA, 201 bp, Homo sapiens; identical to SEQ ID NO: 26705

SEQ ID NO: 67294 - DNA, 201 bp, Homo sapiens; identical to SEQ ID NO: 26706

SEQ ID NO: 67295 - DNA, 201 bp, Homo sapiens; identical to SEQ ID NO: 26707

SEQ ID NO: 67296 - DNA, 201 bp, Homo sapiens; identical to SEQ ID NO: 26252

SEQ ID NO: 67297 - DNA, 201 bp, Homo sapiens; identical to SEQ ID NO: 26312

SEQ ID NO: 67298 - DNA, 201 bp, Homo sapiens; identical to SEQ ID NO: 26313

SEQ ID NO: 67299 - DNA, 201 bp, Homo sapiens; identical to SEQ ID NO: 26444

SEQ ID NO: 67300 - DNA, 201 bp, Homo sapiens; identical to SEQ ID NO: 26177

SEQ ID NO: 67301 - DNA, 201 bp, Homo sapiens; identical to SEQ ID NO: 26178

SEQ ID NO: 67302 - DNA, 201 bp, Homo sapiens; identical to SEQ ID NO: 26421

SEQ ID NO: 67303 - DNA, 201 bp, Homo sapiens; identical to SEQ ID NO: 26629

SEQ ID NO: 67304 - DNA, 201 bp, Homo sapiens; identical to SEQ ID NO: 26630

SEQ ID NO: 67305 - DNA, 201 bp, Homo sapiens; identical to SEQ ID NO: 32566

SEQ ID NO: 67306 - DNA, 201 bp, Homo sapiens; identical to SEQ ID NO: 32670

SEQ ID NO: 67307 - DNA, 201 bp, Homo sapiens; identical to SEQ ID NO: 32568

SEQ ID NO: 67308 - DNA, 201 bp, Homo sapiens; identical to SEQ ID NO: 32369

SEQ ID NO: 67309 - DNA, 201 bp, Homo sapiens; identical to SEQ ID NO: 32452

SEQ ID NO: 67310 - DNA, 201 bp, Homo sapiens; identical to SEQ ID NO: 32259

SEQ ID NO: 67311 - DNA, 201 bp, Homo sapiens; identical to SEQ ID NO: 32370

SEQ ID NO: 67312 - DNA, 201 bp, Homo sapiens; identical to SEQ ID NO: 32029

SEQ ID NO: 67313 - DNA, 201 bp, Homo sapiens; identical to SEQ ID NO: 32112

SEQ ID NO: 67314 - DNA, 201 bp, Homo sapiens; identical to SEQ ID NO: 32578

SEQ ID NO: 67315 - DNA, 201 bp, Homo sapiens; identical to SEQ ID NO: 32113

SEQ ID NO: 67316 - DNA, 201 bp, Homo sapiens; identical to SEQ ID NO: 32433

SEQ ID NO: 67317 - DNA, 201 bp, Homo sapiens; identical to SEQ ID NO: 32633

SEQ ID NO: 67318 - DNA, 201 bp, Homo sapiens; identical to SEQ ID NO: 32508

SEQ ID NO: 67319 - DNA, 201 bp, Homo sapiens; identical to SEQ ID NO: 32510

SEQ ID NO: 67320 - DNA, 201 bp, Homo sapiens
acacatagattattctaagacatgcttgggaaagtaattttgaatgtaaaaagttttataatttattttctccttagggcaggtgtacattacatattagkgctcaaatatatgttcatttccagaatgaatttttgcacagtaatcatatatccatttaatatgtataaagtgttcttggggatgggggtatattcactc

SEQ ID NO: 67321 - DNA, 201 bp, Homo sapiens
agagtaaaaagtgtaattatatttccattgtaaatgtataccaagttttcttagctttctattctccaataacctctagaaactattctaagcatgcctgrtttctgtaacttaaatatggcataaaaacctgtttcctttgaattcacttgatagcagtagtcaatcactaataacgcttgctaatttcctcttactttc

SEQ ID NO: 67322 - DNA, 201 bp, Homo sapiens
tatactgtataaagtgttcatctacccagtactctgaagtcttaagaaaagtcaatgatatgtgtgtgtatatgtgtgtgtatatatatatatatatatayacacattagcaatttaagccttttaacatgccaattttttagatgctttattggttttttttcccctttactactacttcctgttttcccctttactact

SEQ ID NO: 67323 - DNA, 201 bp, Homo sapiens
caacttaaaagctggagatgtcattatcttgttgtgtaaatttgggtctatccctacctttacttctctgtgcctgattttcctcatctactttgaattcrtcattctattaatctacttttgcctaaagtgggaaactgaatatatcagaatgaaacatctatttttttcataaagaagatcatataatatgtgaaagaa

SEQ ID NO: 67324 - DNA, 201 bp, Homo sapiens
acaaaaaatatacatatgggcttttatgtgtgtgtgtacacacacacatacatatatacaaagctctgtagagatggctggtctccacagaaatacataaratatacatttttaagtttattttttaatttttctcaagattatggtataaagttttattttaaataacatacctattaacataccaccacatgggaccaa

SEQ ID NO: 67325 - DNA, 201 bp, Homo sapiens
agatgtcattatcttgttgtgtaaatttgggtctatccctacctttacttctctgtgcctgattttcctcatctactttgaattcgtcattctattaatcyacttttgcctaaagtgggaaactgaatatatcagaatgaaacatctatttttttcataaagaagatcatataatatgtgaaagaactttgaaaggatgag

SEQ ID NO: 67326 - DNA, 201 bp, Homo sapiens
ttggtgtctgtagccactgtgtaccacggtagaatactggacagtgctcgaagtgttttgtgaagattcattttcatcactgctagaaatgcttggcctaraagatgacatgcatgaagaccccccaataccactgctgtgtccttcagtattaattttttcctttttgaacaggtccaatgatttcagatcttctggaaa

SEQ ID NO: 67327 - DNA, 201 bp, Homo sapiens
ttgtaacatttatgatctgcatttggtagaatcttagtaaaagtttatctctgagttctaatactgtataacagagaaattatgtcagaacaaatataaayactgggtaaaatggaaaagctataaaaacataattgaactacacatttaaccttctaaaaaataaaaatgcaactctcagaagttttaagagttatttac

SEQ ID NO: 67328 - DNA, 201 bp, Homo sapiens
tgatcctccattctcattcctgtagattaagagttcatattgtatatctgaccctgaaatgtacaaacttcacactacaacattcttcatgacactatttrttatgaggaaagttgcagctaaatattagtcatgtgacttaaattttgagaaaatggaaaatgtaataggtataaatttcctgacacatacagcaagaca

SEQ ID NO: 67329 - DNA, 201 bp, Homo sapiens
acaaatttaagctgaagatatatactgtataaagtgttcatctacccagtactctgaagtcttaagaaaagtcaatgatatgtgtgtgtatatgtgtgtgwatatatatatatatatatacacacattagcaatttaagccttttaacatgccaattttttagatgctttattggttttttttcccctttactactacttc

SEQ ID NO: 67330 - DNA, 201 bp, Homo sapiens
caaatttaagctgaagatatatactgtataaagtgttcatctacccagtactctgaagtcttaagaaaagtcaatgatatgtgtgtgtatatgtgtgtgtrtatatatatatatatatacacacattagcaatttaagccttttaacatgccaattttttagatgctttattggttttttttcccctttactactacttcc

SEQ ID NO: 67331 - DNA, 201 bp, Homo sapiens
ccaagttaaagctctagaattccttttctccagtaataactcgcagcatcactaccaatggaagggacctaaggaataccgtgtacactgatatacacgargctgctcctcatttttttgtcagattacaaaagctgggctcatgtagttatggcctatggacctctttttaagttattttagcagaagtagatgatggtc

SEQ ID NO: 67332 - DNA, 201 bp, Homo sapiens
gattaagagttcatattgtatatctgaccctgaaatgtacaaacttcacactacaacattcttcatgacactatttgttatgaggaaagttgcagctaaayattagtcatgtgacttaaattttgagaaaatggaaaatgtaataggtataaatttcctgacacatacagcaagacaaatccagcccagcctttgatgatc

SEQ ID NO: 67333 - DNA, 201 bp, Homo sapiens
ctggattcatgctgactgcagttctgtttgaagtactgttgcctgggcaaaataccatcaccgccatctacatgatctactaattgtagatcttctggcckctcctctgaatctaacaagggctgggtagactcggatcttgagaagacttggactgacggaacttggtgtctgtagccactgtgtaccacggtagaatac

SEQ ID NO: 67334 - DNA, 201 bp, Homo sapiens
cattctcattcctgtagattaagagttcatattgtatatctgaccctgaaatgtacaaacttcacactacaacattcttcatgacactatttgttatgagraaagttgcagctaaatattagtcatgtgacttaaattttgagaaaatggaaaatgtaataggtataaatttcctgacacatacagcaagacaaatccagc

SEQ ID NO: 67335 - DNA, 201 bp, Homo sapiens
cctccattctcattcctgtagattaagagttcatattgtatatctgaccctgaaatgtacaaacttcacactacaacattcttcatgacactatttgttakgaggaaagttgcagctaaatattagtcatgtgacttaaattttgagaaaatggaaaatgtaataggtataaatttcctgacacatacagcaagacaaatc

SEQ ID NO: 67336 - DNA, 201 bp, Homo sapiens
gtccctcagtacctggaccaaaagcatctgctgcagaaacttcctgaaacattttcatttgcccagatccacaggattgtgaaatatgatctgaaatctgytgtttaagtctaacaaaatcttcctcattgactgatgaaacttgctttgacctttcaaaatgtgaaatatctggactggattcatgctgactgcagttct

SEQ ID NO: 67337 - DNA, 201 bp, Homo sapiens
cccagtactctgaagtcttaagaaaagtcaatgatatgtgtgtgtatatgtgtgtgtatatatatatatatatatacacacattagcaatttaagcctttyaacatgccaattttttagatgctttattggttttttttcccctttactactacttcctgttttcccctttactactacaatttaagcctttaaaaatggc

SEQ ID NO: 67338 - DNA, 201 bp, Homo sapiens
ttaggcatgccttcatcagtcgcagcctccatgccaactgtttcaaatctttctacttgtccctcagtacctggaccaaaagcatctgctgcagaaacttyctgaaacattttcatttgcccagatccacaggattgtgaaatatgatctgaaatctgctgtttaagtctaacaaaatcttcctcattgactgatgaaact

SEQ ID NO: 67339 - DNA, 201 bp, Homo sapiens
taatctgccaagttaaagctctagaattccttttctccagtaataactcgcagcatcactaccaatggaagggacctaaggaataccgtgtacactgatayacacgaagctgctcctcatttttttgtcagattacaaaagctgggctcatgtagttatggcctatggacctctttttaagttattttagcagaagtagat

SEQ ID NO: 67340 - DNA, 201 bp, Homo sapiens
aatttcctgacacatacagcaagacaaatccagcccagcctttgatgatcaacttaaaagctggagatgtcattatcttgttgtgtaaatttgggtctatmcctacctttacttctctgtgcctgattttcctcatctactttgaattcgtcattctattaatctacttttgcctaaagtgggaaactgaatatatcagaa

SEQ ID NO: 67341 - DNA, 201 bp, Homo sapiens
tgcttctatttccacaacacttacatcagtgaaattgccatctgaatacatttgatcttttgaattaaaattgtgctaaggaagagaaaaaattgtatatrgcaagtattagttaaagccacagagctaatgcatctctgaaacttcccagtaactctcagtggtacagaaataacctgtattatgtcactaagtcactgt

SEQ ID NO: 67342 - DNA, 201 bp, Homo sapiens
agtagtctaaatcaatattgttggtgttacattttgataagctaatggtctacaagtagtatttaatatttcatgcctagactaggcagcctaggattaastggacagaaaactagaaaacattaaggaaaatcaaacctgaatgacagagattttgtagaatataaaaatacataatacattttaatctgttaatataaa

SEQ ID NO: 67343 - DNA, 201 bp, Homo sapiens
gacacatacagcaagacaaatccagcccagcctttgatgatcaacttaaaagctggagatgtcattatcttgttgtgtaaatttgggtctatccctacctytacttctctgtgcctgattttcctcatctactttgaattcgtcattctattaatctacttttgcctaaagtgggaaactgaatatatcagaatgaaacat

SEQ ID NO: 67344 - DNA, 201 bp, Homo sapiens
ctctgccctggacctgtgacattctggactatttctgtgtttatttgtggccgagtgtaacaaccatataataaatcacctcttccgctgttttagctgargaattaaatcaaaaaaaaaaaaaaaaaaagactgcagttctctcctatagattcaattaaatctgacctatagattcaataaaatcccaatcaaaactat

SEQ ID NO: 67345 - DNA, 201 bp, Homo sapiens
tgataccccatctctactaaaaatacaaaaaattagctgggtgtggtggtgggcgcctgtaatcctagctactttgaaggctgaggcaggagtctgaaccrgggaggcagaggttgtagtgaactgagatcgcaccactgcactccatcctgggcaacaagagtgaaactctgtctcaaaatagatagataaataaaaatt

SEQ ID NO: 67346 - DNA, 201 bp, Homo sapiens
aaaaggaggatatagctggtacagggctaagaactttaggagctgctcaatgggcatgaggagtggcacgagtaggaataaactaaaaagtaaacaagccyaagatccctaaataccacacaaatcctcatctgcatttaaaagaggacttgttcatcaaattaatcactaattgggataattaacattggagatttttta

SEQ ID NO: 67347 - DNA, 201 bp, Homo sapiens
actaaaaagtaaacaagcctaagatccctaaataccacacaaatcctcatctgcatttaaaagaggacttgttcatcaaattaatcactaattgggataaytaacattggagattttttaaatgactgtcctgattaattttgaattttacttagtcttttacagtaaaaaatgtatgaaagtaatattgcagccatatac

SEQ ID NO: 67348 - DNA, 201 bp, Homo sapiens
taacaaaatcttcctcattgactgatgaaacttgctttgacctttcaaaatgtgaaatatctggactggattcatgctgactgcagttctgtttgaagtastgttgcctgggcaaaataccatcaccgccatctacatgatctactaattgtagatcttctggccgctcctctgaatctaacaagggctgggtagactcgg

SEQ ID NO: 67349 - DNA, 201 bp, Homo sapiens
cttgaagaaaaaaggttttaaaaattcctaaatcacaatgtagaactaagttccaccctacctcagaactgcagacattaaaataccatctctttattaartgtctctacaataatgatatttgctaagaacaagatgtacattttttggggttctgttttgttttggcaaatattgcccaagttgtcttagtgtgcctca

SEQ ID NO: 67350 - DNA, 201 bp, Homo sapiens
ctacgtgggaggctgaggtaggagaatcacttgaacctgggaggtggaggttgcagtgagctgagatcgcaccactgcactccagcctgggtgacagagckagactctgtctcaaaaaaaaaaaaaaaaaaaaaaaaagcaaaaaaaggagaagaagaagaaaacaccaaagaacaaggagactcaggagactgtgctagc

SEQ ID NO: 67351 - DNA, 201 bp, Homo sapiens
acctgggaggtggaggttgcagtgagctgagatcgcaccactgcactccagcctgggtgacagagcgagactctgtctcaaaaaaaaaaaaaaaaaaaaamaaagcaaaaaaaggagaagaagaagaaaacaccaaagaacaaggagactcaggagactgtgctagcagaaaaagtatggttagaaaacccaagggaggag

SEQ ID NO: 67352 - DNA, 201 bp, Homo sapiens
tctcggccttagcgccatttttttggaaacctcggcgccatgagagccaagtggaggaagaagcgaatgcgcaggctgaagcgcaaaagaagaaagatgargcagaggtccaagtaaaccgctagcttgttgcaccgtggaggccacaggagcagaaacatggaatgccagacgctggggatgctggtacaagttgtggga

SEQ ID NO: 67353 - DNA, 201 bp, Homo sapiens
aaaaggctttttgtcatttgcttctatttccacaacacttacatcagtgaaattgccatctgaatacatttgatcttttgaattaaaattgtgctaaggargagaaaaaattgtatatggcaagtattagttaaagccacagagctaatgcatctctgaaacttcccagtaactctcagtggtacagaaataacctgtatt

SEQ ID NO: 67354 - DNA, 201 bp, Homo sapiens
taaagtgggaaactgaatatatcagaatgaaacatctatttttttcataaagaagatcatataatatgtgaaagaactttgaaaggatgaggcattatatmaatgcaagaatataaaagataaacaggaagtctaatgtgaacaatattctgagagtaaaaagtgtaattatatttccattgtaaatgtataccaagtttt

SEQ ID NO: 67355 - DNA, 201 bp, Homo sapiens
catttaatatgtataaagtgttcttggggatgggggtatattcactcactgtaccatgttttatacaggcttcaacatgcaaatttgtttatatcatggcyttcaatgatcctccattctcattcctgtagattaagagttcatattgtatatctgaccctgaaatgtacaaacttcacactacaacattcttcatgacac

SEQ ID NO: 67356 - DNA, 201 bp, Homo sapiens
atttttttcataaagaagatcatataatatgtgaaagaactttgaaaggatgaggcattatataaatgcaagaatataaaagataaacaggaagtctaatstgaacaatattctgagagtaaaaagtgtaattatatttccattgtaaatgtataccaagttttcttagctttctattctccaataacctctagaaactat

SEQ ID NO: 67357 - DNA, 201 bp, Homo sapiens
attcactcactgtaccatgttttatacaggcttcaacatgcaaatttgtttatatcatggccttcaatgatcctccattctcattcctgtagattaagagktcatattgtatatctgaccctgaaatgtacaaacttcacactacaacattcttcatgacactatttgttatgaggaaagttgcagctaaatattagtcat

SEQ ID NO: 67358 - DNA, 201 bp, Homo sapiens
tttcataaagaagatcatataatatgtgaaagaactttgaaaggatgaggcattatataaatgcaagaatataaaagataaacaggaagtctaatgtgaayaatattctgagagtaaaaagtgtaattatatttccattgtaaatgtataccaagttttcttagctttctattctccaataacctctagaaactattctaa

SEQ ID NO: 67359 - DNA, 201 bp, Homo sapiens
tgcaaatttgtttatatcatggccttcaatgatcctccattctcattcctgtagattaagagttcatattgtatatctgaccctgaaatgtacaaacttcrcactacaacattcttcatgacactatttgttatgaggaaagttgcagctaaatattagtcatgtgacttaaattttgagaaaatggaaaatgtaataggt

SEQ ID NO: 67360 - DNA, 201 bp, Homo sapiens
caaaacaaaaaaaccccacaaagcaaaaacttcaacctacagctaacatcacatgtgatggtgaaagactaaatactttcacctctaaaattaggaacaawgcaatgctcttatatggtctagatgtactatatgtactagaggtcttagccagtgcattaagacaataaaaagaactaaaagcataaagattagaacaac

SEQ ID NO: 67361 - DNA, 201 bp, Homo sapiens
caacaggacttgacactcagcttatgtgagagaaaaatatacaaatacatttattgtaatcacatttaaatttatggctttggcatagaacgagggagggraaatgtatttgggaaggaaagagaagatggctaaagccatggacagagtttgaataggcaagtaagaaaacagggtcaagaggccgggtgcggtggctca

SEQ ID NO: 67362 - DNA, 201 bp, Homo sapiens
gcaggacacaaaactcaggaaccacagaaaaaaaactgataaaatgaacttcatcaaaataaaaaacttatgctttttttttttttttttttttttttttycagacactctgtcacccaggttggagtgcagtgatgtgatcttggctcactgcaacccatgcctcctgggttcaagcaattctcctgcctcagcctcccg

SEQ ID NO: 67363 - DNA, 201 bp, Homo sapiens
ctctatttactgtctacatagtccacaggttctcctttttctgatttacttatgcaaaatttcttcaactaagctgtaaggtcctcgttggcaagactcawgccatgtgaagaagccataatggatccatgagactacagatagagaattgaaaaaaggtaggttataaaataatactaagtataatttaattttaggaaa

SEQ ID NO: 67364 - DNA, 201 bp, Homo sapiens
aaaacaaaatgcccatgttggtcctctgccctggacctgtgacattctggactatttctgtgtttatttgtggccgagtgtaacaaccatataataaatcmcctcttccgctgttttagctgaggaattaaatcaaaaaaaaaaaaaaaaaaagactgcagttctctcctatagattcaattaaatctgacctatagattc

SEQ ID NO: 67365 - DNA, 201 bp, Homo sapiens
aggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttga

SEQ ID NO: 67366 - DNA, 201 bp, Homo sapiens
atgtataccaagttttcttagctttctattctccaataacctctagaaactattctaagcatgcctggtttctgtaacttaaatatggcataaaaacctgyttcctttgaattcacttgatagcagtagtcaatcactaataacgcttgctaatttcctcttactttctaagaaaacccctatatttagcatctgcttcca

SEQ ID NO: 67367 - DNA, 201 bp, Homo sapiens
tctacttttgcctaaagtgggaaactgaatatatcagaatgaaacatctatttttttcataaagaagatcatataatatgtgaaagaactttgaaaggatsaggcattatataaatgcaagaatataaaagataaacaggaagtctaatgtgaacaatattctgagagtaaaaagtgtaattatatttccattgtaaatgt

SEQ ID NO: 67368 - DNA, 201 bp, Homo sapiens
cgttaagactgcagttctctctcggccttagcgccatttttttggaaacctcggcgccatgagagccaagtggaggaagaagcgaatgcgcaggctgaagygcaaaagaagaaagatgaggcagaggtccaagtaaaccgctagcttgttgcaccgtggaggccacaggagcagaaacatggaatgccagacgctggggat

SEQ ID NO: 67369 - DNA, 201 bp, Homo sapiens
gctggatgtggtggcactggtcccagctacttgagaaactgaggtaggaggatcacttgagcccaggaggtcaaggctgcagtgtgccatgttcatgccaytgcactccactgtagcctgggcaacagagtaagaccctgcctccaaaaaaaaaaagtagaaaaaagatgaaaactaaaaagcatgcagtacatatgatga

SEQ ID NO: 67370 - DNA, 201 bp, Homo sapiens
atcttttgaattaaaattgtgctaaggaagagaaaaaattgtatatggcaagtattagttaaagccacagagctaatgcatctctgaaacttcccagtaaytctcagtggtacagaaataacctgtattatgtcactaagtcactgtcaactacccaaaatgcagatactataaaatgagtctaagtagtctaaatcaata

SEQ ID NO: 67371 - DNA, 201 bp, Homo sapiens
tagatttatgattttgacttttgaatagactatatacttttaaaaagctgctgctgcttctagttttaggtaactttgttttgtcttttttattataagawtggcttatgccagatctttaatgttgtaaaagtatccattgctcaccagccatataggagctggccagtagggtttgggcagcagcctttggtgtggagc

SEQ ID NO: 67372 - DNA, 201 bp, Homo sapiens
attttcaggtgtgacaacactcccaagaattttaagattttcctatgtgtcattgcaacaggagaattgaaaaagcaagagtacaaggggagttggaatarttcaggttaatatttactgagaaaaagtcatatatcgaagggaaaatgggagtaagtaagtctgactgccatagtcagacttactatgtgcatggagtag

SEQ ID NO: 67373 - DNA, 201 bp, Homo sapiens
tccatcccttttcaaatatgtgctcagtggcattgtctttttgtttgtttgtttgtttgtttgagacagtgtctcactctgttgcccaggctggaggactrtggcacaatcacagctcattgcagccttgacctcctgggctcaagtgatcctctcagctcagccttctgagtacctgggactacaggtgtgtgccaccat

SEQ ID NO: 67374 - DNA, 201 bp, Homo sapiens
agtcactgccttaacaccctgaagaagtaattcatcatgaaggttataccttcaaatcagaaaaacaaataaatgaaaatgtgtaacctttatatatcagyttctataacaaaatgataaagtcatgttttcttcctagtcatgtctcagtagatagccaaaggggttgttgatcttttctatttatttgtttgtttacct

SEQ ID NO: 67375 - DNA, 201 bp, Homo sapiens
gtgacagagggagacattgtctcaaaaaaaaaaaaaagaaagaaagaaagaaagaaaaaatgtgactcaaatatagcacaatgctaggattttataaaggkgagtattgggtacatgaaagtttattatctgtttgactacatttctcatgtttgaagtatttcattatgaagaataaaaatgatatatataaaatatata

SEQ ID NO: 67376 - DNA, 201 bp, Homo sapiens
acctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggctt

SEQ ID NO: 67377 - DNA, 201 bp, Homo sapiens
tgaagcaattttttttccctcttccattttcaccttcaactaaaacaagccttgactgggtaaacctgtatcaattgtcaaagcatatatctgtcaatcargagcaaagtgcacatttttcatggaaatgaaactaagtcttaactgtggtaaagtgtaaattggcagctagaaattacatttgaaagcacaattatggaa

SEQ ID NO: 67378 - DNA, 201 bp, Homo sapiens
cacctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggct

SEQ ID NO: 67379 - DNA, 201 bp, Homo sapiens
tattttctcttagaatggtttacattatgatgggggatggggagctgggggagggctgtacattcccaaaagaaagtagtgttataggaaatccaaatgcrcttcagtgattcactcctgaaaagcagcctgggtatgttggcagattttgtttgcatttgtcttgcgtatttaaagtctcaggaaatctagtcttggtcc

SEQ ID NO: 67380 - DNA, 201 bp, Homo sapiens
tcaaactcctgggctcaagtggtcctcctgcttcagcttcccaagtagctgggactacaggcatgtgccaccacccccagccaaaacatccatattttctmttagaatggtttacattatgatgggggatggggagctgggggagggctgtacattcccaaaagaaagtagtgttataggaaatccaaatgcacttcagtg

SEQ ID NO: 67381 - DNA, 201 bp, Homo sapiens
caaatttactttttattaaggatgtacctgtgcactattctaaagctaagcatttaaggataaagtccagaaataaaatgtccatattttcttttcttttytttttttttttttttttctgtcatctgtcacccagactggactgcagtggtgccatcatgtcttactgcagcctcaaactcctgggctcaagtggtcctc

SEQ ID NO: 67382 - DNA, 201 bp, Homo sapiens
atttctggtttctatttttatttgaaaggatatttttgttgtttttgtttattttctgtagcacaagcagctgtggcaatgaagggtgtgttcaaaaaaawttttttttttttgagacagagtcttgctctgtcgctcaggctggagtgcagtggcatgatctcagctcactgcaacctccgcctccccggttcaagcgat

SEQ ID NO: 67383 - DNA, 201 bp, Homo sapiens
tatatacagattaacattttgcaaactacctttttaatgttcatatacattaatatttaaacctaagacatcaaggctaactactaagcagagaaatgttrttcctggaagggatgtagtatttttggaaaatatcttaagtttatgcctgttaaatagtgtgtagttcttgaagtagcatgtgttaggcaattttttttt

SEQ ID NO: 67384 - DNA, 201 bp, Homo sapiens
aggtccactttggtctgtcgaccgtttagttcaggatctcagtgggaaaaaagatcactggttcccttctcatatagaatatatttatcagggacttaaakacaatagcatttctctctttataagtaggtaaatgtattaaatggaattgaattaagaatattaagacatggtgaatatattttatgctcacaagcagct

SEQ ID NO: 67385 - DNA, 201 bp, Homo sapiens
gactggggcagaagaaggagaaaataaactcgttttgagaaatttcatgtgatgagggttttttgttttttatgctcatgtatctggttctctttgctgcrttgactctaaaaatgaggttatccactttccaaaggacaagtttcagaataagacttgaggccacatgaattcttggacagtattttacttcttttactt

SEQ ID NO: 67386 - DNA, 201 bp, Homo sapiens
agattgttcaaaaagtttcaaatgacattccttactctttggttttcagaggcattcaagcaaaatatcacagtggtcttttgttttctgaccaatctaamaatacctgtgattaaatttaatttgttagtgtaaataaatttcttgccaatgagtattattgttgttagacaacgaatgcaataaaaagaaatactgagg

SEQ ID NO: 67387 - DNA, 201 bp, Homo sapiens
ctaaataatgaaatatgttgggggtgttccctaagcatcacactcattgataatttcaagacagtctttcagagaacccagcatcctgggctgtgagcagmatctcagaaaaattgagcccatgtagggcacgggatattatgtcactggaatcatgagtaactccaatcttgctgtgaataaagtggttttttgacccaa

SEQ ID NO: 67388 - DNA, 201 bp, Homo sapiens
ttagaataggaaaaatcttttgtaaattagaacacttaaaaaataagttaggacactggaagtcttagggaattaattctgccaaaatacaccttgcccarctcccatctttctgtaagctataaggagttgttcataatgaagaaacagacccctttaggcaacaacaaaatcagagaagagctgaagatttggggaata

SEQ ID NO: 67389 - DNA, 201 bp, Homo sapiens
tgatatggaaaggtttcaactctcaattaatcagcaactattttttttttttggcctaggctgacccgtttctcaaaattaaaagccactcatatttgggrtctgataaataagtgtttgtgggctggcaagtgtgggaacctaatgtccatttaaatcttgatttttgtataattaagttgtaaattatatatgtcttac

SEQ ID NO: 67390 - DNA, 201 bp, Homo sapiens
agccaaagtttcttttttggtccttagtttccttacctgaaaagtggaataatttctggcacatatggtttggtacatcacatgaaatatatatatgaagkgcccggttttgtgtctaatatatagtgctgactcagaattttataattcttaatgaggttaggaaaaaaaagaaaagaaatttaatgattaaatatctaa

SEQ ID NO: 67391 - DNA, 201 bp, Homo sapiens
ggaggtaatgcttttcagatgtatatggaaagttagattccaaggattaaaaaaaaatgaaattcttaaacaaattttggattccaagtccagattcaccrgctagttccaatgggtttgaggggatgacgtataatgtctgtgtttgataagactaaaagctttttgaaagtgtgtgatagccaagaggtaaacttttgc

SEQ ID NO: 67392 - DNA, 201 bp, Homo sapiens
acagctgggtgtggtggcttatgcctgtaatcccaggactttgggaggctgaggcaggtggatcacgaggtcaggagattgagaccatcctggctaacacrgtgaaatcccgtctttactaaaaatgcaaaaaattagccgggcatggtggtgggtgcctgtagtcccagctacttgggaggctgaggcaggagaatggca

SEQ ID NO: 67393 - DNA, 201 bp, Homo sapiens
atatgttgtagccccatcattacactgagatatttccatttgagtaactaaaggtactcctgacagagctggagatgaggggcattttggtgggcagtggycactagggttcacgtcacctacttaatgcaaagaccttagtggtctcagaatgaaaaggtaaaatggaagagaaaagcacagtcctttcctgtcttttca

SEQ ID NO: 67394 - DNA, 201 bp, Homo sapiens
ttatgtttttctgtctgtcttcattaggggtatgataatgaaactgccatattggatactctattaatgtcttgagatgtctggtgctttgttattttttmacatcatgagaaataagaagccactattaatgagtgatacaatttggcaaaacttttcaaatactaaaacactaaattagtaaaaatctggtaatattag

SEQ ID NO: 67395 - DNA, 201 bp, Homo sapiens
cagaaacgttgacatgaagtaacattgtgttttacagttatcaaagtcaccattatgtttttctgtctgtcttcattaggggtatgataatgaaactgccrtattggatactctattaatgtcttgagatgtctggtgctttgttattttttaacatcatgagaaataagaagccactattaatgagtgatacaatttggc

SEQ ID NO: 67396 - DNA, 201 bp, Homo sapiens
agaaagggagggaggaagcaaataagaaaggaaagaaggattttatgttattcctaatggatttctccacaaagtgaaatagactataagagtggtcaacrtggaataactgctgccaaaccctttctgcttctattgtgggcccaagagttcaatttattcagaaggaaattgacatttattttagaaagcatgtctgct

SEQ ID NO: 67397 - DNA, 201 bp, Homo sapiens
accagccaagttttgctgtaacctaactattaagaaggccctttcaaagatataaatgttttgtagctgagcccctgtttaaggagtctcccccatgtccycccctcctctgttccaggaccggccacaggccattagcaaaggagagccagagaagaaaactttgactctgactttccccctaaatctcccagactctca

SEQ ID NO: 67398 - DNA, 201 bp, Homo sapiens
atgtccaaataactgcaacactcatgggttacagagtgttttcgtgtacattgcctcagctggtcttctcagcgctcattgtaacatctcccagctacctytcattcaggaaataattaggcagtctccttttaactttgcatagtcctagccattaagagttgctttaggattgatctggaagaatttggcactttcttt

SEQ ID NO: 67399 - DNA, 201 bp, Homo sapiens
agagaggtcaggactgccaggtagatttgggagtccccattataaaggaagagatagtcaagtatcttattacagtgagattaaggagatgcagtccagtrcaagaccttaggatttggccatcaggagatcatttattatttgaaaatgaaaaccaggttgccacagcttaaagttgaggcacccaatctgggggctcag

SEQ ID NO: 67400 - DNA, 201 bp, Homo sapiens
tttaaagctttacaggatttattgcttattaaaagcattgggcctctgcaagtatagatagagtacaattatatcaacgctcagaagagagagagattgcrtccagctgaggttggtaaacaaaacctatccaaggaagtacaattagaatagccatcaaagcacttaagggaaaaaaagggtaggtaaggagggaatagc

SEQ ID NO: 67401 - DNA, 201 bp, Homo sapiens
ttttgtctttctgttcatgaaataggtttctaataagcatcagatggcatacccaaagggtttacttgaagagagtttaatacacagactttgaacagagktaatagtactaacaaggggtggtgaagtgcacagggactggcaacagcaggaggctgttaccatcaacatctgcagctttataagatgcacagccactgg

SEQ ID NO: 67402 - DNA, 201 bp, Homo sapiens
ctctcttatttccttgagcagtggtttgtagttctccttgaagaggtccttcacatcccttgtaagttatattcctaggtattttattctctttgtagcamttgtgaatgggagttcactcatgacttgcctctctgtttgtctattattgatgtataggaatgcttgtgatttttgcaacttgatttttttatcctgaga

SEQ ID NO: 67403 - DNA, 201 bp, Homo sapiens
ccaactcttttctccaaacctagcttctctgaagcccaaaaactccaacaggcatctcaggctctatttctattaaccagccctgttaaccttctatcccygcagtcagcgtgcctgaccattcttgcaaactcttggacctgtactttgaaaaggttattgattcttgacataaatctcttaaacatgtggaaagggaac

SEQ ID NO: 67404 - DNA, 201 bp, Homo sapiens
attcaagtaagtgttggaaatggaaggtccattataggaaatctaggaatcttaaattctcaccatcgggtttaaaactctatcattccttcagtatgaayttttccagaagtttcagattttcaaaagataaaactcaaaccaaccaaatcctttagggtgcttttctgtatgaatcatctttctgcaaagaggtgtaag

SEQ ID NO: 67405 - DNA, 201 bp, Homo sapiens
tgaaggaaaagtgcaccttatttgacctcagctgggaacgtgcccattgggcaactcaaagtttttgtcactctgacctgtcagcaaatgccaaaaaagcyctacagatttgaggtaacaaataagttttagcaagtgggcaacttttcaaatattgaaatccacgaataatgagaattgactacaagtagttttgccaaa

SEQ ID NO: 67406 - DNA, 201 bp, Homo sapiens
cattactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctca

SEQ ID NO: 67407 - DNA, 201 bp, Homo sapiens
gcattactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctc

SEQ ID NO: 67408 - DNA, 201 bp, Homo sapiens
gctctggttaccctaacaggagttggcgattttctgaattgtgtcaataccacatttacaaatcattttttttcatatctgagggacatcagtggaaattrggatggagaagtcccattataactggctaaatgataagcatctaacggaatatcaaattagaggaagtaaaagatttttttctagagatttgtaaaacag

SEQ ID NO: 67409 - DNA, 201 bp, Homo sapiens
aagaaattgttgatcgtgtgcaactgtttgagttgcattactttttagcacaagaagaatagcatcactaccaaaaccagctgagatatcttattttattwatttatttatttatttatttatttatttatttatttagatagagtctcactctgttgcccaggctggagtgcagtggcatgatcttagctcttggcaacc

SEQ ID NO: 67410 - DNA, 201 bp, Homo sapiens
gctacagtagcagtgttgagtcgttgtgacagagactgtgtatctcacaaacctaaaatattttactctgtggcccctgaaaggtaaagaaagcttcctgwtgcctggtctagaagtatattttcttatactcaaaattgctggataaactctgaaaatggcttcatcattggttgccatttatctagaatttttaaaaag

SEQ ID NO: 67411 - DNA, 201 bp, Homo sapiens
cagctagaatagttcacgtctttgtctcctgaattctttatattgttgtaattcaaaatattttgtctattcattcagtgaactaaccaagagcattatcygtattgtcatatttcatgatggtgcttttgatattcagctattggttttacttagtgggaaataatgaacgtacaagtaattgtttctgtaggtcttagg

SEQ ID NO: 67412 - DNA, 201 bp, Homo sapiens
tttagatttctctaatggctaatgattttgcatctttttattgcctttttttgcaatcatatgtgtatcttattttgtgaaaaatttgcttaaatattttytgattttttaaaaattaagttgttttcttactgttttaagagttatttattctgaatataagtaatatatttattctgaatattttgttgaagtccgctt

SEQ ID NO: 67413 - DNA, 201 bp, Homo sapiens
cccactgatttcttggttatttcttggttacaggctgtcatggtggtcacctgatccttacctgatgttactggttaccttgagattttatcagtgtctgyggtctcttcatcagttctctccaaaggtttctctcactgattatctttcaatattcttagacttgaatgaagcagtcccagagacagagcgcctggattc

SEQ ID NO: 67414 - DNA, 201 bp, Homo sapiens
tattttattgaggatttttgcatcaatgttcgtcagggatattggtctaaaattctctttttttgctgtgtctctgccaggctttggtatcagggtgatgyttgcctcataaaatgagttagggagaattctctctttttctattgattggaatagtttcaaaaggaatgggaccagctcctttctgtacctctgatagaa

SEQ ID NO: 67415 - DNA, 201 bp, Homo sapiens
tttgtattatagagcatacaatccaaatatgagctagataaggcataaaacgtgcaagtactacatacagtgtttctaattatattacagctttcatctaygtggtgttccacattttatatttaagcaagagcttataagattgactctctcccagttatcacaactaatgaactcttaatgggcagctacaaatataga

SEQ ID NO: 67416 - DNA, 201 bp, Homo sapiens
ttcagtatgatactggctgtgggtttgtcataaatagctcttattattttgagataggttccatcaatacctagtttattgagagtttttagcatgaaggsctgttgaattttatcgaaggccttttttgcatctattgagataatcatgtggtttttgtctttggttctgtttacatgctggattacatttattgatttg

SEQ ID NO: 67417 - DNA, 201 bp, Homo sapiens
actagagtaatcatggtagcgcattaattagttatgtaaatgagggcatgctactcaagttctctgagcttcaggagagaaaaaaaatacttgattggtayctcatggggctgttgtaaggaacaaatgagatagagtatgtggcatgatttgtattatagagcatacaatccaaatatgagctagataaggcataaaacg

SEQ ID NO: 67418 - DNA, 201 bp, Homo sapiens
gtcatctgcaaacagggacagtttgacttcctcgtttcctaatcgaataccttttatttctttctcttgcctgatttccctggccagaacttccaacactrtgttgaataggagtggtgagagagggcatccctgtcttgtgccagttttcaaagggaatgctttcagtttttgcccattcagtatgatactggctgtggg

SEQ ID NO: 67419 - DNA, 201 bp, Homo sapiens
gtgaagtttacttccagacttgagattgaccttccagaaggagaataggcttctgaagcctgagctctattcactctctgtcacagattaactgtgtggtrcaagttaatacacaaattgaccttctttaagcctcagttttcttatatgagaaataagctgggaccagaatcccaaggttattttgagttgtaatattag

SEQ ID NO: 67420 - DNA, 201 bp, Homo sapiens
tttttccaattctgtgaagaaagtcattggtagcttgatggggatggcattgaatctataaattaccttgagcagtatggccattttcatgatactgattyttcctatccatgagcatggaatattcttcaatttgtttgtgtcatcttttatttcattgagcagtggtttgtagttctccttgaagaggtcgttcacatc

SEQ ID NO: 67421 - DNA, 201 bp, Homo sapiens
tgttacaagttgctgtgattattacagagaagagtttctttttttaatttaatttaattttttttaattatactttaagttctagggtacctgtgcacaaygtgcaggtttgttgcatatgtatacacgtgccatgttggtttgccgcacccattaactcatcatttacattaggtatttctcctaatgctatccctcccc

SEQ ID NO: 67422 - DNA, 201 bp, Homo sapiens
gtcaaaaataacgtcaatctagtgaaaaaaactgtatgactcacagtattactgtagggaactggtctctgtgtaatatgatatatagcatcctaatttcwtagagcatttttcataacagctgctaaaatcatcaaatccattaaattcttttaaaggatccaatttgtagcagtattgaaaatagtcttaaaatgcagg

SEQ ID NO: 67423 - DNA, 201 bp, Homo sapiens
gctggagttcagtggcatgatctcggctcactgcaaccactgcctcccaggttcaagcgattcttctgcctcagcctcctgagtagctgggactacaggcrcgtgccaccatgcccggctaatttttgtatttttagtagagatgggatttcaccatattggccaggctggtcttgaatccctgacctcatgatccacccg

SEQ ID NO: 67424 - DNA, 201 bp, Homo sapiens
acgccatcacacctggctaatttttgtatttttagtagagacagggtttcaccatgttgttgaactcctgacctcatgatctgcccacctcggcctcccaragtgctgagattacaggcatggcatgagccactgtacccggcctctttccagtttttctatgcaactatatgcatatgtttaccactagaaaatgtattt

SEQ ID NO: 67425 - DNA, 201 bp, Homo sapiens
tcgagaaatatgagttgacggtttcaaggtacaaagttcgcaggaaaataaagcaccatgagtaaaaaacagcagaaaatagaagaaagggagggaggaaragaaaaaaaagagaagaaagaaaataaatataaggtcaaaatcattttattatcaattataccaaactagaacaaatatctccaattgcatataacttat

SEQ ID NO: 67426 - DNA, 201 bp, Homo sapiens
ctactagagtggtttcataagcagctgagtcatattacctattcacgagcaatgtatgagggttccaatttctttacatcctcatgagcgcttgtttttakctctttgattattgagtgggtatgaagtatttcattttagttttggtttgcatttccctggtggctaatgatgttgaacatttttttcatgtgcttattg

SEQ ID NO: 67427 - DNA, 201 bp, Homo sapiens
gtgatttaagttaacataaaatggtatgcatatgtgtgtgtgttcgtttgtttgtcagcgattcctctctgtattgcaattaacccacaagtactgctccsgattctttcaaaggggaattctatattcttgtccagggtaagcatattatgagagaagagaagaggacaagaactttggagcccactatacagaggtgca

SEQ ID NO: 67428 - DNA, 201 bp, Homo sapiens
gctggttcttagcaaagatcgatatttttgataagcctctaaccaggctaagaaaaaaagagagatgacacaaattagtaatattaaaaatgagagagaamaattcactgtggatggcatgggcactaaaaggacaataaaagaatattatgagcccctctgtgcccacaagtttgacaaccaagatgaaatagaccaatt

SEQ ID NO: 67429 - DNA, 201 bp, Homo sapiens
ccactgcacctctgactcctgggttcaggcgattctcctgcctcagcctcccgagtagctgagactataggcatgtgccaccacgtctggctaattttttrtatttttagtggagacggggtttcagtgtgttagccaggatggtctcgatctcctgacctcgtgatccacctatctcagcctaacatgttttattcttaa

SEQ ID NO: 67430 - DNA, 201 bp, Homo sapiens
tacggcattgtttattatgttggattttagttctttggtgagtcatgcataatacattatctgttatatttaacatgttttattcttttttttttttttttgagatgaagtctcgctctgtcacccaggctggagtgcagtggtgtgatctcggcccactgcacctctgactcctgggttcaggcgattctcctgcctcag

SEQ ID NO: 67431 - DNA, 201 bp, Homo sapiens
atggaataactagaagaaaatacaggggttacaactagaaatagagaacagagagggcttcaaaagtaataattttatagtttaggcttgatggaggtacrtggttgtctttttttttttctttcttcatatgagttacatatatggtatacatttttatataaatgttttagactagaaactttaaaataattaaaaggt

SEQ ID NO: 67432 - DNA, 201 bp, Homo sapiens
ggtagcttgaagctgttcttttagctttgctgcagatttataaaatgttcaacatttccatttacctctggacaggctgtagttttttttgttttttttttgttttttttttttttaaggattaagatccttgaagctagaggtctttgaaactgcatctgagtggaagaggtctagtgtaaagtgactcattcttaaaca

SEQ ID NO: 67433 - DNA, 201 bp, Homo sapiens
tatggcttaaattaatctgaattctaatttaccttttaccttgagcttggctgctgttttcaatttatatgcattttatacattaactgctaccctcaatytcctgtcaactttgtagtaagtgatactctgtcaaatgctactctatgatgcatttaaataaagataaaaggtcaatctaggcttttctaaagttaccat

SEQ ID NO: 67434 - DNA, 201 bp, Homo sapiens
ggggcaccttccagatgccagtcagatctctcctgtatgaggtatctgtcgacccctgctgggaggtgtctcccaatcaggaggtacaggggtcagcaacscacttgaggaggcaatctgatgcttagcagagcttaagcactgtgctgggagactccctgctctcttcagagctggcaggcaggagtgtttaagtctgct

SEQ ID NO: 67435 - DNA, 201 bp, Homo sapiens
cagtgcctttttttatttctctaagtgtgtacttcatttccagaagttgtaattgtttttctttatggtatctgtttttctggagcatttttcatccatayactgtattttttccttaatttctttaagctggttttcatctttctctggtatctacttgagtagtttagtaatcaaccttctgaattctttatctggcaa

SEQ ID NO: 67436 - DNA, 201 bp, Homo sapiens
attgatacttgtgtatgcttcacgaagttctcgtgctgtgttttttagctccatcaggtcatttatgttcctctctaaactggttattctagttagcaatwcatctaaccttttttcaaagttcttagcttctttgcattgggttagaacatgctcctttagcttggaggagtttgttattacccatgttctgaagcctac

SEQ ID NO: 67437 - DNA, 201 bp, Homo sapiens
cactgtgtgtatctctttctgtcattatttatccataaattccccccattagcctgtaatctcttcaatgacaggtttcaatgggcttttgcttgctacarcattttaattgtcttgagagtccatgaatttgcaagaagaccctatctctatcacactaaaccacaatcttcttcatgtaaaaccagaaaaaaaaacaaa

SEQ ID NO: 67438 - DNA, 201 bp, Homo sapiens
cactgcaagctccgcctcccgggttcacgccattctcctgcctcagcctcccaagtagctgggactacaggcgcccgccactacgcccggctaattttttrtatttttagtagagacggggtttcaccgttttagccgggatggtctcgatctcctgacctcgtgatccacccgcctcggcctcccaaagtgctgggatta

SEQ ID NO: 67439 - DNA, 201 bp, Homo sapiens
gtcctgttgaaatgaaattaagggttgatggcagtaggatatttggcaggtaaataaatggaaacatacatgatgtttgtagaacagaaggctcactgtcyttcagatgtgaaatttccccatattgatctgtagagtcaaagaaatcccaatcaaactctagcaggttttttgttgttcttgttgtttttggagaaattg

SEQ ID NO: 67440 - DNA, 201 bp, Homo sapiens
aagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggct

SEQ ID NO: 67441 - DNA, 201 bp, Homo sapiens
gttttaaaattaaaagaaaatgttttattataaaagaaagaatatgcttagtaaaatttaaatctgtattatttaatgttacattatgaaatacattaagktaattattttaatataaaagcatgtttgttttagaaaatacagaaataaactttttttgtagccccactacccagtgttaattattacactattacgatt

SEQ ID NO: 67442 - DNA, 201 bp, Homo sapiens
gaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggc

SEQ ID NO: 67443 - DNA, 201 bp, Homo sapiens
tcctggtttagacttgggagagtgtatatgttcaggaatttatccatttcttactagagtttctagtttatttgcatagaggtgtttatagtattctctgrtggtagtttgtatttctgtgggagatcagtggtgatatcccccttatcatttttgttgtgtctatttgtatcttatccctttttttctttattagtctgg

SEQ ID NO: 67444 - DNA, 201 bp, Homo sapiens
tgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttggg

SEQ ID NO: 67445 - DNA, 201 bp, Homo sapiens
gaagctaaaagaattcattacctggagaatactattataagaaatgtcaggggaagtctttaataatgtaaataatataaaacgaaattctagacctacasaaggaaatgaagagaaatagaaattatgtgggtaaatataggctacttcattttttaaaaaattatttaaaggattattaactttttaaaacaaaggaca

SEQ ID NO: 67446 - DNA, 201 bp, Homo sapiens
ttgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgg

SEQ ID NO: 67447 - DNA, 201 bp, Homo sapiens
catttctcaaaataagacatagaaatgactgatatatgtgaagatgctcaacatcagtaatcatcagagaaatgcaaaataaaactgtactaagatatccrcttaccccaattagaatggctgttattaaagagacaaaaggtaacagacgctgacaaggatgtggagaaaaaggaactcttacacaccactgctggggat

SEQ ID NO: 67448 - DNA, 201 bp, Homo sapiens
gttgctggaaaaaaatcaagtcctgttgaaatgaaattaagggttgatggcagtaggatatttggcaggtaaataaatggaaacatacatgatgtttgtaraacagaaggctcactgtctttcagatgtgaaatttccccatattgatctgtagagtcaaagaaatcccaatcaaactctagcaggttttttgttgttctt

SEQ ID NO: 67449 - DNA, 201 bp, Homo sapiens
attattctttctgttgatttcatggagatatacaatgcctagctttggaggagttaaaaattggtgcctgagatatcctacttagcccactttactgtacracccctttcttcacacttctttttgtaggaacgacaggaatagtaggcagtaagccatactaactaaagcaattttaattgtttttctacctttgactaa

SEQ ID NO: 67450 - DNA, 201 bp, Homo sapiens
tcaacccaacaacaacagtgtaacaaatgggtaaaagaaatgatttgacaatttgtggaagtagacaggtgacttacaaacatatgaaaaaatgtttaccygcactagtaatcagtgaaatgcaattgaaatcacattgtaatatctttttacagctgtatgattggcagtacttaaaggatctgagcataccaagtattc

SEQ ID NO: 67451 - DNA, 201 bp, Homo sapiens
attagattctgcatttatttaggttattcgcctaaaaaacctggtttccatactgcaaataaatgacaggaacttttccactagattatcccagacagcasaaatgttctttccaaaagtggagcctggaaccacagccccctcacattgcctgttacatctgtttatgcttatagaagtgacatccacttcgtagacaga

SEQ ID NO: 67452 - DNA, 201 bp, Homo sapiens
ctaaagattgtcacttgattcacatgtattcaggactcataaaactaagtcaccatacttagaaatggtttcatgctattacggtgtctgtcagaattagsaggcaatatctcattataggaaattttaagtatattagtgattttttaaaaaatgtaaaattttgaaattttataatatataatatattataaaatatat

SEQ ID NO: 67453 - DNA, 201 bp, Homo sapiens
cacactgcaatcacatggcattaaaaaatatattgtgtatggaacttggcgaggtcagtcaggacctggagctgtaatcatagccttattgccacttcttkcgttgtgtatacattgaatggctcatagattttaagagatttttttattgtaagtatttctactaaatgcacttatccttctatatgtttatatattttg

SEQ ID NO: 67454 - DNA, 201 bp, Homo sapiens
taaagaaaacagtcgtctcctgttttcagtcatcagattcaagcctattaggaaaaacttgaataattattcttacacgtctccattaatatgaagaatcrtgcataaaatgtagtccatgcttatctctaaaataaacaaggaaataaaatttccgggttctgttagttgttagaaaacatggtaactcaacttgttatt

SEQ ID NO: 67455 - DNA, 201 bp, Homo sapiens
tttttaaaattgatatataatagttgtatacattttgggggtatatgtgatattttgatacatgtatacaatccctagtgatcaaatcagggtaactgagrtatccatcacgttatactttcatctttccttgtgttgggaacattccaattcttctcttctagctattttgaaatatacaataaattattgtttactata

SEQ ID NO: 67456 - DNA, 201 bp, Homo sapiens
tctactcctacactagtaataacaattattgtatgtttacaaaactttaaattttctcttatatctagctgctctcccccaatactatttttattaaaaawtttttagtttgttagtgtgtactttttccaggcaaacttaaacttttttgtcatatttcaaaataaaaatagtatttgttcattattttgtgagaatcca

SEQ ID NO: 67457 - DNA, 201 bp, Homo sapiens
tttgaagatgcccacacagggaagacgttgggcctaccagcagccagcactaacttaaccagacatgtggggaggcacctttgaagatcttccagccttastaaagcattcagatacctgcagcttcagctaacaactggttgaattttgtgagaatcaccaagccacaattgaacagacaagccttccttgaattcttga

SEQ ID NO: 67458 - DNA, 201 bp, Homo sapiens
attacccattgcttgtttttgtcaggtttgtcaaggatcagatggttgtatgtgtggcattatttccgaggcctctgttctgttccattggtctatatatytgttttgggtagcagtaccatgctgttttggttactgtagccttgtagtatagtttgaagtcaggtaacatgatgcctctagctttgttctttttgctta

SEQ ID NO: 67459 - DNA, 201 bp, Homo sapiens
aaatggtatttctagttctagatccttgaggaatcaccacaatgtctttcacagtggttgaactaacttacactcccaccaacagtgtaaaagtgttcctrtttctccacatcctctccagcatctgctgtttcctgactttttaataattgccattctaactagcatgagatggtatctcattgtggttttcatttgtat

SEQ ID NO: 67460 - DNA, 201 bp, Homo sapiens
tgtccctgcaaaggacatgaacttatcctttttatggctgcatagtattccatggtatatatgtgccacaatttctctatccagtctgtcattgatgggcrtttgggttggttccaagtctttgctattgtgaacattgctgtaataaacatacgtgtgcatgtgtctttttagtagaatgatttgagtatatacccagta

SEQ ID NO: 67461 - DNA, 201 bp, Homo sapiens
tacataggtatacatgtgccatggtggtttgctgcacccatcaacctgtcatctacattaggtatttctcctaatgctatccctcgcctaaatccccaccygctgacaggccctggtgtgtgatgttcccctccctgtgtccatgtgatctcattgttcaactccaaattatgaatgagaacatgtggtgtttggttttct

SEQ ID NO: 67462 - DNA, 201 bp, Homo sapiens
tctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatctta

SEQ ID NO: 67463 - DNA, 201 bp, Homo sapiens
ggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatct

SEQ ID NO: 67464 - DNA, 201 bp, Homo sapiens
tggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatc

SEQ ID NO: 67465 - DNA, 201 bp, Homo sapiens
tctctctggctgcccttaacattttttccttcatttcaactttggtgaatttgacaattatgtgtcttggagttgctcttctcaaggagtatctttgtggmgttctctgtatttcctgaatttgaatgttggcctgccttgctagattggggaagttttcctggataatatcctacagagtgttttccaacttggttccat

SEQ ID NO: 67466 - DNA, 201 bp, Homo sapiens
agtctagctgcttgggtgtcatgcttgacaggggttaaaacttgaagttccttatctcttaaacatttttatgtttctgagttcaatcctgttaagattaytgacaacattcttggaagactgtgtcctaaggaaggaagaattttgaaaataaatgattttgctagatagaatgggagaaaagaaattcttggagtacat

SEQ ID NO: 67467 - DNA, 201 bp, Homo sapiens
ttcaagagaaaattagctgcaattaagaaccttctttttattgtaaacatattgagtgttaatattctttggttctagtttatttctaaacaaaaacctgygtgccatagaagtagaattttagatcttttattttctatgtaaaggttgatttcttaactttattcatgttgaatttcatattattctatttaatttatc

SEQ ID NO: 67468 - DNA, 201 bp, Homo sapiens
ctagacacaggtccatactatataaaacaaaaagggttcagttagtgtattttgatgcttttcttgtcaaaagtgatggatttgtagaaattctcttaatrtacatacagaattaaaataatcgcatatttttaattttaggcctcatgtgtactaagaaaatcttgtccattctgaataatgtgaatttacacaattcat

SEQ ID NO: 67469 - DNA, 201 bp, Homo sapiens
gtgaggtactattttattcatcacactagttattgcctgaatactttgtttgtttgtttgtttttgtttgtgtgtgtgtgtgtgtctgtgttgtgttttgktttttttttttttttgagacagaatctcactctgttgcctaggctggagtgcagtggtgcaatctcggctcactgtaacctctgcctcctgggttcaagt

SEQ ID NO: 67470 - DNA, 201 bp, Homo sapiens
gtagcttgaagctgttcttttagctttgctgcagatttataaaatgttcaacatttccatttacctctggacaggctgtagttttttttgttttttttttkttttttttttttttaaggattaagatccttgaagctagaggtctttgaaactgcatctgagtggaagaggtctagtgtaaagtgactcattcttaaacat

SEQ ID NO: 67471 - DNA, 201 bp, Homo sapiens
agaaaacaaattaaaatgcttgaatcacatgatttaccaaaccagttaaacacaaatccagaagcaagaggaaagctatggagtaagttaacacacttcargttcaaaccaggttggaaggaccacgctacctgtcctggataaacaatgttcctatgtcccatctttctttcacataacccttccccattaatgatgtgg

SEQ ID NO: 67472 - DNA, 201 bp, Homo sapiens
aaactcaaattcactctatctcaattaccatgttttctacatagcattcatttactgatcctcttctgatcctctccacctggttattgactttcttttgsgttttctactgtattgattcctgtctagtctgtatgataatttgaatatgaaagtaatgatctgtgactttttaggctaggttataaaaggcactgtggc

SEQ ID NO: 67473 - DNA, 201 bp, Homo sapiens
ttctaacttcttgaaaccaatgctgaatttattgtcatacttgattgtttaaatatgagagcagttaaaattatgaacctgtctcttattatgcctttggscacatctcgtttcaacgtgcattcttctcattttcatcacttcataaatagtctatattttttatttttactttcattttctctttgacttgaacaattg

SEQ ID NO: 67474 - DNA, 201 bp, Homo sapiens
attctaacttcttgaaaccaatgctgaatttattgtcatacttgattgtttaaatatgagagcagttaaaattatgaacctgtctcttattatgcctttgsccacatctcgtttcaacgtgcattcttctcattttcatcacttcataaatagtctatattttttatttttactttcattttctctttgacttgaacaatt

SEQ ID NO: 67475 - DNA, 201 bp, Homo sapiens
agtagataccgtatactgtggtatgactggtgacctgttggatgtcgctgtcctgtagtcattggttaaatatactcctgatgacagatgggtacatgcayttcatccagctttgctgctgcacgttgtcatggtgaaggggaaggacacactacaaatgatgattccttcccacagactacagtccatatcttaacaaag

SEQ ID NO: 67476 - DNA, 201 bp, Homo sapiens
ttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcct

SEQ ID NO: 67477 - DNA, 201 bp, Homo sapiens
acagttactggctcagtgcctacccatagtgcatagtcagtcttccattaatgttttgaatagaaatcaaccagatgagctagcattaaagtttggattcmgaattttcatttatcaattgcagaaatataggtaattataagataactgcatcctgaagtaatttatatccagatataaatgtacgtgatcagtttgatc

SEQ ID NO: 67478 - DNA, 201 bp, Homo sapiens
tttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcc

SEQ ID NO: 67479 - DNA, 201 bp, Homo sapiens
ttttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttc

SEQ ID NO: 67480 - DNA, 201 bp, Homo sapiens
tgtgaggtactattttattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaag

SEQ ID NO: 67481 - DNA, 201 bp, Homo sapiens
gcagtgggtggtactggttgttcctttccatgtttaatgcttccttcaggagctcttgtagggcaggtctggtggtgacagaatctctcagcatttgcttktctgtaaaggattttatttctccttcacttatgaagcttagtttggctggatatgaaattctgggtttaaaattcttttctttaagaatgctgaatattg

SEQ ID NO: 67482 - DNA, 201 bp, Homo sapiens
tcagttctttaaggatactagcaagtacccaggggttacatcagttcatggggttttaaaatcacagatactcacagaggaatgagagatacaggatacarcttcagcaggggcacagccaagcctcatgggaaactgaaaaatattcttcaaaatatccctgaatctggtgatttgccactgtagagacgtaggtgtctt

SEQ ID NO: 67483 - DNA, 201 bp, Homo sapiens
caggtaatgtgatgcctccagatttgttctttttgcttattcttgctttggctatgcaggctctttttttgttccatagaaatttttaggattttttttttctagttctgtgaagaatgatgatagtgttttgataggaattgcattgaatttgtagattgcttttggcagtgtggtcattttcacaatattgattctacc

SEQ ID NO: 67484 - DNA, 201 bp, Homo sapiens
ttattttagaatatatgtttgtaaatatgcgtgtgtgtgtgtgtgtgtgtgtgtgtgtatatgtatatgtccacatatgtttgtatttatatatgtgtatsttaacaaagtctacagttattcaatattcttactctccttgtgaaccatttaggtcatttttgttattctgcttcttgtgtttacaaaattgctcgtatt

SEQ ID NO: 67485 - DNA, 201 bp, Homo sapiens
ctttccaattaccccaacaccttttgttgaatagggtatcctttccccacttcatgtttttgtttgctttgtcaaacatcagttggctgtaaatatttggstttatttctgggttctctattctgttccttttttctacatgcctatttttataccagtaccatgctgttttggtatagccatgtagtataatttgaagtc

SEQ ID NO: 67486 - DNA, 201 bp, Homo sapiens
atttttaaaattgtttattctgttattttagaatatatgtttgtaaatatgcgtgtgtgtgtgtgtgtgtgtgtgtgtgtatatgtatatgtccacatatrtttgtatttatatatgtgtatcttaacaaagtctacagttattcaatattcttactctccttgtgaaccatttaggtcatttttgttattctgcttcttg

SEQ ID NO: 67487 - DNA, 201 bp, Homo sapiens
ccagcactaacttaaccagacatgtggggaggcacctttgaagatcttccagccttactaaagcattcagatacctgcagcttcagctaacaactggttgrattttgtgagaatcaccaagccacaattgaacagacaagccttccttgaattcttgactcacagaaactatggaagatagtaactgtttataagttttgg

SEQ ID NO: 67488 - DNA, 201 bp, Homo sapiens
attttttaatgttaagtatgtagtaaggtatattaatctagctctcaatatagaaaggaaaaatatgtaagaatatgcagttacaaataaggagcaagagyttggttgtctaggacttttaactcttaactactgtcagcaaactagtgaaagtggctggagttaaatttaccactacatgctcatcgaaatcaagttaaa

SEQ ID NO: 67489 - DNA, 201 bp, Homo sapiens
ccactagcagggagcttagttatttttaaaattgtttattctgttattttagaatatatgtttgtaaatatgcgtgtgtgtgtgtgtgtgtgtgtgtgtgkatatgtatatgtccacatatgtttgtatttatatatgtgtatcttaacaaagtctacagttattcaatattcttactctccttgtgaaccatttaggtca

SEQ ID NO: 67490 - DNA, 201 bp, Homo sapiens
tcgatatgatattggctatgggtttgtcataaatagttcttattattttgagagatgtgccatcagtacctagtttattgagtgtttttatcatgaagagktgttgaattttatcgaaggccttttccacatctattgagataatcatgtggtttttgtcattcgttctacttatgtgatggattatgtttattgatttgc

SEQ ID NO: 67491 - DNA, 201 bp, Homo sapiens
aagagactcacctaacacataaagactcacataaacttaaagaagcagaaaaaggcatttcatgcaaatggacaccaaaagcgaggagtagctattcttayaaaagacaaaactttaaagcaacagcaattaaaaaaaagacaaagagggacattatataatggtaaaaggctttgtccaacaggaaaatatcacaatcct

SEQ ID NO: 67492 - DNA, 201 bp, Homo sapiens
tccactagcagggagcttagttatttttaaaattgtttattctgttattttagaatatatgtttgtaaatatgcgtgtgtgtgtgtgtgtgtgtgtgtgtrtatatgtatatgtccacatatgtttgtatttatatatgtgtatcttaacaaagtctacagttattcaatattcttactctccttgtgaaccatttaggtc

SEQ ID NO: 67493 - DNA, 201 bp, Homo sapiens
gtttcaaaagggaaacagaataaaagtttggaaaacttgcagcctgacaatgagatagaaaagaaaatcccatttcctgaagtgaaattcaaatcagctgyagaaatttgcacaagtaataagtagctgagtgttaatccccaagacaatgggggaaaatgtctccagggcatatcagaggtcttcagggcagcccctccc

SEQ ID NO: 67494 - DNA, 201 bp, Homo sapiens
ccaactatctgctgccttcaagagactcacctaacacataaagactcacataaacttaaagaagcagaaaaaggcatttcatgcaaatggacaccaaaagygaggagtagctattcttacaaaagacaaaactttaaagcaacagcaattaaaaaaaagacaaagagggacattatataatggtaaaaggctttgtccaac

SEQ ID NO: 67495 - DNA, 201 bp, Homo sapiens
gatggggttttctaaatatataatcatgtcatctgcaaacagagacaatttgacttcctctcttcctatttgaagaccctttatttctttctcttgcctgwttgtcctggccagaacttccaatactatgttgaataggagtggtgagagagggcatccttgtcttgtgctggttttcaaagggaatgcttccagttttgg

SEQ ID NO: 67496 - DNA, 201 bp, Homo sapiens
actgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatggc

SEQ ID NO: 67497 - DNA, 201 bp, Homo sapiens
aaattgaagaggacacaaacaaaacaaagagcccatgctcatggattaggagaattaacgttgttaaaatgaccacactccccagagcagtctactgattsagtacaatccctgtctaaatatcaatgtcatttttcacagaaatagaaaaaagatcctaaaatgtgtaagaaaccaagtacggctcaaataccaaagtga

SEQ ID NO: 67498 - DNA, 201 bp, Homo sapiens
ctcttaggttttctgaagcagtttttgtaatactagattggtttgttctttgagtgcttcattcagtttcctctaagaccatttaggacttttttttttttgcattatgagttttaaatttttcattcaacctctttgaagactatagcactctactttaaaaccattttttggagtcaattttggtaaggttatattttc

SEQ ID NO: 67499 - DNA, 201 bp, Homo sapiens
cactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatgg

SEQ ID NO: 67500 - DNA, 201 bp, Homo sapiens
gccaagatcgcaccactgcactccagcctgggtgacagagcaagactgtctctcaataaataaataaataaataaataaataaataaataaataaataaataaaagtttgccaactgctgatttagaaaattgtgatcatttctttaggtgaatattcctgacaaactggtttaaaatcatgtttaaatatctgcaaattt

SEQ ID NO: 67501 - DNA, 201 bp, Homo sapiens
tcactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctatg

SEQ ID NO: 67502 - DNA, 201 bp, Homo sapiens
tcaagtaatgttaaagttgtttaaacagtgtactaataaaacctttcactaagtatggggagactgtgtagggggtgtgtgtgtgtgtgtgtgtgtgtgtktttgtgtatatattttttccctccaaaagtgatctaacaacttaaataattaagaattctaaacatactggtgggaaatgttaccaaatggtaaaacatt

SEQ ID NO: 67503 - DNA, 201 bp, Homo sapiens
atcactgttttgtcttagctttcataatctcaagctatttgtctgtctgtctatctatctatctatctatctatctatctatctatctatctatctatctatcttaggcgaagattttgattaaccctcatacttggctctgatatatcaggttgaggctagaagcagaaggtggtgtcttagtttgttttgtgctgctat

SEQ ID NO: 67504 - DNA, 201 bp, Homo sapiens
aagaaccttttaaggtactttgccttcaagtaatgttaaagttgtttaaacagtgtactaataaaacctttcactaagtatggggagactgtgtagggggtgtgtgtgtgtgtgtgtgtgtgtgtgtttgtgtatatattttttccctccaaaagtgatctaacaacttaaataattaagaattctaaacatactggtggg

SEQ ID NO: 67505 - DNA, 201 bp, Homo sapiens
gcagtctgcaccttggataattctagtacacagcagagcatccagattatcactgttttgtcttagctttcataatctcaagctatttgtctgtctgtctrtctatctatctatctatctatctatctatctatctatctatctatctatcttaggcgaagattttgattaaccctcatacttggctctgatatatcaggt

SEQ ID NO: 67506 - DNA, 201 bp, Homo sapiens
attatgtcacccaggcttgagtgcaatggcatgattttagctcactgcaacctctgcctcccaggttcaagcaattctgccacagcctcccgaggtgcacrccaccacgcccagttaattgttgtatttttagtagagatggggtttcgccatgttggccagactggtttcaagcccctgacctcaagtgatcggccctcc

SEQ ID NO: 67507 - DNA, 201 bp, Homo sapiens
cagatattggtactttaaatctacacaagacaatgtattaacgttaagtatgctacaaataattggtgaaatgaatgatgttgaagatacaggggttagcyttagaaatattttatgtaactagactttgggtcaggcgaggcttgcagattaacagcttttggagtaataacctaactagtactccatttgatcctgttt

SEQ ID NO: 67508 - DNA, 201 bp, Homo sapiens
attgaatctataaattactttgggcagtatggccattttcacaatgttgattcttcctatccatgagtatggaatgtttttccatttgtttgtgtcctctyttatttccttgagcagtggtttgtagttctccttgaagaggtccttcacattcctttaagttgtattcgtaggtagtttattctctttgtagcaattgtg

SEQ ID NO: 67509 - DNA, 201 bp, Homo sapiens
ggaagccatttcttaactgtagacttaattttaagactttgaaaaccatcaagtttctgtttaaacagaaagaattcctttctgtttaatagtactctcarctgaactctattctttttacattttactacaagcagcaagaagaaatcaggctgcaccttcaccactgtgtttagaagtctacttagccagatcaccctg

SEQ ID NO: 67510 - DNA, 201 bp, Homo sapiens
tagtgacttaggtgaacattgactgggaggataccatgtgtcccatcccagaagattgtataatgttatgacagggacaagattatatatatatatatatrtatatatatgtatacatacatgtatatatgtgtacacacacacacacacacacacacacacgtcccaggagattgtatagtgttatgacccaaacttata

SEQ ID NO: 67511 - DNA, 201 bp, Homo sapiens
ctcaccaggatcacttggagaaaaatctcttagtattctgagagggcctagactcccactgagtcctccaaaaggactgaagatagaggtttcctagagcktctggctcctctctttctttttagtgctggttctctctaatcttctttgtaaactcccattctctgaaagacaaatgcttttagggactctgcatggcat

SEQ ID NO: 67512 - DNA, 201 bp, Homo sapiens
atggccgattaagtagatttgcagtaggtgtacactggcagcctagaggaagattaatctgaagacaggttgagagcacctggaacattttaggatttagrtgatctgactattaagtgttgccaagtcatgggacctggtaactaccatgttactgatggggagactggatcttagagagttagaggatcttgtcaaaaa

SEQ ID NO: 67513 - DNA, 201 bp, Homo sapiens
ccagcagagcaaggaacccgaggactccacatctaatcaacagactcccgacagcattgacaaagatggtcctgaagaaccttgtgctgaaagtaaggcartgccaaagtccgaaatcccttcaccacaaagccaactgttagaagatgctgaagctaatttggttggaagggaggcagcaaagcaacagaggaaagaact

SEQ ID NO: 67514 - DNA, 201 bp, Homo sapiens
aatcttctgtacctctaatttcttacatagtaagtggaagttcaacaactggaagatctctgtggtctttagcgtcctcaccctctctctatgctttctcrttcagcaaacatttgtcaagtgtctactctgtggcagaatttgtgtaagaacttggggatagtctgtcttcagatgagctcagagtctagtaggagagag

SEQ ID NO: 67515 - DNA, 201 bp, Homo sapiens
attacccatggccagatttcctagttattttctcattgcaaaagaatgtgaaacaaactgattaagtgtaaaataactcttaactcttatttagactatcrtagtcatcttcaaaactctttgagatcatcttgagaattcacagttttctattctttttgttgctagcaggtgaaattatgtacctttggaaccctctgt

SEQ ID NO: 67516 - DNA, 201 bp, Homo sapiens
ataaaattaagcacatagaccaatggagcagaatagagaacccagaaataaacccaaatatttacagccaactgatgttcgacaaagcaaacaaaaacatraagtggggaaaggacacattactaacaaatggtgctgggacaattggcaagccaggtgtagaagactgaaactggatgcttatctctcaacttatacaaa

SEQ ID NO: 67517 - DNA, 201 bp, Homo sapiens
acccaggctagggtgcagtggcatgatctcaactcactgcaacctctgactccctggttcaagtgattcttctgcctcagcctcccaaatagttgggattrtaggcgtgtgccaccacatccagctaatttttgtatttttagtggagacagggtttcaccatggtggccaggctggtctcgaactcctgacctccagtga

SEQ ID NO: 67518 - DNA, 201 bp, Homo sapiens
agtgttaataacatatatcacagtgtagctggtcagatccaaatgagaaatatttagaaagatttttaataagtaaacaagtgtttagtaaaacacttttwaaaaacatctttcaaatgttatcttagttcactttaattagcaagttgaatcaaactgacagtctctttggcatttggtggtgttctagatagccagtag

SEQ ID NO: 67519 - DNA, 201 bp, Homo sapiens
ttaaaaaatatttgtttatgtctaatccatcctcacattaactcatggtatgtttctgggtagtttgttgtctccaaattttataaaccacaaaaatgtgytgctgctgagatgtcagtaattaattatttttataaataatcttttgtcaactctggtgccttagctgttcttaggtttttaaagaatatcctgataaag

SEQ ID NO: 67520 - DNA, 201 bp, Homo sapiens
gagcaggtctttcatattcagtatgggtccgtaggaatatattggtatatattataataagtaatgagtgaattaattctaaatttggaacatgatggtcrtgatgaattagaaacctgtcacttagttggtacagtggtggggcaggagcagggagggacaggccaaatgtgcacattagagttatctggcaaactctaa

SEQ ID NO: 67521 - DNA, 201 bp, Homo sapiens
tcgtgaattaagcacaaatcgtagaacagatttgtattggtacagccaatgtatttgagtggagcccaagtattgatatgtcagagggtggtcattttgcyttatttttttaatcaatattgttgactattttataaatatttcaatgcctactatgtgcctaaaagtattctatgagaaatgtattgaatctactttttg

SEQ ID NO: 67522 - DNA, 201 bp, Homo sapiens
tgtccttggttcttccatcttccctttatcatccttcccatgtgtccccatgaacttggtaaaaacccaagggaatacaggttgcaaacccaagagagggytgaggtttatgaggtgctgtggtctccacaggttcacattgctagtctgaaaactccacatttctgtccttctgtcagactcactcacttctgataagaa

SEQ ID NO: 67523 - DNA, 201 bp, Homo sapiens
atcagcatacagaaaataagtgctgtttctatacaaaaataatgaactagctgagaaagaacacaagaagacaaccaaatttacaatagttaaaaaaaaaatacctaggaataagtttaaccaaggagatgaaagaccttcacaaggaaaactacaaacactgatgaaaaaaattgaagaggacacaaacaaaacaaagag

SEQ ID NO: 67524 - DNA, 201 bp, Homo sapiens
cttagcaaggaaacagttccttgacgctcaaatcataaaggaagagctgcaaagagggcaataaaaagtgttttcttctcttggtccctgagcaattaaaytggtaacctaatctgatgttagggagtatagaccataaactgtgtttaattagtttgcacccagtgtcatttcacacagtagacactttaatttacaact

SEQ ID NO: 67525 - DNA, 201 bp, Homo sapiens
cacaggaaagacctgtccccataattcaatcacttcccaccaggttcctcccatgacatgtgggaattgtgggcgtaacaattgaagatgagatttgggtrgggacacagccaaaccatatcaatacctcaacataataaaggccacatatgacaaactcacagctaacattgtattgagtggggaaaagctgaaagcctt

SEQ ID NO: 67526 - DNA, 201 bp, Homo sapiens
aaaattgaagcagaggaacttctccctgattctttctatgaggcaagcattaccctgataccaaaaggagataaggacagaaccaaaaggaaaactgcagrccaatattcccaatgaacacagaggcaaaatttctcagcgaaatactagcaaaccaagtccaacagtacattaaaaagataatacaccatgattaagtgg

SEQ ID NO: 67527 - DNA, 201 bp, Homo sapiens
tggataggaacttgataataatgcctatcatgcacaagcaatttaggtgactaggaaatatcattctctacagccacacccttttttttttttttttttttctttgaggcagagacagtctcactctgtcctccaggctggagtgcagtggcactatctcagctcactgcaaccttcacctcctgggttcaaaccgattct

SEQ ID NO: 67528 - DNA, 201 bp, Homo sapiens
aaagaaccttttaaggtactttgccttcaagtaatgttaaagttgtttaaacagtgtactaataaaacctttcactaagtatggggagactgtgtagggggtgtgtgtgtgtgtgtgtgtgtgtgtgtttgtgtatatattttttccctccaaaagtgatctaacaacttaaataattaagaattctaaacatactggtgg

SEQ ID NO: 67529 - DNA, 201 bp, Homo sapiens
gcctgattgccctggccagaacttccaacactatgttgaataggagtggtgagagagggcatccctgtcttgtgccagttttcaaagggaaggcttccagwtttgggccattcagtatgatattggctgtgggtttgtcataaatagctcttattattttgagatatgtcccaacaatacctaattcattgagagttttta

SEQ ID NO: 67530 - DNA, 201 bp, Homo sapiens
aaaaagtcaggaatgaattaactttgtctataaataagcacacacagatatagattttctctgacaatttaggcatacacacatctctgcatatatatatwcacatatttagtgtcatatatatgtatatatatgacatatatatacacagcatatttagcgtcctatcatcatgtaggaagatttcagtgctgtaattat

SEQ ID NO: 67531 - DNA, 201 bp, Homo sapiens
caataataagtatgatacatctttttcatatgcctctcttcatttacaaagatggtgctgggcattccaatctacctgaagcattttttttttttttttttggtcaggagaggtaacagggtttgaacccatcttcattccactatgcattctcccgtgtgactgctgtcacatacctgagagacagatggttgggagtgc

SEQ ID NO: 67532 - DNA, 201 bp, Homo sapiens
gatatgaacagacacttttcaaaacaagaaatttatgtggccaacaaacatatgaaaaaaagcttatcatcactggtcattggagaaatgtgaatcaaaaygacaatgagataccatctcataccagttagaatgacaatcattaaaaagtcaggaaacaacagatgctggagaggatatggagaaataggaatgctttta

SEQ ID NO: 67533 - DNA, 201 bp, Homo sapiens
cttccgtctcccgagttcaagcgattctcccacctcagcctcctgagtagctggaattacaggcacgcaccaccatgcctggcttaatttttctttttttmgtagagacggggtttcaccatgttggccaggctggtctcaaactcctgacctcaggtgatctacccacctcggcctcccaaagtgctgggattacaggag

SEQ ID NO: 67534 - DNA, 201 bp, Homo sapiens
cccagtgccatgatagccttgaaaccaacagcctgaaatcacggtgaaaaccaccaccttggcagccacttcagggggcttatagtattggattgccttaraaatcccattttcattgaattgtcattgtttgacctgtgtggtgattgtctggataaccccactcacaaagattatttttatttgacctgactcagtgct

SEQ ID NO: 67535 - DNA, 201 bp, Homo sapiens
aagggctgggcccgaaatctatgattttcatatctgtattatatacagtttcttgcttagcgtctagaattacctattatttaggatagattcctaaaaawatataattttattaatttataatattatttataattttattaaattatatttaaattaattaaaaataaaattattttaaagccctttatatataattca

SEQ ID NO: 67536 - DNA, 201 bp, Homo sapiens
agttttagggtacatgtgcacaacgtgcaggttagttacatatgtatacatgtgccatgctggtgtgctgtacccattaactcatcatttagcattaggtrtatctcctaaagctatccctcccccctccccccaccccacatcagtccccagagtgtgatgttccccttcctgtgtccatgtgttctcactgttcaattc

SEQ ID NO: 67537 - DNA, 201 bp, Homo sapiens
ctcactgcagccttgaactcctgcgcacaagggatcttcctgccccagcctcccaagtagctgggactacaggtgtgtgccacagtgcctggataattacwttttttttttttttttttgtagattcagggtcttgctatattgtctaggctggtcttgaactcctgggctcaagtgaccctcttgcctcaccctcccaaa

SEQ ID NO: 67538 - DNA, 201 bp, Homo sapiens
ttcatttcctgccacagagggagatactcttacaaatggagcttttcttcatagatctaagtttcccttacaaaacagtatcttctactctgttttttttytttttaattatacttttaagttttagggtacatgtgcacaacgtgcaggttagttacatatgtatacatgtgccatgctggtgtgctgtacccattaact

SEQ ID NO: 67539 - DNA, 201 bp, Homo sapiens
ccctgacctctggggctcaagtaattctcctgcctcagcctcccatgcagctaggactacaggcaagcgccaccatgcctgttattattttttttttttttgtagagatgaagtctcactatgttgtctaggcttgtcttgaactcctgggttcaagcgaccctcctgccttggcctcccgaagtgctgagattaaaggca

SEQ ID NO: 67540 - DNA, 201 bp, Homo sapiens
tattaggattttgtacttgtgaagtaaatatataggatgaagtcctagaagtataattcctgtgtcaaagactacattgcttttttttgtttttttttttkttgttgttttttttgagacggagtttctctcttgttgcccaggctggagtgcaatggcgcgatcttggctcaccccaacctctgcctcccaggttcaagt

SEQ ID NO: 67541 - DNA, 201 bp, Homo sapiens
ttctcttttctctctaaatgttgggtcattattaagtttatgtctctatatcagggattgtgtgttcaggtttggttacaaaatggttagtgctcctgtawtttttttagccagcattgattaacagagttaatcactttctgtctttaaaagagactgataagggcttatgatataaagtttatttgggaaattatctgt

SEQ ID NO: 67542 - DNA, 201 bp, Homo sapiens
gatgatttcttaaagatcgatgaactgctggtttctttttaaagggcattcacaaaagcgaccaaaacttgggctaaagtattgctttcaaatatacttakgtgtagcttgtatttgtgagtgtgtgtatgtgtttgtgtgtgtgtgagattttgataggtatctccaaattgtgtttggaactttttttttttttttttt

SEQ ID NO: 67543 - DNA, 201 bp, Homo sapiens
atattacatattatatattatgtaatataatatataatatattatatgtatatttattacatataatataatatataatattatattaaatatatatattwaatatatatatttatatattatatttataattattatatataataattattatatatataataattattatatataataatataagttatataatataat

SEQ ID NO: 67544 - DNA, 201 bp, Homo sapiens
gggagggaatggggggtgtgtgtaggggagaggggagggtgtttgtggctttaaaaagaatggtcagggtaaaaggagattgtcgatgctttacaaaaaamgaaaaaaacaggcaccacactccaaagcctttcttgtttgtctgcatgggccatgcatgcgtgctgggccaggagccgagtttggagacggtttaagtga

SEQ ID NO: 67545 - DNA, 201 bp, Homo sapiens
atgtggagactcacattgtgaacttttgccccaagaactaccacaggaaaataccaggaaagccaagagaatccacagaccttttgaaggaactggatcascgctgcaggctccctaaaatgccaaaaaagtgtgagtctgcttgctttctcaacagggaagctcgtgatttagggtgagttctcagccctggtcataagc

SEQ ID NO: 67546 - DNA, 201 bp, Homo sapiens
gtatcattaagattaggtagtatttcttttcttttgtataattatcagtgttgagtatcattaagattaggtagtatttcttttcttttttttttttttttgagacagagtctcgctctgccgcccaggctggagtgcaatggcacaatctcggttccctgcaacctctgactcctgggttcaagcaattctcctgcctca

SEQ ID NO: 67547 - DNA, 201 bp, Homo sapiens
tattaatctttacatttccttttcctcctttttgtacattaactgctgaattcagagtttgagtcattatgtggatttttggttgttaaggagagcatccrgcctgttaatgctctcaaatggggtatccctcagaaacctctccttgcaaaagtagcttatggatattatcttttacctgggtagaggggtttcagctgc

SEQ ID NO: 67548 - DNA, 201 bp, Homo sapiens
caccggggtatgaaaaaatactcctgcagctagcttggtgtctgcctaaacagccacccagttttgtgcttgaaacccagggccctggtggcataggcacyggagggaatctcctggtctaaaggttgcaaagaccgtgggaaaagtgtagtatctgggccagaatgcaccattcctcacagcacagtccctcacggcttc

SEQ ID NO: 67549 - DNA, 201 bp, Homo sapiens
ttgaactatattctccaggtaatatggagaaacttaggaggactttttatgcccttctccatctccattagaaagtaatacttgctcattatacagaattyggaaagtacaaaaaagtatacaaaagaaatgtaaaatcattcgtaaattcattctctctcctctgtcactctactccatcccgtcttccagtgctgtttc

SEQ ID NO: 67550 - DNA, 201 bp, Homo sapiens
gctggaggtctactccagacccagtttacctgggtatcaccagtggaggctgcagatcagcaaagattgctgcctgttccttgctctggaagctttgtccyagaggggcaccctccagatgccagccggagctctcctgtgtgaggtgtctattggtccctgctgtgaggtgtttcccagtcaggagacacaggtgtcagc

SEQ ID NO: 67551 - DNA, 201 bp, Homo sapiens
tcttctccttcctctgctttataagaaaacaagactggttaataaaaaaaacaaaacttataaataaatgacacatttgccttaaaagggaaacttgaacyttaatgaggggtggtttattttttcagataacttgggtgtcttttggttgtattgaatgttttgtgcttttcaaaatcatatcatgaataataatattag

SEQ ID NO: 67552 - DNA, 201 bp, Homo sapiens
ctcctaatgctatccctcccccaaccccccaccccactacaggcctcagtgtgtgatgttccccgccctgtgcccaagagttctcatcgttcaattcccayctatgagcaagaacatgcagtgtttggttttccatccttgctatagtttgctcagaatgatggtttccagcttcatccatgtccctacaaaggacatgaa

SEQ ID NO: 67553 - DNA, 201 bp, Homo sapiens
cctgactcttttaaatgttctcttctccttcctctgctttataagaaaacaagactggttaataaaaaaaacaaaacttataaataaatgacacatttgcyttaaaagggaaacttgaaccttaatgaggggtggtttattttttcagataacttgggtgtcttttggttgtattgaatgttttgtgcttttcaaaatcat

SEQ ID NO: 67554 - DNA, 201 bp, Homo sapiens
ttataaaatgttaacagtatgaatttgattctcctaaatatttcatattttaaatctcctcagaagtatattatcccaagcaattttctcaattatttgargctgcgtgaagaatttgagcaagatgttcatcagatttttgttagttcatttaagatatatcaaactttatttattgataacaggcatgtaaaaattaat

SEQ ID NO: 67555 - DNA, 201 bp, Homo sapiens
ggtggaaggcaaggaggagcaagtcacatcttacatcttacatggatgacagcaggcaaagagagagtgcttatgtagggaaactcccatttttaaaaccrtcttatctcgtgagacccattcactatcacaagaacagcacaggaaagacctgtccccataattcaatcacttcccaccaggttcctcccatgacatgtg

SEQ ID NO: 67556 - DNA, 201 bp, Homo sapiens
tgaagcataacaggaacttagtcacttgtaggtttgtaaatgtgattcaaggatttctgtgaaatttgaatattgctaccaagtgctgcttcatttcattytcacacctacctactcagtgagtggaccaccagttaggtaatactgcatgttatcttcccaaaagtgtgaacaaggagggttatataaggcattttatac

SEQ ID NO: 67557 - DNA, 201 bp, Homo sapiens
acaccacctgttccccaaaaacctattataacaacaacaaaaaaattttaactgccacaaagattatatttgcttcaatataaattaggaagtttttccgyatttttttattttcagaaattacttttataaaagagacttaatgatgtagataagatagaaagtaccgttcctggaagtttgttattattcagcttttaa

SEQ ID NO: 67558 - DNA, 201 bp, Homo sapiens
acaatgtaagaagaatattaggccaggcatagtagcttaagctggtaatcccagcactttgggaggccaagatgggaggattgcttgagcctgggaattcwagaccagcatgggcaatatagtgagacctcgcctctaaaaaaaaattttttttaattagctgagtgtgatggcatgtgcctgtaatcctagctactcagg

SEQ ID NO: 67559 - DNA, 201 bp, Homo sapiens
gtatcttaacaaagtctacagttattcaatattcttactctccttgtgaaccatttaggtcatttttgttattctgcttcttgtgtttacaaaattgctcrtatttagatttttaaaaaaactttctgaatcagataattcttactgtcattaatacaattattatttattttcatttacatacctgtttttcttttcact

SEQ ID NO: 67560 - DNA, 201 bp, Homo sapiens
tgttattagtggataatggcaataggggcaggaggtggttggttgagtaccagaatctcctggggtgctttttcaaagtgtacttgcccacagctcagtcytgagatgctggcatgctctccttggggaatctggaaggttatggtggcagaatgtgtagttttagaccacattctaggggcttctagcttacacagtgtg

SEQ ID NO: 67561 - DNA, 201 bp, Homo sapiens
tgaagtatacaccttgaatgggaaggattccctgtaattcctggttaagtttttccttagggaagataggtgtgttgtgagactaggtattaggcccaaarcatatttcatctggatctcttatgttttatgtacagttattaaggacaaaaatgatataaatatgtaaatatatcatttgcagttatcaatttttgtgat

SEQ ID NO: 67562 - DNA, 201 bp, Homo sapiens
atagtcccatatttcttggaggctttattcattccttttcattcctttttctctaatattgtcttcatgctttatttcattaagttgatcttcaatctcttgataccctttcttcagtttgatcaatttggctattgatacttgtgtataattcacgaagttcttgggctttgcttttcagctccatcagatcatttatgt

SEQ ID NO: 67563 - DNA, 201 bp, Homo sapiens
tgcagtttcttcctagtgtcaataggctttgtaatttggtatgtttttgcagtggctcgtatcgattattcctttccaagtttagtgcttccttcaggagmtcttgtaaggcaggcctggttgtgagaaaatctctcagcctttgcttgtctgtgaaggattttatttctcctttgcgtatgaagcttagtttggctgggt

SEQ ID NO: 67564 - DNA, 201 bp, Homo sapiens
ttaaagtctgttttctcttagagtgggatcgcaacctctgctttttttttgttttccatttgcttggtaaatatttcttcatccctttattttgagcctaygtgtatcttagcacatgagataggtctcctgaatacagcacaccgataggttttgagcctttatccaatttgccagtctgtgtcttttaattggggcatt

SEQ ID NO: 67565 - DNA, 201 bp, Homo sapiens
attaaggtgtaaatttctcacacatcgtgttttgtcctttgtttcttttttgagactacaacctctgcctcccaggttcaggtgattctcatgcctcagcytcccgaatagctggaattacagccagctaattttcacatttttagtagacacagggtttcaccacgttggtccagctggtctcgaactcctgacttcaat

SEQ ID NO: 67566 - DNA, 201 bp, Homo sapiens
ggtgctcagaatgtatattctgttgatttggggtggagatttctgtagatgtctgttaggtcacttggaccagagctcagttcaagtcctgaatatccttsttaattttctgcctccttgaggtgtctgatatacacagtggggtgttaaaatctcccactattattgtgtgggagtctaaatctctttgtaggtctctaa

SEQ ID NO: 67567 - DNA, 201 bp, Homo sapiens
ggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcactg

SEQ ID NO: 67568 - DNA, 201 bp, Homo sapiens
tggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcact

SEQ ID NO: 67569 - DNA, 201 bp, Homo sapiens
cctggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctca

SEQ ID NO: 67570 - DNA, 201 bp, Homo sapiens
gatgagcattttttcatgtttgttggccgcataaatgtcttcttttgaaaagtgttcatattctttgctcactttttgatggggttggtttttttttttttcttgtaaatttatttaagttctttctagattctggatattagccctttgtcagatggatagattgcaaaaattttctcccattctgtaggttgcctgttc

SEQ ID NO: 67571 - DNA, 201 bp, Homo sapiens
tttaatgatcgccattctaactggtgtgagatggtgtctcattgtggttttgatttgcatttctctaatgaccagtgatgatgagcattttttcatgtttkttggccgcataaatgtcttcttttgaaaagtgttcatattctttgctcactttttgatggggttggtttttttttttttcttgtaaatttatttaagttc

SEQ ID NO: 67572 - DNA, 201 bp, Homo sapiens
aacatgaactcatccttttcaaataacatgaactcagccatagctgcatagtattccgtggtgtatatgtgtcacattttctttatccagtctgtcattgmtgggcatttgggttggttccaagtctttgctattgtgaacagtgctgcagtaaacatacgtgtgcatgtgtctttacagtagaatgatttataatccttt

SEQ ID NO: 67573 - DNA, 201 bp, Homo sapiens
tctcggatgagatgttgaactgtggacttttgagttaatgctgaaataagttaagactatgggggactgtttggaaggtgtaattggttttgaaatgtcargacatgtgatttggcaggggctggggcagaatgatatggtttggctgtgtcctcacccaaatctcctcttgaattgtaactcccacaattcccatgtcgt

SEQ ID NO: 67574 - DNA, 201 bp, Homo sapiens
ttgaaatacttgtaagcattttaattcttcctgccggctctgtatttcaacctgaggacccaaataatacaatttcatccacaacagtaaagctaattacmcttgactgtagcatttctaatacaattttattttagcatttcaaaatacatttgaaaagtaaattatgagttcttccaaactagattctctacttagtca

SEQ ID NO: 67575 - DNA, 201 bp, Homo sapiens
ctttgaatgatgtgcaaagagctatggcgctggacgcggtggctcatgcctattaccccagcacttcaggaggccaaggcaggcaaattgcttgagcccargagtttgagaccaggctgggcaacgtagggagactccatctctacaaaaaatacagaaactagtcagatgtggtggtgcacacccgtggtctcagctact

SEQ ID NO: 67576 - DNA, 201 bp, Homo sapiens
taatataggcccaggatgaagatgacttactggaaaggattataaggaaatagtttgggttgatggaaatgttctgtatcttcattggtgtggtaattacrcgtttacatatgtatcacagttattgaactgtacatttaaaattcatgtattttattgtgtgtaaattgtacctgaataaagatgaaaaaggtagtattt

SEQ ID NO: 67577 - DNA, 201 bp, Homo sapiens
ttttttgttttatccctctggcttttttcaattggtagtatgacagttgacaggcatgtaagaccattccatgtccatgtattagcatttttaatagctcygtagtataaatgtgccctaacttattattcatcctttctttattgatggatattagattatttccgatgtttttgcttctatgaataatgctgcatcttg

SEQ ID NO: 67578 - DNA, 201 bp, Homo sapiens
ttcattgctctcagtattgggtggcgtattcacaaagagaatttaaagaaatgacttatttccctcagcaacataattttatttggtaaaataatcaaatrctcagaaaaaacaactcttgtttctgtattaaagatgccactgatactagtagatttttagaaacgcacttgtatatggcataggtttgtcactttggat

SEQ ID NO: 67579 - DNA, 201 bp, Homo sapiens
tacatatacatatatatctgtttctgtgttgatctatctatatttaaaaatctacagtgtgtaatgctatttatcattgccacaacttaatgtctacacasaatgataggaagctttatcaaatatgtctttattttgctttcatttgtaaggattattttcactggatatagaattctgaatgaaatctcactagatagg

SEQ ID NO: 67580 - DNA, 201 bp, Homo sapiens
gcacttcatgtgaaaatttataatggattatcattgcttctagttgctcttagtgggcaaacataaaatatatatgtacacacacgaatatatatatacayacacacacacacacacatacacacacacatacatatacatatatatctgtttctgtgttgatctatctatatttaaaaatctacagtgtgtaatgctatt

SEQ ID NO: 67581 - DNA, 201 bp, Homo sapiens
gggcacttcatgtgaaaatttataatggattatcattgcttctagttgctcttagtgggcaaacataaaatatatatgtacacacacgaatatatatatayacacacacacacacacacatacacacacacatacatatacatatatatctgtttctgtgttgatctatctatatttaaaaatctacagtgtgtaatgcta

SEQ ID NO: 67582 - DNA, 201 bp, Homo sapiens
gcccctggtattagtcagttcttgcactgctgtaaagaaatacctgagactgagtaatttataaagaaaagaggtttaattggctcatggttctacaggcygtacaggaagcatagcggcctctgcttctggggagacctcaggaaacttactgaggtcatggcggaaggtaaagaggaagcaggctcgacttacatgggc

SEQ ID NO: 67583 - DNA, 201 bp, Homo sapiens
cagggttttaccgtgttggccaggctggtctcgaactcaggtgattcacctgcctcagcctcccaaagtgctggaattacaggcgtgaaccaccttgcccrgccaagaacatttttaatgcttgtttatataagaagatatttggctaggcctttgattttttgaaaggaagatcctaaatataaagtgcatgacctatta

SEQ ID NO: 67584 - DNA, 201 bp, Homo sapiens
attacttgcttcaatttgcacctttcataaggattaaaataaattgagatcttaagaacttatttatttatttatttatttatttatttatttatttattwgagatggagtttcactcttttgcccaggctggagtgaagccgcacaatctccgctcactataacctccgcctcccaggttcaagtgattctcctgcttca

SEQ ID NO: 67585 - DNA, 201 bp, Homo sapiens
gctggagtgcagtggcatgatcttagctcttggcaacctcggactgccgggttcaagcgattcttgtgcctcagccttctgagtagatgggattacaggtkcctgccaccacgccaggctaattttttgtatttttagtagagatagggtttcaccatgttgactgggctggtcttaaaatcctgacctcaactgatctgc

SEQ ID NO: 67586 - DNA, 201 bp, Homo sapiens
gattctggtgttccacccctcaccccggtggatagcaatgtgcccttctcgtctgaccacatagctgaatttcaagaagaaccactggacccagaaatggkgcctctctcctctatgtggggagacacttcactgttttctacttcaaagtctgatcatgatgtggaagaatctccttgccatcaccaaaccaccaacaag

SEQ ID NO: 67587 - DNA, 201 bp, Homo sapiens
ttactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctcagc

SEQ ID NO: 67588 - DNA, 201 bp, Homo sapiens
attactttttagcacaagaagaatagcatcactaccaaaaccagctgagatatcttattttatttatttatttatttatttatttatttatttatttatttagatagagtctcactctgttgcccaggctggagtgcagtggcatgatcttagctcttggcaacctcggactgccgggttcaagcgattcttgtgcctcag

SEQ ID NO: 67589 - DNA, 201 bp, Homo sapiens
tttgcaatgataaagggagatgattaaaaataaaggggcctacaaatgtaagaaatttagtattagtggaaagaaccatgggctgggatttctaaaacctkgctttggcacctaatagccttccaaggtaagctcactagacacaggtccatactatataaaacaaaaagggttcagttagtgtattttgatgcttttctt

SEQ ID NO: 67590 - DNA, 201 bp, Homo sapiens
cctacccccaccaagcttgagtgtcccagttcgacttcagactgctgtgctggtagtgagaatttcaagccagtggatcttagcttgctggactccatagrggtgggatctgctgagctagaccacttggctccctgacttcagccccctttccaagggagtgaatggttctgtcttgctggtgttacaggtgccaccggg

SEQ ID NO: 67591 - DNA, 201 bp, Homo sapiens
ttggacaaatagcaaattatgttaaattgtagggcaaattgagaaagcgaagctgtgattttgagcaactgtgccttcatgatttaaaatgcaactttctwatgcagtatggaacaattcttatttcctctcaaacttctattataaatgcatttattctttttaattttagcttcacagataattctggtttggaattag

SEQ ID NO: 67592 - DNA, 201 bp, Homo sapiens
attgtggagaatcctaaatgaagttgattttctggacagtttgatgatttcttaaagatcgatgaactgctggtttctttttaaagggcattcacaaaagygaccaaaacttgggctaaagtattgctttcaaatatacttatgtgtagcttgtatttgtgagtgtgtgtatgtgtttgtgtgtgtgtgagattttgatag

SEQ ID NO: 67593 - DNA, 201 bp, Homo sapiens
gcttcctcgcccgtcattttgttcccctgtcgctgcttcaccatcaaagtctctgatatctctcagccaggaaaacctctgtgacaaatccattaagtagdcagtctcacatagcgaggggcaagctaaggaagaatcaggaccatcgtagagtatggggttattttaaacaatattctttctaaagccttaaaaataagt

SEQ ID NO: 67594 - DNA, 201 bp, Homo sapiens
aagcttcctcgcccgtcattttgttcccctgtcgctgcttcaccatcaaagtctctgatatctctcagccaggaaaacctctgtgacaaatccattaagtagtcagtctcacatagcgaggggcaagctaaggaagaatcaggaccatcgtagagtatggggttattttaaacaatattctttctaaagccttaaaaataa

SEQ ID NO: 67595 - DNA, 201 bp, Homo sapiens
gtacccaggggttacatcagttcatggggttttaaaatcacagatactcacagaggaatgagagatacaggatacaacttcagcaggggcacagccaagcytcatgggaaactgaaaaatattcttcaaaatatccctgaatctggtgatttgccactgtagagacgtaggtgtcttctcggaagtggcctctcattgcct

SEQ ID NO: 67596 - DNA, 201 bp, Homo sapiens
ttcctcagagatacccaattataagagtatgggactgcagagaaaatatttatatgtttctacacagctagagctttctaggcatttttactagaatgtgsaacctaagctaaaaaacaagcctcagaaaataaattatgaggctgagtgttgtgattcacacctgtaatcgcagcactttgggaggccaaggcaggaggt

SEQ ID NO: 67597 - DNA, 201 bp, Homo sapiens
tctgtgcattagtggaggaatattttaagtacctttcataataattattactctgttcaagttttcaatttcagggggacgattttggtattttgcatttytcaagaaatttagatatttcctttaggctattatacttattaacttatatttttataaaataatttttaagtattgaagtattttatatttataagtagt

SEQ ID NO: 67598 - DNA, 201 bp, Homo sapiens
aacagctttcactgtgttacttggcagaaatcttctttatgggcagtctgcagtctgaatctaagagctacagtttaattcttcctgaaagctgtcctgtrttcagtcactgcttcatcagtatggcctatggtatagaaatgggacagccactctagatggatgagaggtggacaggcaggatagatacagcactaggtt

SEQ ID NO: 67599 - DNA, 201 bp, Homo sapiens
tgattaaagtcatttaatcagataagatcttatgaaaatggttcctgattttaggtaatgtggttattggtaccacctcagtcctggaaggcagtcatgtyagcctcaaccttttggccagggtttttctggacagtagaattgctctaacccctagacttcctccttgtatgccaaggtttgagtctatgtaattattga

SEQ ID NO: 67600 - DNA, 201 bp, Homo sapiens
aagtcacttctatcactttttcatgagattatgttttgtatattttatagtttttggctgccagggcctctttgctatttttgataattaatcgttgtttrtaactgttaaaacatctgaatttctttattctttttgaaacacctctatgatttagaaacaagaagcccagcggaaagtcatgtagaatgactgactatt

SEQ ID NO: 67601 - DNA, 201 bp, Homo sapiens
tgcatatataatcttcatagcaatacagttattatgttttgttatcatgactgttttgcaattgaggatcctgagggacagaggttagataaattgcccartttaatgggacagccgcttgttctgaattctattcaaggaacaactccaggtctactctcatggtaactgttttacactgcctctctgagatacataaac

SEQ ID NO: 67602 - DNA, 201 bp, Homo sapiens
tccatcctcactcaggggaagtttcattaaaatgttgttcacagttagggtctctctgtgttgagatggatgtgaagaaactcattgttaaaagaaaagcmaataaagtgattaaagttttcataaaatcaaatctgaaggaatgtaatagaaatgggttatggctttcatcagtaaggtgttggtatgtgcttgtcagtt

SEQ ID NO: 67603 - DNA, 201 bp, Homo sapiens
ctagattttatggttctgtgtacttttacttttaaaatattattattgactttttaccagaaaatattttctgtacaatttcttgcatctaatttttttaycaaacatgaatttgcaacataatttttgaaaactcatgtttcttgagtctacagctataaacaggaccttgcctgtcttgttgaccactggcatagttgg

SEQ ID NO: 67604 - DNA, 201 bp, Homo sapiens
accagaggagataatgatcatccggtccagtttttcctcagagatacccaattataagagtatgggactgcagagaaaatatttatatgtttctacacagytagagctttctaggcatttttactagaatgtggaacctaagctaaaaaacaagcctcagaaaataaattatgaggctgagtgttgtgattcacacctgta

SEQ ID NO: 67605 - DNA, 201 bp, Homo sapiens
ttatgattaaagtcatttaatcagataagatcttatgaaaatggttcctgattttaggtaatgtggttattggtaccacctcagtcctggaaggcagtcakgtcagcctcaaccttttggccagggtttttctggacagtagaattgctctaacccctagacttcctccttgtatgccaaggtttgagtctatgtaattat

SEQ ID NO: 67606 - DNA, 201 bp, Homo sapiens
ttacttctatgagatcaacatttttttagcttcctcatatgaatgagacatgtggtgtttaactttctgtttttggcttattttacttaacataatgtccrccagttccatccttgttattgcaaattacaggatttccttcttttttatggctgaatagtactccattgtgtataaatacaccacattttctttatctct

SEQ ID NO: 67607 - DNA, 201 bp, Homo sapiens
taggtccatcccattcataaaaacaatgcaaaaaggtcctaaacaaaatattagcaaaccatatgaagcaacatataaaagagataatatatcatagctasgttgggtttagccaggaatgcaagtatggtttaacattggaaaatctgtcactttttatatttgacattgtactggaaggcaagtaaaagaaattaaaga

SEQ ID NO: 67608 - DNA, 201 bp, Homo sapiens
atttgaacaattgaaaaattttaaatgtatatctgaatatatctgtgattcatgatttaatttctgtttaatcgaagtattgatcacttgtttttttttttctttctttctcttttcttttttttaataatctgaaaggttgccatggaggatttcaataaatctctcagacaatcagcactatttcatgacactcggggg

SEQ ID NO: 67609 - DNA, 201 bp, Homo sapiens
cgaaatcccttcaccacaaagccaactgttagaagatgctgaagctaatttggttggaagggaggcagcaaagcaacagaggaaagaacttgcaggtggtratttcacctctcctgatgcttctgcatccagttgtggaaaagaagtacctgaagattcaaataattttgatggttcccatgtgtacatgcacagtgacta

SEQ ID NO: 67610 - DNA, 201 bp, Homo sapiens
gtatcacctgtgtggcactcttttgtgacatttgtatcttgtacactgtcactatcatagtcttaaatttctttatgtgattaatatacatgtccaaataytatatagcactgggcacttttcacaggatcatccacaaaacttggggtgagtgtgaaggatcatattgtattagagtctttacaaagtttcatgttacag

SEQ ID NO: 67611 - DNA, 201 bp, Homo sapiens
acgatggcccttcatattccaagttcactgagactcgaaagatgtttgagagaagtgtgcatgaatcaggacagaacaaccgctattccccaaagaaagaraaagctggagggagtgaacctcaggatgaatggggaggttccaagtccaacagaggcagtactgattccttggacagccttagctcccgaactgaggctg

SEQ ID NO: 67612 - DNA, 201 bp, Homo sapiens
accaaagagcaatgcagaaaaagaaaaggtctgcagaaagtggctgagtgggagaaagaggtgtaatctagttacctgtttctctgcagcccttatttggycaaagaatataagttatcaagaaaagtaggtagatgacttgttctctaagaatattttaactcacaacccaactttaacaaatattgaaggcagtgagat

SEQ ID NO: 67613 - DNA, 201 bp, Homo sapiens
aggaccgagcagtggtcaaaaagaaactcaaggaaatgaagatgtctctagagaaggctcggaaggcccaagagaaaatggaaaaacaaagagaaaagctraggagaaaggagcaagagcaaatgcagaggaagtccaaaaagacagaaaagatgacgtcaactacagccgagggtgctggtgagcagtaacacataccct

SEQ ID NO: 67614 - DNA, 201 bp, Homo sapiens
tatttattgaaccacaccccttctcatactatctttccccccaaaggaagtgaattaattcactacctcttgttattacagtttttcattttaaaaacaaraaacacttaagttttccttttctcttatttcaaagttatatatttagccacctgagttatgctatgcgtcaaaatgtttgttgttgttgttgttgttggt

SEQ ID NO: 67615 - DNA, 201 bp, Homo sapiens
aagaaatgacttatttccctcagcaacataattttatttggtaaaataatcaaatgctcagaaaaaacaactcttgtttctgtattaaagatgccactgayactagtagatttttagaaacgcacttgtatatggcataggtttgtcactttggatctttaaactaacatttgtttataacattggctgcatgaggcatgc

SEQ ID NO: 67616 - DNA, 201 bp, Homo sapiens
attcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcctca

SEQ ID NO: 67617 - DNA, 201 bp, Homo sapiens
tacagatgagaaaatcgttagcattttgctattgcagtattttgacaccagcagcagcaacaatagcggtcactcgttttgagcacctaccatgtgccagmccttgtgttaaatacataggcaccatctaacttaatcttatgacagctttcttatgctaaggaactgttttgtccttactttatagatgaaaagattaaa

SEQ ID NO: 67618 - DNA, 201 bp, Homo sapiens
tattcatcacactagttattgcctgaatactttgtttgtttgtttgtttttgtttgtgtgtgtgtgtgtgtctgtgttgtgttttgttttttttttttttttgagacagaatctcactctgttgcctaggctggagtgcagtggtgcaatctcggctcactgtaacctctgcctcctgggttcaagtgattctacttcctc

SEQ ID NO: 67619 - DNA, 201 bp, Homo sapiens
attcatcttgaatccttggggcaggttggggccagtaaatgaggaggacagaggcatggaagttttcttgggcttgggtagaagctggtgcctaccccaamctgggaatataagtagaggaacaggtatatatagaggaaaggaaaagttttacttcagaaatgaccaatttgcttataaaagattcatgtgttgaggtct

SEQ ID NO: 67620 - DNA, 201 bp, Homo sapiens
gatttttctctcttctggccctcatctctccaaccccaaatgctttttttgttgcattagtttatggtgttgtcctggagaaataagggatggtgaaaacmatcataatcataacgtcatgcagtcagttagcatattctaggcactgtggttaactctttcatatcactacaatgaattctcatagcaacctctttaaat

SEQ ID NO: 67621 - DNA, 201 bp, Homo sapiens
aaagtttctattatgctttggttatttgctttatttcttctgcattgtctttggcctctcttctcaaaccagtattaaatggggcttagatttcctgggcrtatcctctagaatcttattttctctcaggatctccatctgtttgaatttttgctagtataagagtttctttaattttctcttccagattaccatggtttt

SEQ ID NO: 67622 - DNA, 201 bp, Homo sapiens
aagttacacatacttaaaatatgattggttttgttattataaaatgttaacagtatgaatttgattctcctaaatatttcatattttaaatctcctcagargtatattatcccaagcaattttctcaattatttgaggctgcgtgaagaatttgagcaagatgttcatcagatttttgttagttcatttaagatatatcaa

SEQ ID NO: 67623 - DNA, 201 bp, Homo sapiens
tcatctttctgcaaagaggtgtaagactgtctttattgccaactctgccccctcttctacagacagaactcagtgattagattctgcatttatttaggttrttcgcctaaaaaacctggtttccatactgcaaataaatgacaggaacttttccactagattatcccagacagcacaaatgttctttccaaaagtggagcc

SEQ ID NO: 67624 - DNA, 201 bp, Homo sapiens
tttcctcatgattagctttcaatttatgcagtcttggcaggaatactgtggaagtgtttttgttttcttttcagtgcatcagatctggagacacattataragatttgtccaattattgattatattaactttgatcattttgttaaggtggtttctccactttgccagtttgtcccctatgaagttattattttatcctt

SEQ ID NO: 67625 - DNA, 201 bp, Homo sapiens
gttgaaatgaaattaagggttgatggcagtaggatatttggcaggtaaataaatggaaacatacatgatgtttgtagaacagaaggctcactgtctttcaratgtgaaatttccccatattgatctgtagagtcaaagaaatcccaatcaaactctagcaggttttttgttgttcttgttgtttttggagaaattgacaag

SEQ ID NO: 67626 - DNA, 201 bp, Homo sapiens
tggtattgcctaggttttcctctagggtttttatggttttaggtctaacatttaagtctttaatccatcttgaattaatttttgtataaggtataaggaarggatccagtttcagctttctacatatggctagccagttttccatttattaaatagggaatcctttccccattgcttgtttttgtcaggtttatcaaagat

SEQ ID NO: 67627 - DNA, 201 bp, Homo sapiens
tacctaagtatcgagctataagtaacaggacatattactggagtgggttaaataaaagctgccacatggccagtcatgctggctcacatctataatcttarttctttgggaggctgaggtgggaaaatggcttgagctcaggagttcaaagttacaatgagcaatgaaggttgccacagcactccagcctgagtgacagaa

SEQ ID NO: 67628 - DNA, 201 bp, Homo sapiens
tactaaaattggtgcattcatttatcctaacagcgtactgttggaaaatgaattttaaaagaatcccgtttataatagcaccaaaaatcataaaatacttrggtataaacaaaacaaagatgtctaagacccctacactgaaaaatacaaaatgttgccaatagaataggagggtagaaactgagaagctgattataaaaa

SEQ ID NO: 67629 - DNA, 201 bp, Homo sapiens
atggatacagagaagtgaaacgctcccttatggctagtgggaatgcagaatttcactgccacttaggaaaacagtttggaagttttttttaaagttaaatrtacacttaactttttgatccagcaattccactccaagatattttccaatagaaatgaaaacatatgtctacataaagtcttgcatgtgaatgacaacttt

SEQ ID NO: 67630 - DNA, 201 bp, Homo sapiens
ccaaaaccctggggctaacttgcaacctttatgttccttagaaaactttggccttaacattctggtccaagcatggcctaatgtttttacctttgtttccrttaagcacacctgggataagccagaattttcaaaaagaaattcttaaataccaagggagaatggtaagaaaatactttttaaaactgacaaatgtattac

SEQ ID NO: 67631 - DNA, 201 bp, Homo sapiens
tatttattctcccttgttcattcccatgcagttgaagctaaaactctttgtgatgaatgttgagcctctgtcctatagaggacctcccctgcttaaccgaragttcctcaatgtaactgtgtctcctaggtcgtataagaaggcattgattatttattttacaattaggaatttaggcaaagcccttagattcagagatgc

SEQ ID NO: 67632 - DNA, 201 bp, Homo sapiens
gagagttcctcaatgtaactgtgtctcctaggtcgtataagaaggcattgattatttattttacaattaggaatttaggcaaagcccttagattcagagaygcattgacttttgaattgtgactttaaaaataataataattgatctttttcacaaatgtgtatatcctagatgatgccaaagatcccaaatcactaaggg

SEQ ID NO: 67633 - DNA, 201 bp, Homo sapiens
gtgttccacccctcaccccggtggatagcaatgtgcccttctcgtctgaccacatagctgaatttcaagaagaaccactggacccagaaatggggcctctstcctctatgtggggagacacttcactgttttctacttcaaagtctgatcatgatgtggaagaatctccttgccatcaccaaaccaccaacaagaaaatat

SEQ ID NO: 67634 - DNA, 201 bp, Homo sapiens
atgaaaagatcatgattttaactgagtaatttaggacagaggttggcaaactatggcccctaggccaaatctagacctctgtttgcttttgtaaataaagktttattgaatacagccatactcatgcctgtaagtattgtctatggctgctttcctactgtaaaggcagagcaagtagttgtctgccttcccagcactttg

SEQ ID NO: 67635 - DNA, 201 bp, Homo sapiens
acgatgttcttaaaatgcattctgttataatgtaaattttgtataaaatgggactattgtggacctcaccaagaaggtttattactagaactagattgaaratggaaataaagtcacagaaatctcctgtttaattgtagacaaacatggatgcttatttatttactttaatagttaattcaccaaggctaatgctatgga

SEQ ID NO: 67636 - DNA, 201 bp, Homo sapiens
actaaatactcaaccttatgaacttttaaagctgaaaatccaagatacttgtagaatgggaaatggacagagatgatggtttaaattttcagtggcatgtycaagccatgagtgtaggtagaaagccatgctgaatcattatcaatttattggggtagaaatgacacctttaatgttaattttatagctaacatcacaaaa

SEQ ID NO: 67637 - DNA, 201 bp, Homo sapiens
taatgaatgtaggcttatgataaagtggtttcaattaacaaaagtattgctgtgataaagtagtttcacctttgagtaaaacttgttgattgcactaagtrgaccatttttgccatttcattctggaaaccagagattgcggattttaaattttcttttaatctcctgaatcagcctggattataacatgctgtattttct

SEQ ID NO: 67638 - DNA, 201 bp, Homo sapiens
agtggaggaatattttaagtacctttcataataattattactctgttcaagttttcaatttcagggggacgattttggtattttgcatttttcaagaaatktagatatttcctttaggctattatacttattaacttatatttttataaaataatttttaagtattgaagtattttatatttataagtagttatccctttt

SEQ ID NO: 67639 - DNA, 201 bp, Homo sapiens
gttgtacagttttaaaaacagaattattcttttgaattgcgtttcataagttcagttcttattgcctttcccacctcaatgattatcccagaaatctgaamattttataataatgaatgtaggcttatgataaagtggtttcaattaacaaaagtattgctgtgataaagtagtttcacctttgagtaaaacttgttgatt

SEQ ID NO: 67640 - DNA, 201 bp, Homo sapiens
atatttgcttcaatataaattaggaagtttttccgtatttttttattttcagaaattacttttataaaagagacttaatgatgtagataagatagaaagtwccgttcctggaagtttgttattattcagcttttaattcagcatattaaaggtaatgacagaaaccacaattacttttgcactaaccttatataaaccatc

SEQ ID NO: 67641 - DNA, 201 bp, Homo sapiens
tacacacatgaataacttaattctttgaatagttcttagaatgtccatcacgaaaacttaaaaatacattgagaaaacccctaaaacaatatagaatatastttgtactttttgtttatcctctaaccttgtgaccacatggttaatactaatcatggtattattggttgcaaaggaaatgaaaataacagcccacaatat

SEQ ID NO: 67642 - DNA, 201 bp, Homo sapiens
aaactgagaactcccccaccccaaacacattttggattttttgcatgtcagtaatgaagttcacttttcaccacctttccagttggaacatataaaatgtrtgacctctaatgcctaatacattaatgatctattgaactaagttaacccttataaagttcatagaagtgaaaatgtggtctagaacaacactgtttgata

SEQ ID NO: 67643 - DNA, 201 bp, Homo sapiens
tgcttgaacccgggaggcggaggtttgagtgagccaagatcgcaccactgcactcctgggcgatagagcgagactccgtctcaaaaaaaaaaaaaaaaaaagattgggagagtagataataataccatactttattgatgaagaactttaccttcatagaatttaattgatttgcccagggttatgcagcaggcagttaat

SEQ ID NO: 67644 - DNA, 201 bp, Homo sapiens
tgccagtgtcatataaccatctctcatattttttttccatttagcaggatcaagtataatgtagggtgtcctttttctttttcttttaatttttttttaastacagctcattggaacttagcctatttcatccagatgtgtaacatcctccttaatactatttttcttcttattcccagttactctgagaattctttccct

SEQ ID NO: 67645 - DNA, 201 bp, Homo sapiens
ggaggatatagtttccatgagcttcccatactgagaatgacattctaattcatttatgaactttttccctgaaaaagtggtagggcaagttttattgttttaagagtgttttaaaggaaaagtctaacataaagcttgcatttggatgcttgtattgttttcaccttgtactttaaaaatctttagcacaatttattgaag

SEQ ID NO: 67646 - DNA, 201 bp, Homo sapiens
caggagactggggcagaagaaggagaaaataaactcgttttgagaaatttcatgtgatgagggttttttgttttttatgctcatgtatctggttctctttkctgcgttgactctaaaaatgaggttatccactttccaaaggacaagtttcagaataagacttgaggccacatgaattcttggacagtattttacttcttt

SEQ ID NO: 67647 - DNA, 201 bp, Homo sapiens
ttttttggtgatttttttgagtttttccttctcatttgttttgtcccctccactagcagggagcttagttatttttaaaattgtttattctgttattttaraatatatgtttgtaaatatgcgtgtgtgtgtgtgtgtgtgtgtgtgtgtatatgtatatgtccacatatgtttgtatttatatatgtgtatcttaacaaa

SEQ ID NO: 67648 - DNA, 201 bp, Homo sapiens
tgttaggaaaactggctagccatatgcagaaaactgaaactggaccccttccttacaccttatacaaaaattatttcaagatggattaaagacttaaacayaacatctaaaaccataaaaaccctagaagaaaacctaggcaataccattcaggacacaagcataggcaaagacttcatgactaaaacacaaaaagcaata

SEQ ID NO: 67649 - DNA, 201 bp, Homo sapiens
taatatcattgtactgtagtcatagatacttggaaagctgaggtaggaagatagcttgagctcaggagttggaggctggcttaggagttgaaggctgcagkgagctatgattgcgctactgcactccagcctgggcaacagggtgagaccttgtctcctaaggaaaaaaaagtggtatgtagagatggtcagctccccgaa

SEQ ID NO: 67650 - DNA, 201 bp, Homo sapiens
gagtacagtggttattcacaggtgtggtcataattcactgaagcttcaaactcctgggctcaagtgatcctactgcaccaagccttcctagtagcttggastacagttgcgctccactgcacccagcttataattttttgattaacagcaattctaagagaatattatgtaatgaagtgtgagaataattagtgcagtggt

SEQ ID NO: 67651 - DNA, 201 bp, Homo sapiens
cttgggtaaaatcccagactgtataaacaattcctttttaaaatggatttggttattttcaaagaaaagatacattttctgtattaatgcttaaatttccytaagagcttttatgataattaagcttaaaataccaaagatggatatggttacatattttgctgatttcaaagtttggagaatagttaatgaacaactact

SEQ ID NO: 67652 - DNA, 201 bp, Homo sapiens
tgtatatatttgatgttaaaagcttttatcaaattgtgtgtgtgtatgtatatacacacatacatgtatatgtacgtatacatacacacacacacacacayatatattttaagagatgtgttgcccaggctggagtacagtggttattcacaggtgtggtcataattcactgaagcttcaaactcctgggctcaagtgatc

SEQ ID NO: 67653 - DNA, 201 bp, Homo sapiens
tgtgttctgtttaggctattagctgagcctttatttaccatttttggtgcttttgttatcgatgttatgttttaaaaatatatacatgtttctggaactayatatatgtctgtgtgtgtatacgtatatgtacacatatatacgtctatatacatatatatgtgtatatatttgatgttaaaagcttttatcaaattgtgt

SEQ ID NO: 67654 - DNA, 201 bp, Homo sapiens
agtactccatttgatcctgttttgtggtatgtaggattctggtgagtgatccacttagaaggttaaatgtatcctactgtagaatgtagttgcaactgctytaagtaaacctttcacacaggctacttttcaaaatgacttttaaggacagaaatctgggattttagagttttatgagataggcctatgagtctgtttttt

SEQ ID NO: 67655 - DNA, 201 bp, Homo sapiens
aaacagtttttatttaataatcctcatttatgcaaaaagcacccttgttccatatttagatgtgaagtttatgtgtgtgtatgtgtatatatatatatatwtatttttttttatggttttttgttttttttttgagatggagtctcactctgtctcccaggctggagagcagtggtgccgtctcagttcactgcaacctct

SEQ ID NO: 67656 - DNA, 201 bp, Homo sapiens
gatttgttacctgggtatattgtgtgaggctgaggtttgggatatgaatgatcctgtcgcctaggtaccaggcatagtacccaatatttagtttttcagcycttgcttccctctcttcctttcccctctagtagtccccagtttctattgttgccgcctttatgtccatgagttcccaatgtttaacttacacttataagt

SEQ ID NO: 67657 - DNA, 201 bp, Homo sapiens
tgtctagcctcataaggtattttcaatactgagcatagtgccaaccagtgagctggtgcttaataaggatttgaagtaagaatcaatggctcaaaagagagagaaagtatgaagtgtaatttctgtatctgcagtcagcattcacaggctcagtagtttgagaaacctgtatttcctgctttgactttttcactatttctt

SEQ ID NO: 67658 - DNA, 201 bp, Homo sapiens
gtgttaggaaaactggctagccatatgcagaaaactgaaactggaccccttccttacaccttatacaaaaattatttcaagatggattaaagacttaaacrcaacatctaaaaccataaaaaccctagaagaaaacctaggcaataccattcaggacacaagcataggcaaagacttcatgactaaaacacaaaaagcaat

SEQ ID NO: 67659 - DNA, 201 bp, Homo sapiens
gttgagcattttttcatacatttgttagccacttatatatatcttctttgagaactgtctattcatgtccctagcccacttttttatgggattttttttttgtcttactgattggcattctctatagattctgggtattagtcctgtgtcggatgtatagatggcaaagattttctcccactcttggggttttctgtttac

SEQ ID NO: 67660 - DNA, 201 bp, Homo sapiens
aagatccagataagctcagttacaaatgaaacgggagatactacagctgataccacagaaatagaaaagatcattcaaggctactatgaaaacctttacaygcataaactagaaaatctagaggagatgtttaaattcctggaaatatacaatcaccctagattaaaccaggaagatataaaaatctctgaacagaccaat

SEQ ID NO: 67661 - DNA, 201 bp, Homo sapiens
agtctctgatatctctcagccaggaaaacctctgtgacaaatccattaagtagtcagtctcacatagcgaggggcaagctaaggaagaatcaggaccatcrtagagtatggggttattttaaacaatattctttctaaagccttaaaaataagtgagggctattaatttcattcattcttacacacgcaaactataattta

SEQ ID NO: 67662 - DNA, 201 bp, Homo sapiens
attttctccaggggaaacaccaaattctgtggtggcttaggtgaaggagtaaggctctttactcagcttttgtttttaattgtaactgtgcagatgtctcmtatgtcctatggccagttatttaaaatagtgaaagccaaatgctagtttggtggtgtgcaggcataactcaattatctgacaagagaaaaagaatggttg

SEQ ID NO: 67663 - DNA, 201 bp, Homo sapiens
caaaatcagtggtcagtatctttgagctaaagtgatatgccaagaattgagatggaagaaaaattgcacaattagtttatattggtcttactccaattatrgcctccatctagccttgggcatatccattggttcttaattgcagaattatggccacatgaaccatttcaataagtgtttatctaaattcagcacaaatat

SEQ ID NO: 67664 - DNA, 201 bp, Homo sapiens
attattttcttcttaagagagcttgatttcatcaaaagacaggaagcagaaagaaagaaaatagaagatttggaaaaagctcatcttgtggaagtgcaagscctccaagtgcgggtaagttgtgttccctaagacactaaataataagatggttttgctgtacttggaggggagcgctagtttagagttttataaatggat

SEQ ID NO: 67665 - DNA, 201 bp, Homo sapiens
tcccttgcttctgttgctagggaatgctgaaatactagaggtttagaaaggaaagtaaggctgcagacctaacataggccattccacatttaaaaatccaycaccaacgttttgtaccaggagaggtatagcacttccagtagttcccaaagttcctagatgcaagtgttatcctcccgaccttctactgactgtccaatt

SEQ ID NO: 67666 - DNA, 201 bp, Homo sapiens
gcctcaagccatccacctgcctcagcctcccaaagttctgggattgctagcatgagccaccatgcccagccacatgtactatcttattaacatgaataaayaagtaaagaagaaaagaccatataaatgaaggaggaattccagatatgttatgatcagatttatttaaaattatatgtttgaatatgtgtactcttacgc

SEQ ID NO: 67667 - DNA, 201 bp, Homo sapiens
atgtccagcctacatgcaaggatagataattacattcagacttaaataaaaggagtcaaggatcacttgggtctatgttagaggcagcctatcatagtacrgatcaataactagttggatggatggatggatggatggatggatggatggatggatgtggagggatggtcagtcaggcagacagatgatgggcaaatagat

SEQ ID NO: 67668 - DNA, 201 bp, Homo sapiens
atttttgttaggtatatttgatcaggttaaggaagttctcttcaattgccatttatttatttgccatgtgttaaaaaattgtgaatggatattgagtttcrttgaacttttaaaatacatctatatagatataatcatataagatttctcctttaatgatattaataggtacttttcatgttaaaccacttgaattcatgg

SEQ ID NO: 67669 - DNA, 201 bp, Homo sapiens
tggatagtgtcttctttttgtccatgaattaaaaggcaattaatttaaaaagatcattttttctgagacaaggtctcactttgttacccaggctggaatgyagtggtgcaatcatggctcactgcagcctcaacttcctagacttcagtgatctttccacctcagcctcccctagtagttggggccacaggcatgtgccac

SEQ ID NO: 67670 - DNA, 201 bp, Homo sapiens
ctttgggtcttctttaatatatttattatataattatacaacttttgtttaaaacattttttgctactgttgtggatagtgtcttctttttgtccatgaawtaaaaggcaattaatttaaaaagatcattttttctgagacaaggtctcactttgttacccaggctggaatgtagtggtgcaatcatggctcactgcagcc

SEQ ID NO: 67671 - DNA, 201 bp, Homo sapiens
atccatcttttgcatcttgtaacttctctttgtgcatcctggtaatccttttgtcattctcctggcatttatagcatacttgaaacttgggactccatggwctttcagaacttttccaggtttaaacagagagctctggggacaatgtatttcccaagagagagaaaggctaagtactccaattattattattcattttgt

SEQ ID NO: 67672 - DNA, 201 bp, Homo sapiens
tagagtaagtgtgatgtggtgctcagaatgtatattctgttgatttggggtggagatttctgtagatgtctgttaggtcacttggaccagagctcagttcragtcctgaatatccttgttaattttctgcctccttgaggtgtctgatatacacagtggggtgttaaaatctcccactattattgtgtgggagtctaaatc

SEQ ID NO: 67673 - DNA, 201 bp, Homo sapiens
gtcatttggtttgattgccccacaaagcataagatgtaaactgattaagggtatgaaagcaaagtgaaagacctcagatcttgtgcacattttgttttccyattatttcttttattgactgtagtgcatgatacctaatcaaggctccaatgtcttgcacaattcctactttaatgctagtggttttcagtgtccttacaa

SEQ ID NO: 67674 - DNA, 201 bp, Homo sapiens
aaggttatttttagaaatgactgggtgcccttttgcaaaaactgttttgaactatttatatgaattgtagtatcaaatagtgccaaatttggatacaaatrtccttttaggcagcaaagtactatttaaagtatgaattaaagtatttggaaaatgtttgcccttatcgtttaacacattcatgttttactcgtgaattaa

SEQ ID NO: 67675 - DNA, 201 bp, Homo sapiens
cataacaggaacttagtcacttgtaggtttgtaaatgtgattcaaggatttctgtgaaatttgaatattgctaccaagtgctgcttcatttcattttcacrcctacctactcagtgagtggaccaccagttaggtaatactgcatgttatcttcccaaaagtgtgaacaaggagggttatataaggcattttatactttgt

SEQ ID NO: 67676 - DNA, 201 bp, Homo sapiens
tatgaattgtagtatcaaatagtgccaaatttggatacaaatgtccttttaggcagcaaagtactatttaaagtatgaattaaagtatttggaaaatgttygcccttatcgtttaacacattcatgttttactcgtgaattaagcacaaatcgtagaacagatttgtattggtacagccaatgtatttgagtggagcccaa

SEQ ID NO: 67677 - DNA, 201 bp, Homo sapiens
ttaatcaatattgttgactattttataaatatttcaatgcctactatgtgcctaaaagtattctatgagaaatgtattgaatctactttttgaatcttcaytgggtttcgggatagaaactttagagtcaaatgaattttctgggattcactgtacatcaactaatcccctagtcttaatttaaatcttttcaacatcagg

SEQ ID NO: 67678 - DNA, 201 bp, Homo sapiens
ccctttcttaatgagactttctaaattttaatatgatggataactcaattttaaagtatagtttctattttttatagcagctttattgagatataattcayataccataaaatttttagtatacttgcagaattggtcagccacaatcaattttagaaatttccatcaccccatccctggctcacattagccacaggcagc

SEQ ID NO: 67679 - DNA, 201 bp, Homo sapiens
cctgccacagagggagatactcttacaaatggagcttttcttcatagatctaagtttcccttacaaaacagtatcttctactctgttttttttttttttaattatacttttaagttttagggtacatgtgcacaacgtgcaggttagttacatatgtatacatgtgccatgctggtgtgctgtacccattaactcatcatt

SEQ ID NO: 67680 - DNA, 201 bp, Homo sapiens
tttgaatatttgcaatactttatgtattaggcaagcctttgtgacatattcaacaatatctttacaccagatagtagagaataagcagaaaaaccacaatragtgatgcacataggtcttggcctcatgtgggggcattgtggggaacctggcattggcatatcccattggcatatccacctgcacatgtgccattttatt

SEQ ID NO: 67681 - DNA, 201 bp, Homo sapiens
ggtcagcaacgcacttgaggaggcaatctgatgcttagcagagcttaagcactgtgctgggagactccctgctctcttcagagctggcaggcaggagtgtktaagtctgctgaagctgcgcccagagccaccctttcccccaggtgctctgtcccaaggagatgggagttttatctataagcctctgactggggctgctgc

SEQ ID NO: 67682 - DNA, 201 bp, Homo sapiens
ggcacaaatctactttctgtctctatacatttggctctcctggccatttcatgtaaatggaatacagtatgtggtcttttgtgactggcttttttttttttaactagagaaacgttttcaaggttcattcatgttgtagcatttatcagtacttaattcatttttattgcaaaataatattccattgacttgataatacca

SEQ ID NO: 67683 - DNA, 201 bp, Homo sapiens
gcagtgacctctaccttggccctgactcagctggtatgatggttctttgtgcaaatattttctcaaccttcaatttgtcacaagtagctaagcattatccygtgaataatagatttatgattttgctagcattagcacagtgactaggatactaacttattccagctgtgtttcctgggtttgagttttcttcccaggaac

SEQ ID NO: 67684 - DNA, 201 bp, Homo sapiens
atttcacacagtagacactttaatttacaacttgctgcactgcagcacttttctaggccttttactatgtaataaggcattcttgtagctgctgaggcttyacaaatatagatacactttcttagttcagattttttctttcttttcaattttcagttgcaaatcaaacatgcagttacagaagcagagattcaaaaattg

SEQ ID NO: 67685 - DNA, 201 bp, Homo sapiens
gggtctctggcctgcaggcctaccctgcagattttggatttgctagtccctactgtcatatgagacaattccttaaaatcaattttaatataaatatatakagtatgtataaaaaacacatataaagatattaattctatttttctggaaaaccttgacaaacgtaggcttccttgtgttgccgtttgaactagcatgctc

SEQ ID NO: 67686 - DNA, 201 bp, Homo sapiens
aaaacgtgtagaaaagctggaacttttcccagtggagctagagaaaggttcgtgagtgctacagtgttaatatcattatgttgctatgttaataatacagrattatttttccaaaatgtagccttttttctaaggattggataaaattttaattctaacagaggatcttatttattaagtttcaaaaatagttgatatgga

SEQ ID NO: 67687 - DNA, 201 bp, Homo sapiens
aactcacatggtcataatatattatcctttcaacatactgtttaatgcagtttgctaatgtagtgatgaattcttccagcttttatgtatctgaaaaaaaktatttttcttgcctttatttttgaagatatttttactgattatacaattctaagttgatattttttttcattactttaaagaagttgctgcattatcttc

SEQ ID NO: 67688 - DNA, 201 bp, Homo sapiens
tcactgcaacctctgcctcccgggttcaagtgattctcctgcctcagcctcccgagtaggtgggactataggcgcccaccaccacacatggcttttttgtrtttttagtagagacggggtttcaccatgttggccaggatggtctcgatctcttgacttcgtggtccacccgcctcgggctcccaaagtgctgagattaca

SEQ ID NO: 67689 - DNA, 201 bp, Homo sapiens
gcccactgtattttaaacacgtacccccaggtaattctgatatagatggttagaggaactctgctttcgagtgtttctaagccaatttgttattttggttrcaaggatattagaggtgattttattggtatttaccctaccgagtcagtagtgcctaaatcctaacattcagttttcctccttatgaaacccctggcagag

SEQ ID NO: 67690 - DNA, 201 bp, Homo sapiens
ccaggcatagtacccaatatttagtttttcagcccttgcttccctctcttcctttcccctctagtagtccccagtttctattgttgccgcctttatgtccrtgagttcccaatgtttaacttacacttataagtgagaatgtgcggtatttgattttctgttcctgtgttagtttgcttaggataatggcctccagatgca

SEQ ID NO: 67691 - DNA, 201 bp, Homo sapiens
aatgggggtcccatcagtgccaaacttgtttactggcacaagtaaattttaataagtccagcttatcaattctttctttcatggtttgtgcatttgtgttwtatctaaaaagtcatcactatccagagttatctagattttctcctacattgtcttctaggagttttatagttttgcatcttacatttttacatttaagtc

SEQ ID NO: 67692 - DNA, 201 bp, Homo sapiens
gtattgttagtattttggattttggctattctaatacatgtagtgggtatcatgttgttgttttaatttgcagttccctaatgacatatgtggagcatctkttcatctacttatttaccatgtgtatatcttcattggtgggatatatctgtttaatcaaattgattgttttgttattgttggcttttaagaatttttaaa

SEQ ID NO: 67693 - DNA, 201 bp, Homo sapiens
atttcttaaaccttggtaaaattgatcccacatttgtggctaaccttgtaagtattatggggaaggagaccctccaattcattttaaattgtgattatatrgcatttgcataggcctgagatgttttccttaagttcgactattgtgtatatgatattctaatgtgttacttaaaatatgctttcaaacactgggtataat

SEQ ID NO: 67694 - DNA, 201 bp, Homo sapiens
tatttcttaaaccttggtaaaattgatcccacatttgtggctaaccttgtaagtattatggggaaggagaccctccaattcattttaaattgtgattatayagcatttgcataggcctgagatgttttccttaagttcgactattgtgtatatgatattctaatgtgttacttaaaatatgctttcaaacactgggtataa

SEQ ID NO: 67695 - DNA, 201 bp, Homo sapiens
atgtgaggatctagctttatttttcttcataaggttagcataatttcctaataccatttattgtataatccaccttctcttcattattttgacatattttrtatctcataaaccaaagttttatatatttgaatttggatctttctggactctctgtttcatcaatctgtctactcctacactagtaataacaattattgt

SEQ ID NO: 67696 - DNA, 201 bp, Homo sapiens
ggaagattgaggctgcagtgagctgtgattgagccaccacactccagcctgggcaacagagcaagaccctgtttcaaaaaagaaaaagaagggctgggccygaaatctatgattttcatatctgtattatatacagtttcttgcttagcgtctagaattacctattatttaggatagattcctaaaaaaatataattttat

SEQ ID NO: 67697 - DNA, 201 bp, Homo sapiens
aaacctgtaagtaagtcttttgaaaaataaaggctggctggaagattgaggctgcagtgagctgtgattgagccaccacactccagcctgggcaacagagyaagaccctgtttcaaaaaagaaaaagaagggctgggcccgaaatctatgattttcatatctgtattatatacagtttcttgcttagcgtctagaattacc

SEQ ID NO: 67698 - DNA, 201 bp, Homo sapiens
atgttttattcttttttttttttttttgagatgaagtctcgctctgtcacccaggctggagtgcagtggtgtgatctcggcccactgcacctctgactcckgggttcaggcgattctcctgcctcagcctcccgagtagctgagactataggcatgtgccaccacgtctggctaattttttatatttttagtggagacggg

SEQ ID NO: 67699 - DNA, 201 bp, Homo sapiens
tgaaggatgacttgggtatcttggtcttctttttcattttcttttttttttttttttgaaatggaatcttgctctgtcacccaggctggagttcagtggcrtgatctcggctcactgcaaccactgcctcccaggttcaagcgattcttctgcctcagcctcctgagtagctgggactacaggcgcgtgccaccatgcccg

SEQ ID NO: 67700 - DNA, 201 bp, Homo sapiens
aaagataataagcactaatgttaaatgctacttagcaaatggatgcaaagctttgacagtaattttaggttatttctagatagtgtggacttaaaaaaagytttttagaaagctgttttcagttgacttagagttacttgtaatctgttattatcaaggtcaccccatggaagatctctgaatacccaatgaggcaagtgt

SEQ ID NO: 67701 - DNA, 201 bp, Homo sapiens
agcctcccaaagtgttgggtttacaggcatgagccactgtgcctggcctacgttttttttaaaaaaaacttattattacagataattatcttgtgggcatmttttcaccttgtattacagataattttcttttcaacctccagctggtgttattttcaggtgaagtcttcatcttaggctattatacatacatatgtacat

SEQ ID NO: 67702 - DNA, 201 bp, Homo sapiens
gaagttgtctggctgtggtgtccaggcacttttaattgaaagggaatctctgtgttatcgtggtatcagcagctatcaaataataggcattccatcaaacrgcaagggtgacctcttccaagatgcacataaactgctgcctgttcctactttggtttctgatagttattttttctcttaaccaaaagataattacagata

SEQ ID NO: 67703 - DNA, 201 bp, Homo sapiens
agagcccaagatccttcccaagttgaatttacattaaggagataagatttctccctccaccctccccagaggctgcagaggggacagctttccctctcctrtataatcaaccagattcatgtttttggagttcctcacctagagtgtagaccatgtgtaggatgacatctggttcccccagcatgctgatctcaatatttt

SEQ ID NO: 67704 - DNA, 201 bp, Homo sapiens
tattttttacctaatttctacacaattagtttcttttgattttgcactgttattcaatgcaatacctgaaagaaataagttttttttttttttttttttttgtcaaggctcacacaccagaagaactaatgataaatattctttgtaatcttctagaaattttagatgcatatataaatacatatatatataaataaatac

SEQ ID NO: 67705 - DNA, 201 bp, Homo sapiens
aagatatatgtaaatgagttcattacttataagagatattacataaaccatttaaatgccaggaaacagctacctctgaaatggtatctttggattatgargacgaatttgaagccattctttctcccagttcctaggagtgacttatgattctcttttttccaaaaatgatagcaagccagtaaattatagctaaaaaag

SEQ ID NO: 67706 - DNA, 201 bp, Homo sapiens
ttacagaagacagaatgggagacactataattttgctttggggtactttaaatctgaggtgctatcaagtcacctaactggtccagaagtatgaactgtcyatacagaatcaggaacccaggtaggaggtacagatgattgctgcatttgattttttgcttacagagcattcacctatttattttaataaagaaattacca

SEQ ID NO: 67707 - DNA, 201 bp, Homo sapiens
agctgggactacaggtgcgcgccaccacgcccggctattttttgtatttttagtagagacgggattttgccttcttggccaggctgctctcgaactccggrcctcaggtgatccacccacctttgcctcccaaagtgttgggattataggcttgagccactgagcccagccctcaaaatgtttttgaagtaatttttgtta

SEQ ID NO: 67708 - DNA, 201 bp, Homo sapiens
ttcaacttaattttaatagctaatggcaattgccatgtatggatggatatgagaaagttttcagaaaaatgagatatttatcttgaggaagatttggctgktgggaggaggagacataatagcttttttcagatattcagtgtaagtgagtttgcacaagttttaaaatctttggaagctaacttgatatcagcaagcaaa

SEQ ID NO: 67709 - DNA, 201 bp, Homo sapiens
gattcatgcttctctgcaacatggatgaacctggaggacattatactaagtgaactaagtcaggcacagaaagataaatactgtgttctcactcatatatrggagctaaaacatgagcggatagaggtagagagtagaattgtggttattagaggctaggagaggttggttaacagatacaaaattatagctagaagagag

SEQ ID NO: 67710 - DNA, 201 bp, Homo sapiens
tcaaggctgtttcattctgtttccaggtaaaatttggggcttgaggtactcttcccaaggtactcaagacctcagagtttaatgtttgcttttcatgatastctttaccccactctcccttccattcagaggtccagtcacccctgggggattttcatgggagagtgtaaacttctgtactggagaagcttaaaagtctca

SEQ ID NO: 67711 - DNA, 201 bp, Homo sapiens
ccttgtgcttccccttcttagcatctagtattttctgttctactttacttctatgagatcaacatttttttagcttcctcatatgaatgagacatgtggtrtttaactttctgtttttggcttattttacttaacataatgtccgccagttccatccttgttattgcaaattacaggatttccttcttttttatggctgaa

SEQ ID NO: 67712 - DNA, 201 bp, Homo sapiens
tagtttacctttctttgggctagctcacatggattacagaagtgagcttactatttatatgaacaaatataaattgacctttactttctctttttttcccrtagttttgcaagaaaaaacttacttttatgatttttacatgtattaatctttacatttccttttcctcctttttgtacattaactgctgaattcagagtt

SEQ ID NO: 67713 - DNA, 201 bp, Homo sapiens
ttttaaaatttcaattttcggtgctagtatctagaaatgcagtgggttttaaaaatacttttattttatatcttttaatcttactggactctattagtagmagtagcttggaaattttgtcagattttttacccagactgccatgttgtctgtgaataaagatacttttacatcttccttttctctttgctcgagttactg

SEQ ID NO: 67714 - DNA, 201 bp, Homo sapiens
tgaaactagcagagtggtaaaattaactaaaagcttaactatctaaaaaacataataatatcttctagatagaaatatgggtcccagattatccattcctsaaatgctctataggattgtgtatttatgtggcaatattaaaaaacgtggaacagataacttgctataaataagccacaacttagaattcatgcttttagt

SEQ ID NO: 67715 - DNA, 201 bp, Homo sapiens
tagtatctagaaatgcagtgggttttaaaaatacttttattttatatcttttaatcttactggactctattagtagaagtagcttggaaattttgtcagaktttttacccagactgccatgttgtctgtgaataaagatacttttacatcttccttttctctttgctcgagttactgaactggctaaagcctccagctgaa

SEQ ID NO: 67716 - DNA, 201 bp, Homo sapiens
cctgactaccttgtcaaataccaaaaagttcagttttgcagccagagaatatcctgtttgaaagactttgtgatgactcattttatgggtcaacgttggtrggccacagtacccagatatgtgggtaaacattattctagagtctatgaagtatcttttagatgagatgaacatttaaagcagtgggctaaagcagattac

SEQ ID NO: 67717 - DNA, 201 bp, Homo sapiens
aagcctaacaaatttatttaaccgaagttttatctgacacaagagccctcagaaatgaagacttaaagacccagggaaaactgtgtattttttttttcatwggtgcgatgaacaaataaatagtcatgtagaagtatgattggactgaaaagatataatctattgggatcatagaggaaacttagaaaggcctgtttgttc

SEQ ID NO: 67718 - DNA, 201 bp, Homo sapiens
gtgaaatgaatgatgttgaagatacaggggttagccttagaaatattttatgtaactagactttgggtcaggcgaggcttgcagattaacagcttttggartaataacctaactagtactccatttgatcctgttttgtggtatgtaggattctggtgagtgatccacttagaaggttaaatgtatcctactgtagaatgt

SEQ ID NO: 67719 - DNA, 201 bp, Homo sapiens
atgcacttaagttatatagaaataattttatccttttggatcttgctttaaaaagttttgaacagtacaagaacagcatctggtccatggctcataattayttcactagtgagacaaagtccttctgaatacccagtctatttctccataaattacaatgttttccagtctggtagaaggactggatatatcttggggaaa

SEQ ID NO: 67720 - DNA, 201 bp, Homo sapiens
ctatcatttgaccaagcactcccactactgaatatctccccaaaggaaaagaaatggtatcaaaaagagacttgtgcttgtatgtttaacagaatactatycaatggaaatagtcttggaaatagcaaagtcatggaatcaacctaagtattcatcaatagatgactggataaagaaaatggggcatgtatacactatgga

SEQ ID NO: 67721 - DNA, 201 bp, Homo sapiens
atttatgaatcacattttaaaattcatatctgaaattttttattggatgttggatattatgactattatactattgtctagattttattatcttcttttamattttttgaaatttgttttgagtgctgtcaaagctactgtggtttagcttcattttttgaggcttttatcaaaacttcgttatagtgggtctggtgacac

SEQ ID NO: 67722 - DNA, 201 bp, Homo sapiens
tcagaactcaagcatcttgcagcccagtgagaccactgggaattatttagcttgcagctccccagtaataggtcacccagtctcatagaattttctcctcygtgtatatgtgtaacttagtagttagctattggcgtaaggggcctctgtgaagatttctggagtttttctctgccaagctctgagctcactagtactcag

SEQ ID NO: 67723 - DNA, 201 bp, Homo sapiens
ccagagatgaattcaagcagtctaagttaactactcttcatgcttggcacatggttgaaagaacaagaagtatatcttgtcaatagcgattgcaaatcctmtaaaatcacctaagtgtatggattttctggatgccttagcacatagccatgtatgtttgtgtgcatatacattatttgtttttgtagatttatatataaa

SEQ ID NO: 67724 - DNA, 201 bp, Homo sapiens
cctcccaaagtgctgagattataggcgtgaaccactgtgcccagccgatggtataacatttaaattggatttccttttaaatttttatgttttatgacctrtgcttcataaccaggtaaatgaaatatgtcaaatattttaatatactttgtaaaatcaaataatgaagatttgttgaatgaaccccttttctaaaatcca

SEQ ID NO: 67725 - DNA, 201 bp, Homo sapiens
tgacagcagattatttcagatgtttactggtatttatttgtaatagaaatatttaaagtttcttgttttttgttaatttaattaattttttttgagacaakgtcttgctctgtcaccctggctgtagtgcagtgatgcagtcatggctcactgcagccctgacctctggggctcaagtaattctcctgcctcagcctccca

SEQ ID NO: 67726 - DNA, 201 bp, Homo sapiens
tgtatgtttctcactaaaacctaagccaactcaagtattattaaaattttgataacaatcatcagtacaaatttgttatttaatatattgtaacacttttwtcttatcatgattacataaagcagacgtaacaaatttttttccaccaagagccataacagaccccaaatccattctagtttatatcaatgtgctggtcaa

SEQ ID NO: 67727 - DNA, 201 bp, Homo sapiens
taatctagcgtcatttcccagtcacttcaggaagcccttcagtagcatactcctgacagatgatgtttcagcttctgcttgaataattctaccgatggagrgtttattactttggaaggtaaaaggaaagttagaaggaggggcatgctggtgtgtgtagggaggtggtgcactcactcttctttttatttaattttaatt

SEQ ID NO: 67728 - DNA, 201 bp, Homo sapiens
tcaattttgctaggctctagagaatttaacctgagcttcaaattagttctccttttgtattctgcagcaggaaacaaccacttcctagacttgggtgggaraataaatattatgaacttgtctaggaataagtcaaccctatcaatgaaaagatcatgattttaactgagtaatttaggacagaggttggcaaactatggc

SEQ ID NO: 67729 - DNA, 201 bp, Homo sapiens
tactgtaaccatctataagatgagtgatttgaagcagatatttatttagtttactatgtattgtctgttggagcatattactatatagtctatattactawtaaatatcattaactagtaataataatggtaacatcgagaggtacttgatattctgtcaggttggacaagtgtgcctcttgaagccttgaatttcttacc

SEQ ID NO: 67730 - DNA, 201 bp, Homo sapiens
tgaaagaaccttttaaggtactttgccttcaagtaatgttaaagttgtttaaacagtgtactaataaaacctttcactaagtatggggagactgtgtaggkggtgtgtgtgtgtgtgtgtgtgtgtgtgtttgtgtatatattttttccctccaaaagtgatctaacaacttaaataattaagaattctaaacatactggt

SEQ ID NO: 67731 - DNA, 201 bp, Homo sapiens
tgtgtgtgtgtatgtgtatttttgtctataaagaacaattataactcaataatagaaagacaacccaattttcagtaatgggtaaaacagttgaaaagatrtttcactgcagaagatatgtgaatggtcagtaagtgcatgaaaagataatatcatcagtcatcagggcaatggaaattaaaaacattatgaaataccaca

SEQ ID NO: 67732 - DNA, 201 bp, Homo sapiens
ttttagatacaaggatatagagtggttcattattcaaagattcatccacatacaatttaaaggaaaagcccttaaattttttaaatttcatgtcaaattgktatgaaaagatgtcaatttggtaacatttaccactttaaagaaagactgtaaattaacacatgatggaagctgcctaaatttatgcaaactataaattta

SEQ ID NO: 67733 - DNA, 201 bp, Homo sapiens
aaaaattgtagaggtggggtcttgctatgttgcccaggctgttgttgaactcctgggctcaagcagttctcccacctcagcttcccaaagtgctgggattrtaggcacaagccactacacccagccaacattctgattttaaacaggcagcatagcagataacaaaagcaggaaacatttagttgtcagagcttgttcacc

SEQ ID NO: 67734 - DNA, 201 bp, Homo sapiens
agttagaaaataagctttgggctccatagtatgacaatagtgtcttccataataacatagtccctctgtctttgccgtcattttatggctgttttgccttrgtgctttgcctgtccctaggaatgtatggagaggaagacagggtgcagctgggttctcgatgggtcagccacaggaataataagtggcctttaaggatga

SEQ ID NO: 67735 - DNA, 201 bp, Homo sapiens
acatcttttgtttacttttctcagtgaaataaaacaggaacaatgtgaaggtagcttgaactacaaaaatacatatatcttgttggtgttgaacattaggrctcagaatgctgttggcctttagagttttttgtgttgctggaataccaggaggagtcatgctctgattattatctgattaattatccatttttttgtaga

SEQ ID NO: 67736 - DNA, 201 bp, Homo sapiens
acttttaagtttttttttttttaatttatttatttttattatactttaagttttagggtacatgtgcacattgtgcaggttagttactccatactgttttycattgtggttatactagattacattcccaccagccgtgtaaaagtgttcccttttcaccacatccatgccaacatctatgttttttgtcttttaattatg

SEQ ID NO: 67737 - DNA, 201 bp, Homo sapiens
tctgcaactggattttcagctctgcaaatctgagtaattttccagttaaaagcaatgagaggagcaatggaaggaagaaagagaattctaccaagacctgwgtctaggcagagaaaatggatttagaaaccaagaagtaattttcactcaagatagttgcaggaagaaattatttaatggtgtgacagtatggagatttca

SEQ ID NO: 67738 - DNA, 201 bp, Homo sapiens
cgagatcgcgccactgcactccagcctgggcgacagagcgagactccatctcaaaaaaaaatgtatggagaggtagctagacaaaggaaaggggtttgggrcttctgtggggcagagcaatgggtaacttgtgggaaagtaactagaaaatgtatagtaattaagagttgtttactaagatttgttttgcagattaggggt

SEQ ID NO: 67739 - DNA, 201 bp, Homo sapiens
gggattacaggcatgagccaccgcgcccagccaagataccttatttaaattaagattcatcatgcagttctgatgtagttcttttgtaagtagtgcggcaraatttttcatacccatcattgtgtcctaaacactcaaaataatgcttcatacatgatataggtgttcaggaagtgtttgtagaatgagaaaataaatctg

SEQ ID NO: 67740 - DNA, 201 bp, Homo sapiens
aaattatatgtttgaatatgtgtactcttacgcctaaaataattcattgcattatttagagaatctaggttttaaggcagagtgactattcaataatcaarttgttaccttttcttgagaccacagtgaattaccaacagtagtagtaaaatgatgctaaatgcatgagccttttggaggatctcattagatacccttact

SEQ ID NO: 67741 - DNA, 201 bp, Homo sapiens
tccttgcccatgcctatgttctgaatggtattgcctaggttttcctctagggtttttatggttttaggtctaacatttaagtctttaatccatcttgaatkaatttttgtataaggtataaggaaaggatccagtttcagctttctacatatggctagccagttttccatttattaaatagggaatcctttccccattgct

SEQ ID NO: 67742 - DNA, 201 bp, Homo sapiens
ggaaagagaatattagtgaacaatgacttctactttgagactttgaacaccaagagaggcaggcctcagatgatcaaggtaatgttaattggctaaaaaaattgaggaatattttttgtgagaatatcaaggggaaaaagaggagacagggacatttatttatgattcatatcaaactggaaggtagttttcaattgtgac

SEQ ID NO: 67743 - DNA, 201 bp, Homo sapiens
tccaggtgaaaatttcctacctattggaaatataatttgtagtttttgactgatttatcttatattgataaaagatagggcatttaggaagaatttttatrcatattattttgttttctccctcaacttctttgtaaggtaggtgaacagatgaggtaaatgatgcagataggctaatcgtctctctccaagtcacacagt

SEQ ID NO: 67744 - DNA, 201 bp, Homo sapiens
gaataactttatgtgcatacactagaaaacctagaagagatggataaattctttgtaagatacaaccctcctagcttaaatcaggaagaattagatacccygaacactccaataacaagtagtgagattgaaatggtaatttaaaaattaccaacaaagaaatgtccaggaccagagagattcacagcagaattctatcag

SEQ ID NO: 67745 - DNA, 201 bp, Homo sapiens
agaggtagctgaggtgggtgtctccaggtaggacacgtgaagatgggaataagttcaggggacctgagaaaggtgcttggtgcctaaagtcagaggaaagycaaattagggattccttttagggaggtgaggagagcaacttagacgtgatgttgcatttgtgagcttggaacccagagttaaaagaaaatatacagaatt

SEQ ID NO: 67746 - DNA, 201 bp, Homo sapiens
gggcctcccaaagtactaggattacaggcgtgagccactgcacctcgccccaagttgctttcatttttaattcactcttaatttttcacctttttctagatagctagttcagaattattctagatatatacatcttagtaagtatggtgatttaaaattactttggacaactttaagtttactttttttaaaaaaggaatt

SEQ ID NO: 67747 - DNA, 201 bp, Homo sapiens
ttaaaatagggagaggtaactttcaatcccaaacatagatcaaatacttagtaatttgtttgacctataatgctggttctcaaccctggctactctttacratcacctgggagcttcttaaaattaccagtgtgatcttaaccccagagattctgatttattgttggtctgggttagggcctaggcatggttaattggatt

SEQ ID NO: 67748 - DNA, 201 bp, Homo sapiens
actgttgcgttaaggatcgttttcaacatataacattcaaaccatagcagttggcaatataataaaagtagacccaaatatacgactgctaaattcaaagrattattatgttgttttatgtacatttaatgaatagctttaaatttttttatgtttaagtatgtatcatttgaccatcttatcaagaaataataaagcatg

SEQ ID NO: 67749 - DNA, 201 bp, Homo sapiens
cctggctactctttacaatcacctgggagcttcttaaaattaccagtgtgatcttaaccccagagattctgatttattgttggtctgggttagggcctagrcatggttaattggattccttaggtaattctaatgtgtagtcagaattgaaaaccactgccttagaaacacacagttgaactttcttttatcttcatatgg

SEQ ID NO: 67750 - DNA, 201 bp, Homo sapiens
ctgttgcgttaaggatcgttttcaacatataacattcaaaccatagcagttggcaatataataaaagtagacccaaatatacgactgctaaattcaaagarttattatgttgttttatgtacatttaatgaatagctttaaatttttttatgtttaagtatgtatcatttgaccatcttatcaagaaataataaagcatgt

SEQ ID NO: 67751 - DNA, 201 bp, Homo sapiens
tgggcagaataggaggaacagggaggggaggtgctacacacttttaaacaaccacataccctgagaactctattatgagaacagcactaggggaatagtgmtaaaccattcatgagaaatcacccccatgatccaatcacctcccaccaggccccacctccaacatgggggattacaatttcacatgatgtttgggcaggg

SEQ ID NO: 67752 - DNA, 201 bp, Homo sapiens
attatcctagaacagagataatggaagtaatttttcatggaaaaactatatactttcgtttgtaagctgttagaattggcattttgttggttgggtgccargctgctagactatgcaccacgtgggcagggattttgttttgctcaatgttgtattcctgatgaaaggtaaatgattttaattttgataaagtgatttatt

SEQ ID NO: 67753 - DNA, 201 bp, Homo sapiens
tgcaggtttgttacatatgtatacgtgtgccatgttggtgtgctgcacccattaactcatcatttacattaggtatatctcctaatgctatccctcccccytcccccaaccccacaagagactctggtatgtgatattccccttcctgtgtccaagtgttctcattgttcagttcccacctatgagtaagaacatggggtg

SEQ ID NO: 67754 - DNA, 201 bp, Homo sapiens
agatcttaagaacttatttatttatttatttatttatttatttatttatttatttgagatggagtttcactcttttgcccaggctggagtgaagccgcacratctccgctcactataacctccgcctcccaggttcaagtgattctcctgcttcagctccccgagtagctgggattacaggcatgcatcaccagacccggc

SEQ ID NO: 67755 - DNA, 201 bp, Homo sapiens
atagatgaaaacatatagtcagttgactttctttttttcttttttttttttttttgagacggagtcttgctttgtcacccaggctggagtgcagtggcgcratctcggctcactgcgaaccccgcctcccaggttcacaccattctcctgcctcagcttcccaagtagctgggactaaaggtgcccgccatcacacccggc

SEQ ID NO: 67756 - DNA, 201 bp, Homo sapiens
ctcacttccttctttttcataccagctttcaattgcttgtttctaaacaatgcgttatctttgattaaattagaccagtaataaaagctcgtgaatccttraatgaaaagcacacattctggtcttcttgaccctgcattccaaaattattctctaatgtttataaccaccttggtagataaagtcttctttttccttctc

SEQ ID NO: 67757 - DNA, 201 bp, Homo sapiens
atggggaatttctaaacttctaaaaacataaaaacatataggtaataagtattttttctaacaccactagaaccattagcttatcatattttggtttaaasataaatgtggctctcataggttaagaaattccttttgatagcataatatgagccatagtatcttggtcctttaacaacactacgtaacattcctatctta

SEQ ID NO: 67758 - DNA, 201 bp, Homo sapiens
acctgggaggtggaggttgcagtgagctgagattatgccattgcgcttcagcctgggggacagagtgagactccatctcaaataaataaacaaacacacaracaaaccaagcttcagttttttctcctgtaaaattgaaataatgtctattttatggttttatggtaagaaacaaattacatgataaatatggtcagctaa

SEQ ID NO: 67759 - DNA, 201 bp, Homo sapiens
tttcttgtgagttttattcctaggtattttattctctttgtagcagttatgaatggaagttcactcatgatttggctctctgtttgtctattattggtgtwtaggaatgcttgtaattttggcagattgattttttatcctgagactttgctgaagttgcttatcaacttaaggagattttgggctgagacgatggggttt

SEQ ID NO: 67760 - DNA, 201 bp, Homo sapiens
cacatcaggaaggggaaaggagttacagagatacaaagatagagacttgcatttatttctggtaaagtaggttaacattacctatttagccatttaaaatkagccatttaaaatatgtaatagtaacttagagctgtgcacaaggtcatggcagatttggaatcagagatgaggtcctgaaagaaccagtgctgggcttag

SEQ ID NO: 67761 - DNA, 201 bp, Homo sapiens
gtccctttaagacagattttaggtactccatttgctacacaatttcattaacttagaaccatatttttaaaatgttttctccacacaagtaagatacatayggaaaatttgctactatgcagtccctgtagcatatataaaaaatgaggctgctaaattaggtcttttcttctttaccttctttaaacctacgttattctt

SEQ ID NO: 67762 - DNA, 201 bp, Homo sapiens
tccttcattgttttggaagagtatcctccatcattgaagagaaatgtgtcattatttacaacttgttcatttcttctaaagactttctaaattaactgatrtcttcaaaccaaagagcaatgcagaaaaagaaaaggtctgcagaaagtggctgagtgggagaaagaggtgtaatctagttacctgtttctctgcagccct

SEQ ID NO: 67763 - DNA, 201 bp, Homo sapiens
attgccttctgcctggctcttcctccttcctgtctattacttggtgtgcaaagctagggaaaggaagcctctgggtatcaccagaggcccagcttctgtgrtctccttcaccgcacatgtaagaaccacatggcctcaagaccctcctcagtgctggatgcacaggtccatgtggaattattagtcttgaatatttttctg

SEQ ID NO: 67764 - DNA, 201 bp, Homo sapiens
gaggagactgggaacctcgtgtgggaaaggggtagttgggccctctattaaacagcagctgatggccaagtagggcagaaacccatgtgtgactattgaawatcaaccttgcgtttacctgaatgtgtctacccaaaactggattcataatactggttttcaattttgtcttatggaaacttgttcttccttttgtttact

SEQ ID NO: 67765 - DNA, 201 bp, Homo sapiens
ttgaactacaaaaatacatatatcttgttggtgttgaacattaggactcagaatgctgttggcctttagagttttttgtgttgctggaataccaggaggartcatgctctgattattatctgattaattatccatttttttgtagagcaattaaggttaataaaaataatagaactattgtaagaaaatggaaagaatcaa

SEQ ID NO: 67766 - DNA, 201 bp, Homo sapiens
catgtaataaatttcctttccagatgggctgctatatctggttgggtggaataatattctctgaagatgaaataaggtataatcttgtaaagtgcatgaayactctgtttctggatcccaaagtggattattatccttaactcaaggcatttgggtcattaaaaagtcacatcctaggctctttgtgtggtttaagttttt

SEQ ID NO: 67767 - DNA, 201 bp, Homo sapiens
aaaaatgactttttctcataatcataagtcatttgttttctcatagctaataattaatattaatttctttttatattatagaataagagaaacaacccctscatgtattttactttaatttagttttatcttttcctatctggttcagtatttttatctcttcagctctctataagtttactactcaagggagttcttcag

SEQ ID NO: 67768 - DNA, 201 bp, Homo sapiens
gccaaggaaaatagaactcctgtttttggtgcatatgtcacagctgagcctttctgtttgaagagcttcatttaataatttttgccttttggagtgtaggygctagactatatcctagacactgtagcattgataaatgttaacatacagaggccgcgtatattctttgcaccaaatactttccttgttcacactgttctg

SEQ ID NO: 67769 - DNA, 201 bp, Homo sapiens
ctatgaaggtctgaaatctgtagggcaggcagtgaagatgggaggctggaagcctcaagcataagttgaagctgctgtcacaggcagaatttcttttatcktcaggaaacttcagctctgctcttcaggcctttcaactgattcagtgaggcccacccagattatttaggataatttcccttacttaaagtcaactgattt

SEQ ID NO: 67770 - DNA, 201 bp, Homo sapiens
gatagtttgctgagaatgatggtttccagcttcatccatgtccctacaaaggacatgaactcaaaaaaaaaaaaaaaaaaaaaagatgcaagtcttttcaragtgtggcttgccttaaagcttttagttaatgtgaggatgttgctggaaaaaaatcaagtcctgttgaaatgaaattaagggttgatggcagtaggatat

SEQ ID NO: 67771 - DNA, 201 bp, Homo sapiens
ctccctttttgggggctccgagtcatagttagggcattcatggatatatgaagtttttttgttcaggatggttttcagggaatagttctgttgagatccarctttttgtctttgcggaggcttcctttataacagttttgtcagtgcttcttaaactttaatatgcatatgaatcacttgggagatcttgttagcatcaag

SEQ ID NO: 67772 - DNA, 201 bp, Homo sapiens
gcatcagatggcatacccaaagggtttacttgaagagagtttaatacacagactttgaacagagttaatagtactaacaaggggtggtgaagtgcacaggkactggcaacagcaggaggctgttaccatcaacatctgcagctttataagatgcacagccactggtaaaagctgcatccttggggcaagggtaagaataca

SEQ ID NO: 67773 - DNA, 201 bp, Homo sapiens
tttgaatagctgtgtgaatgtgtacttctttccttgaatctaaaataagattagaccagatatggcaaatacgtttcttttgtccttcccttaaattgatytcatagttaactgctttggagattctgggaagatggctgcacttgcctcacattcttcacctggataatccaccacagggagcggagtcccatgccttgt

SEQ ID NO: 67774 - DNA, 201 bp, Homo sapiens
attagctgggcgtggtggcacacgcctgtagtcccagctacttgggaggctgaggcaggagaattgcttgaacctgggaggtggagattgcggtgagccgrgatcgcaccattacactccagcctgggtgacagagcaagactcttgtctcaagaaaaaaaaaaaaaaaaaaaaaaagacaaacaaaacacaaaaagcaaa

SEQ ID NO: 67775 - DNA, 201 bp, Homo sapiens
gtaatgaataacacaattactctttcttgctgcttccattgttaaatatgcaagtggattcacttggaaaatttgagagctgctttctactggtcatggtrgtggccatagtgtttaggttattctccaattaagattttttttgctgcagagggtggtaataccttattagatccaattaaagtatttattgaaggctta

SEQ ID NO: 67776 - DNA, 201 bp, Homo sapiens
gtgaatggttctgtcttgctggtgttacaggtgccaccggggtatgaaaaaatactcctgcagctagcttggtgtctgcctaaacagccacccagttttgwgcttgaaacccagggccctggtggcataggcaccggagggaatctcctggtctaaaggttgcaaagaccgtgggaaaagtgtagtatctgggccagaatg

SEQ ID NO: 67777 - DNA, 201 bp, Homo sapiens
acatggttagtcccaagcataattttgaagtaagtaaaatccatcttttgcatcttgtaacttctctttgtgcatcctggtaatccttttgtcattctcckggcatttatagcatacttgaaacttgggactccatggtctttcagaacttttccaggtttaaacagagagctctggggacaatgtatttcccaagagaga

SEQ ID NO: 67778 - DNA, 201 bp, Homo sapiens
ggagaggcagtctggctacagtggctttgctgaggtgtggaaagctctgcccagctggaacttcccctctgctttgtttacactgtgaggggaaaaccacrtactcaagcctcagcaatggcggacacccctacccccaccaagcttgagtgtcccagttcgacttcagactgctgtgctggtagtgagaatttcaagcca

SEQ ID NO: 67779 - DNA, 201 bp, Homo sapiens
atttatttacctttggtttttgatgttggtgaccttcagatggggtttctgtgtgcacatcctttttgttgatgttgatgctatttgtttctgtttgttasttttccttctaacagttaggcctctctactgcaggtctgctggagtttgctggaggtctactccagacccagtttacctgggtatcaccagtggaggctg

SEQ ID NO: 67780 - DNA, 201 bp, Homo sapiens
gcagttgctcttcttgaggagtaactttttagtattctctgtatttcctgaatttaaatgttggcctgtcttgctaggttgggcaagttctcctggataaratcctgaagagtgttttccgacttggttccattccccctgtcactttcaggtacaccaatcaaccatagatttggtcttttcacatagtcccatatttct

SEQ ID NO: 67781 - DNA, 201 bp, Homo sapiens
ttttgttaatattgatgctattcctttctgattgttagttttccttctaacagtcaggcccccctgctgcaggtctgctggggtttgctgcaggtctaccycagagcctgtttgcctgggtattaccagtggaggctgtcaaacagcaaagattgctgcctgttcctgcctctggaagctttgtctcagtggggcaccttc

SEQ ID NO: 67782 - DNA, 201 bp, Homo sapiens
tgcctggcgaaaattcttttctttaagaatgttgaatattggcccccactctcttctggcttgtagggtttctgcagagagattcactgttagcctgatgkgcttgcctttgtgggtaacccgacatttctctctggctgcccttaacattttttcctttatttcaaccttggtgaatctgacgattatgtgtcttgcagt

SEQ ID NO: 67783 - DNA, 201 bp, Homo sapiens
ataatttgacaatagatcctccatatcttctcatattctggtgcttattttacatatttgtaacttaagtatttaagaagagacctttccaatttattaaraattattggataagacaccagctcaacagtttagtaagttttttttgttttagtaatgtttccaagtggtgacactgtgtgtatttaagtaattagtgaa

SEQ ID NO: 67784 - DNA, 201 bp, Homo sapiens
taatattagtattattctaataacccagtaggttgagtatactaggtattattcccatttcattaataagtaaataaaaaaaactgatagcctgagtcatygggccggacaaattcagagccaaaaatctataatattttaagcaaaaggttatgtttgaaagactgtgaggttccttatatgtataaaattggatagatt

SEQ ID NO: 67785 - DNA, 201 bp, Homo sapiens
ttaaaattagccatttaaaatatgtaatagtaacttagagctgtgcacaaggtcatggcagatttggaatcagagatgaggtcctgaaagaaccagtgctrggcttagctgtcagttttgcaggttaagctagactgttagcgtatccgtacaaaatagttatgaagattaatgttgccttctgtagaatgattttgcctg

SEQ ID NO: 67786 - DNA, 201 bp, Homo sapiens
tcttagcccaaaatctccttaagctgataagcaacttcagcaaagtctcaggatacaaaatcaatgtgcaaaaatcacaagcattcttatacaccaataasagacaaacagagagccaaatcatgagtgaactcccattcacaattgcttcaaagagaataaaatacctaggaatccaacttacaagggacgtgaaggacc

SEQ ID NO: 67787 - DNA, 201 bp, Homo sapiens
tgcttccagtttttgcccattcagtatgatattggctatgggtttgtcacaaatagctggtcttattttgagatatgtgccatcaatatctagtttattgrgagtttttagcatgaaggggtgttgaattttattgaaggccttttctgcatctattgaggtaatcatgtggtttttttcattggttctgtttatgtgatg

SEQ ID NO: 67788 - DNA, 201 bp, Homo sapiens
aaccctatcaatgaaaagatcatgattttaactgagtaatttaggacagaggttggcaaactatggcccctaggccaaatctagacctctgtttgcttttrtaaataaaggtttattgaatacagccatactcatgcctgtaagtattgtctatggctgctttcctactgtaaaggcagagcaagtagttgtctgccttcc

SEQ ID NO: 67789 - DNA, 201 bp, Homo sapiens
ttctgagaattgaaaaaattttatgcatgtcacaaattaaacttacaaatatagtgactgtaatgttctcttaaatatgtcaatactatgtttagtgctartaagatttctacttataatcacaagtctcaatcagttattcaatttttaattttaatcagaactacaaggaattattgtcctgtcactctaataggtcat

SEQ ID NO: 67790 - DNA, 201 bp, Homo sapiens
gtaattcctggttaagtttttccttagggaagataggtgtgttgtgagactaggtattaggcccaaagcatatttcatctggatctcttatgttttatgtrcagttattaaggacaaaaatgatataaatatgtaaatatatcatttgcagttatcaatttttgtgataggaatatgtatgtttggtaaactgaatgtctc

SEQ ID NO: 67791 - DNA, 201 bp, Homo sapiens
gtgctataacctaaaaattgatatgaatcactgtgataaaggaagtttactctagtttattcatagatgaagaaaagtagcctggtagcttgaagctgttyttttagctttgctgcagatttataaaatgttcaacatttccatttacctctggacaggctgtagttttttttgttttttttttgttttttttttttttaa

SEQ ID NO: 67792 - DNA, 201 bp, Homo sapiens
ggaaacaaccacttcctagacttgggtgggagaataaatattatgaacttgtctaggaataagtcaaccctatcaatgaaaagatcatgattttaactgartaatttaggacagaggttggcaaactatggcccctaggccaaatctagacctctgtttgcttttgtaaataaaggtttattgaatacagccatactcatg

SEQ ID NO: 67793 - DNA, 201 bp, Homo sapiens
agaattctatcagacattcaaagaagaattggtaccaatcctattgacacaattccagatagagaaagagggaaccctccctaaatcattctatgaagccrgcatcaccctaatatcaagaccagaaaaggacataaccaaaaaagaaactgaagaccaatatctctaatgaacacagatgccaaaatccttaacaaaata

SEQ ID NO: 67794 - DNA, 201 bp, Homo sapiens
aaaaaaaagaaaaaaaaaaccctgaagctttgactcccaacctcatcatgagtaagcttaatctggcagagtatttaagctagatgagtctggaattagcwagaagactttttgttttttgttttcctttaaagcaaatctctaatactactaccacattgctaccaaaggcattactacttagagctagaggaaaagtag

SEQ ID NO: 67795 - DNA, 201 bp, Homo sapiens
ctcctggccatttcatgtaaatggaatacagtatgtggtcttttgtgactggcttttttttttttaactagagaaacgttttcaaggttcattcatgttgyagcatttatcagtacttaattcatttttattgcaaaataatattccattgacttgataataccacatttagtttattcattttgatattagttgatggat

SEQ ID NO: 67796 - DNA, 201 bp, Homo sapiens
aattttgatgaagttcaattcatctagttttttttgtcacttatactttgatctcatatcctagaagactttacatattctgagatcataaagatttactygttcatcttcctctaagagttttgtagtttttagtctttcttatatttaggtctatgatccattttagttaattttgtataaggtgtgaggaagggatat

SEQ ID NO: 67797 - DNA, 201 bp, Homo sapiens
tgagctactgattgtagggggaaataatgatgctatttacttttgtgattttcttcaaactgaacaatcaagttaaaacctaagataatgtttcaaaagtmatcactatatatgtggtcttatccttttatccttattttctctgtaagtgattccttttctgctcttctgatttcttaatatttttcactttcttcagtt

SEQ ID NO: 67798 - DNA, 201 bp, Homo sapiens
gaaggtacacaaaataaatttttagggcatgaaaagttgaaaggaatagctaatatattgagtagagaaataggaatttaacattatcacagtggactgaygtgctatgtcatggcaaataatatgttatttaatgtgaataaatatatatgtctgcattaatgatatataaaatattcacttaatttcgaggaaacagtg

SEQ ID NO: 67799 - DNA, 201 bp, Homo sapiens
gaatgcatgagaagtctagagaaggacttctcaattctagggaacctgatctggagaaaagatttctgacaatgagcataaaattattccaccttcttatraaaggcaggactaggatcactgagtatatagaaattttagggaagtagattacattaatatgtaatgatgtgaaaagttggaatcactcaatatggattg

SEQ ID NO: 67800 - DNA, 201 bp, Homo sapiens
agtacctagtttattgagtgtttttatcatgaagaggtgttgaattttatcgaaggccttttccacatctattgagataatcatgtggtttttgtcattcrttctacttatgtgatggattatgtttattgatttgcatatgttgaaccagccttgcatcccagggatgaagccaacttgatcatgatggataactttttt

SEQ ID NO: 67801 - DNA, 201 bp, Homo sapiens
agtttagtcaatttttaattactgtatattcttcccatccatttacacagttcagtggtttccttccttcattcatattccttaaatagtttttgttccayggactatcattttttattatatagtttctctgtccctgctgattgcattagtctagtactagcaaacagagggttatccaaatgtttaagaactaaacca

SEQ ID NO: 67802 - DNA, 201 bp, Homo sapiens
ttcccttctagtagttataaaatgttttatgaaattatttggatacacaaatagagaaacaaagaatttaaaaaatgcaactctcattccttgtcatgtctcatatgaaggacaagaaatccctttaatcttaacagaggtctttaaagttcagattataaaattacattcccaattattaatgcatgcatggggattatc

SEQ ID NO: 67803 - DNA, 201 bp, Homo sapiens
aaatgttgtttggccagttgtttatacatttgaaaaaaaataaaattagattgccaacacatattataattttagaaaatttccaggtggataactgcctraatacagaaaatcagaatgttaatgcattttgaagaaaacataggcccaaggcagtggctcacagctgtgatcctagcactttgggatgccaaggcagga

SEQ ID NO: 67804 - DNA, 201 bp, Homo sapiens
aattttctatagtttaacctgcaaataaatgtaattacaatgacaattttacctgaatagtaaaactttgcttttagttttaaatattttcacctttattwtaattagttcatgaaaatagaatttaaaattacaaatcatagtattttagaaagatacaaaaacaagcacttgtcttcatatctttctaaaatactatgg

SEQ ID NO: 67805 - DNA, 201 bp, Homo sapiens
agaataagaacaagacaaggatgcctactttcgtccacttcattcagcattgtaatggaggtcccagccattgtaataaggtatgtgttatggattgaatygtgtacctcaagaagttatgttgaagtcctaacctctggtacctttcaatgtattcttatctggaaatagggtctttgcaatgtaatcaagttaaaatga

SEQ ID NO: 67806 - DNA, 201 bp, Homo sapiens
aatagggtctttgcaatgtaatcaagttaaaatgaggccatgctgatttagggtgggtcctaatccaatatgactggtgtccttattagaagagaagagaygcagtgggaagacagccatatgaagatggagacagatactggaattatattccctcaagccaaggaacttctaggacaaccagaagctagaagagggaag

SEQ ID NO: 67807 - DNA, 201 bp, Homo sapiens
cccaaaacatgcttaaccaggaggctgattcatctgctgactccaagaacatgaagatgaacatgatagacagactgtccaccatctgaatgttcattcamcacccattcattcagtaacccttactcaggcccagatgagcagcacatttcttgccaacaatcattaaatgtccaagaaggctctcgttatcatcttctg

SEQ ID NO: 67808 - DNA, 201 bp, Homo sapiens
acaaaaacccaccagcactaccaccacctcaacaacagtgtagtctttggggacacttttagcttcgcccatgtcaattatgggattcattctgtatccartcatcgaagtgaacaaacttcctttaaccaagtcaaagacactcaaatgtacaatttgtgccaagatcatagagactcataattttcaggtgtgacaaca

SEQ ID NO: 67809 - DNA, 201 bp, Homo sapiens
ccatttaggacttttttttttttgcattatgagttttaaatttttcattcaacctctttgaagactatagcactctactttaaaaccattttttggagtcrattttggtaaggttatattttctttctttttaaattattattatactttaagttctgggatacatgtgcagaatgtgcaggtttgttacataggtataca

SEQ ID NO: 67810 - DNA, 201 bp, Homo sapiens
tacattttagcaaaagtaggttatttgttttaaaaatatagtcagttttctaattactgagtttgttattccctttgtttgtaaagtacttacctcatgcyatctgtgtgagtgtcctaccaaacttccaagtccatttcttttttaaaattgatatataatagttgtatacattttgggggtatatgtgatattttgata

SEQ ID NO: 67811 - DNA, 201 bp, Homo sapiens
atcaattttgttgatcttttcaaacaaccagctcctggattcacggattttttgaagggttttttgtgtctctatctccttcagttccactctgatcttastgatttcttgtcttctgctagcttttgaatgtgtttgctcttgcttctctagttcttttaattgtgatgttagagtgtcaattttctatctttcctgctt

SEQ ID NO: 67812 - DNA, 201 bp, Homo sapiens
agattacttaaagatgtaaatacttcatagtaaaaagtctggttaaatgctgaatatgcatttctgtcatatttttactttaaaaatatgtgtatttgcasctaggacaaagattaaaaacacatacatcaaaatgtcaactctggtaatttctggattgagagaacagtgataatgttaaatgaatgtatacttttctga

SEQ ID NO: 67813 - DNA, 201 bp, Homo sapiens
gacttcctaaaaagtctctttttgtctttctgttcatgaaataggtttctaataagcatcagatggcatacccaaagggtttacttgaagagagtttaatwcacagactttgaacagagttaatagtactaacaaggggtggtgaagtgcacagggactggcaacagcaggaggctgttaccatcaacatctgcagcttta

SEQ ID NO: 67814 - DNA, 201 bp, Homo sapiens
tttggaaggattggtttaaacatctgtattgacagtcatgatcagttttatatcttgcaggaaggtggtaacacttccggtacttgggggtgtaagagggwgtactgagcctttagaaaagggcggggttcgggggggagtgagctgaaaaactctccctagacaggaaaggtagaagacctcctcatccctttctctttg

SEQ ID NO: 67815 - DNA, 201 bp, Homo sapiens
ttttggaaggattggtttaaacatctgtattgacagtcatgatcagttttatatcttgcaggaaggtggtaacacttccggtacttgggggtgtaagaggkagtactgagcctttagaaaagggcggggttcgggggggagtgagctgaaaaactctccctagacaggaaaggtagaagacctcctcatccctttctcttt

SEQ ID NO: 67816 - DNA, 201 bp, Homo sapiens
gaggagaactggaggaggatgaatgttgaaaaattatctgttgggcacaatgttcattgttaaggtgatgagtatgctagaagctcaaaccccactactaygcaatatatccatgtaacaaatctgcatatataccctctaaatgaatgaaaaaaaatttttaatgcaatataacaatttaaaaatttttttagggcacaa

SEQ ID NO: 67817 - DNA, 201 bp, Homo sapiens
tgtctctgattcaggtgtcttgggtcttctgctggcatgagggaagccattgcgggctaacttgtagcttgcaagtagggtaaaatctcagacccttcatrgttcttgacattaccaaggtaattaaaagggaaaaggaaaatcttttcagaaatggcaccatattaactggatatccatctggaaaacaattaacattaa

SEQ ID NO: 67818 - DNA, 201 bp, Homo sapiens
taaaacttaaaaccatactacttagaaaaaataggctgggcgtggtggctcacgcctgtaatcctagcactttgggaggccaaggcaggcagatcacttgrggttaggagttcgagaccagcctggctaacatggtgaaactccatctctactgaaagtacaaaaattagttgggtgtggtggcaggcgcctgtaatccca

SEQ ID NO: 67819 - DNA, 201 bp, Homo sapiens
catagaaaagagctacatttttgttgttatttatttatttatttgtattatactttaagttctagggtacatgtgcagcacgtgcaggtttgttacataggtatacatgtgccatggtggtttgctgcacccatcaacccgtcatctacattaggtatttctcctactgctatccctcccctagccaccagcccccatcct

SEQ ID NO: 67820 - DNA, 201 bp, Homo sapiens
tttattagagttggagtttcaccgtgttagccaggagggtgttaatctcctgaccctgtgatctgcccgccttggcctcccaaagtgttgggattacaggmgtgagccaccatgcccggccttctctagttcttttaattgtgatgttagggtgtcgattttagatctttcctgctttctcttgtgggcatttagtgctat

SEQ ID NO: 67821 - DNA, 201 bp, Homo sapiens
tgacagcacaatcactggttattttgtaaagaaatttattttaaaacagtatgacggccaaaaaaaagctattggaaggagaggaagagaggacacacctrggttacatttggcctcttttaagtctgtgagacatgtttaaaaatctttaaagaaagcttactttgtcactatcccatttctgctataatcaacataatt

SEQ ID NO: 67822 - DNA, 201 bp, Homo sapiens
tttaagaatgttgaatattggcccccactctcttctggcttgtagggtttctgcagagagattcactgttagcctgatgggcttgcctttgtgggtaaccygacatttctctctggctgcccttaacattttttcctttatttcaaccttggtgaatctgacgattatgtgtcttgcagttgctcttcttgaggagtaact

SEQ ID NO: 67823 - DNA, 201 bp, Homo sapiens
catgctctgattattatctgattaattatccatttttttgtagagcaattaaggttaataaaaataatagaactattgtaagaaaatggaaagaatcaagwtcatgtagatgaaagggcttcctggtcagagaaaacacagaaagcctggcaggccatgagccattgtgtaatgacagtgcattgctctagacataggtgg

SEQ ID NO: 67824 - DNA, 201 bp, Homo sapiens
caacatataaaagagataatatatcatagctaggttgggtttagccaggaatgcaagtatggtttaacattggaaaatctgtcactttttatatttgacaytgtactggaaggcaagtaaaagaaattaaagaaataaattgtaaagaaatgaaactgttattcacatatgatgagattgtctatttaaaaaatctcaaaa

SEQ ID NO: 67825 - DNA, 201 bp, Homo sapiens
catagatttggtcttttcacatagtcccatatttcttggaggctttattcattccttttcattcctttttctctaatattgtcttcatgctttatttcatyaagttgatcttcaatctcttgataccctttcttcagtttgatcaatttggctattgatacttgtgtataattcacgaagttcttgggctttgcttttcag

SEQ ID NO: 67826 - DNA, 201 bp, Homo sapiens
tttcttatcaggaatattgtatgctagaaaacaaggcaaagacatctttttaaagttcttaaaaaattgttcatacttagatagcatgtatatgccatagrcatcagtttattaaaatagaaaagaacaatgtgttaccacttaccagtgagctaacacaaaatttaatgcccatgttgaaagaaaagtttagggaaaaat

SEQ ID NO: 67827 - DNA, 201 bp, Homo sapiens
ctatgtggcataggcaccaaggattcaggactggaacagcatactgggcctgccctttcctcctggggtttcgctctttagttgtggagttgtggggaatwtagggcaggtggcttattcagggattctgggagaggagactgggaacctcgtgtgggaaaggggtagttgggccctctattaaacagcagctgatggcca

SEQ ID NO: 67828 - DNA, 201 bp, Homo sapiens
tcacatgaaatatatatatgaagggcccggttttgtgtctaatatatagtgctgactcagaattttataattcttaatgaggttaggaaaaaaaagaaaaraaatttaatgattaaatatctaaatatcatttctcccacttctctcttctcagtcagaatatatttctccaattcttagtcacttggcctgtcactcaga

SEQ ID NO: 67829 - DNA, 201 bp, Homo sapiens
tgtaatataatacagatgctggtctatttctaatgtctttgaaatgtacattgatataatgggacaacatgctttattataaacacgtttaaacattcatrtgtttcatattggtgtgtcaaaagatccatcaacaatttaattgtagtattttatactccataaactagtacatattcaggtaaaacaaatattcttcat

SEQ ID NO: 67830 - DNA, 201 bp, Homo sapiens
ttaaattatttcaactagactggtccaagtcatctgtagtcagtcagtcagtcactcagctagtaaatgcctgaggcaaaacctcggatttctgtttcctrttatttctactgtaccctatctgtattcagaagtgatggtctattttataatctgtctgcttcaaatcactttggcaaccattatgatatatagcctttt

SEQ ID NO: 67831 - DNA, 201 bp, Homo sapiens
aatgtattaaatggaattgaattaagaatattaagacatggtgaatatattttatgctcacaagcagcttattttgctgtggaaacagtaaatatgtatgrtaaaaaatttaaatccttttcaaggcaacctgtcaaaagatccaataacgatagtgtaaaagaatcatcacaattttaaggcataaaaaataaaaattaa

SEQ ID NO: 67832 - DNA, 201 bp, Homo sapiens
aaaatagcaacttggtgactcacagtaacatgccttctttttagtcataactgaataaacctgcagttgaaacagaatagtcaaaatggcctaaattacartactgcatatatgtccttatctccttcccaatgtattcacttagaaatagccttaaatcatagaaacatattttctatcacagaaacacatttccatttg

SEQ ID NO: 67833 - DNA, 201 bp, Homo sapiens
agtgatttatactgtctgtaaatccagtacttttttagaaaataatcttttgatacaaaattcttgatttctcaaaacactaaatatatctttaaattatrgtagtatttagttgcatgatttatatggtagacatatcaaaatatctaaaatatcaaaatatctaaaatgatactatactttaaataataaaataattct

SEQ ID NO: 67834 - DNA, 201 bp, Homo sapiens
aatacagtttagagtagctgccctcatgggtatggttttttattgcttgtgttagcatgtcataattagaggcaaaaatataatggaagctttggtttgcrtaagtattaaaaggtatacaataatataatatttatgttataaaaagtgttagagggataacattaagtttgactcatactgtttgccattcctagttgg

SEQ ID NO: 67835 - DNA, 201 bp, Homo sapiens
ttttgaatagaaatcaaccagatgagctagcattaaagtttggattcagaattttcatttatcaattgcagaaatataggtaattataagataactgcatmctgaagtaatttatatccagatataaatgtacgtgatcagtttgatcagttttccttttcacaaataaagtgttaaacatcaaagtggtttttagtataa

SEQ ID NO: 67836 - DNA, 201 bp, Homo sapiens
cacctagcagctcttttcccccacagtttggtgagcaggagggaggattccggtgttacatgaccccttcggtgccgcttcgccagctggaaatctctgcrgccgatgtctctttgctcaggctcactgggttcacgctgctcacccgcccgctgcaggctgcacttggcttgcaccccagtctggatgctgcacccgcca

SEQ ID NO: 67837 - DNA, 201 bp, Homo sapiens
tattgtttctgtttgaaatttggggaaactgagtcccagaatttcctggttttaggtcttatttcacttgtcatgctggtggatgtcaaagatgcagtttwtcaccattcctgtgtagctagccaaaggtatccatccgtgcttctcttggttgcataaaattatggtgagagttagtagatggtgcaggttcatggacga

SEQ ID NO: 67838 - DNA, 201 bp, Homo sapiens
attaaaaaaatattctaagcaatacaatagcatttattctaaatatatttaaaattaaggtgtaaatttctcacacatcgtgttttgtcctttgtttcttktttgagactacaacctctgcctcccaggttcaggtgattctcatgcctcagcctcccgaatagctggaattacagccagctaattttcacatttttagta

SEQ ID NO: 67839 - DNA, 201 bp, Homo sapiens
aattatttgtacatttgtatcaattattcagaattatggaatattctagtttgagaagtaagagatacttgattttatagtgttaatagcaagaaaaaatrctttactttcttgcctatatttttgtttaatctttttaacaaccttaagagtagagcattatgatttctgttctatagcagatgagacctaaatgcaggg

SEQ ID NO: 67840 - DNA, 201 bp, Homo sapiens
aggtgagtattgggtacatgaaagtttattatctgtttgactacatttctcatgtttgaagtatttcattatgaagaataaaaatgatatatataaaatakatatagaaatgtaaaagtattatacaataaacagtatcaatacatacaatgctcataaacataagtatgaacacacacaaaaacacttgtatgtatatgt

SEQ ID NO: 67841 - DNA, 201 bp, Homo sapiens
aaatatttttcctatagtaaagagaacatataatgcatgaatgtagtactcattaatgctatatatttgttaaaatagaaaaatgttttatatttaaataytccacattgtacatagagcccaattttttagcataggaaaaaatgtgaaattttagcttatatttatatatcttttctccttctgtcagtgactgccacc

SEQ ID NO: 67842 - DNA, 201 bp, Homo sapiens
agatatgagttctaggctgttcttgctggaatgactttagggagtacagaaatgatccacccaagagccagttatagctaatatggttgctgcaactgtgwgttatgaatatactcctcttgctgcaatccagtaatcaggaagccagagttacactgctaatgctgtagtcacaattgcctcttgacacccagaaaattg

SEQ ID NO: 67843 - DNA, 201 bp, Homo sapiens
tagtcacaattgcctcttgacacccagaaaattggaaagtgccacaaaaagcactgctaacaccttgcatttctttatctttgtttgcagttaaaacagtygaaaggatgtaggaaaatggcttctgcttcgcttctgtgttcattatcttagatgaattgcttctaatttgcagaagcgaattctcatccagaatttgaa

SEQ ID NO: 67844 - DNA, 201 bp, Homo sapiens
gcgtgcgcgcgtgtgtgtgtgcgtgcacacacgtgcactttaacactggattaatataaaaattagatattgagtctcccagtttcagttctgacattttragatcaaggaagttgttaatcttggctaggtgtggtggctcacacctgtaatcccaacactttgggaggccaaggcaggaggattgtttgagcccaggag

SEQ ID NO: 67845 - DNA, 201 bp, Homo sapiens
ggtcaaaatacatggccagtaatgtagtacatccttgggaacaggacattatttgcttcactcactggtggggagagggtcctaccatccatctcgaggcscttgggcaataggttttacttgggaaggtgatgtcagggaaggcaggtagccaggtgtgcttttactgccctcagggagttcctagtctacttgtgcatg

SEQ ID NO: 67846 - DNA, 201 bp, Homo sapiens
ttaactagtatatttttgcaggtatttgctttaggagaagctcctaagaaaaaatgattcaatcttaaaaaggccaaaatctaaatgaatatttatgtttrgacattaattatgtcattctgccagaccagtttttaaaaattatcagacacaccttcactaaactttgttagacaacttcaagttatatataagaataga

SEQ ID NO: 67847 - DNA, 201 bp, Homo sapiens
ctagagatttgtaaaacaggttatatgccagtagaaggcatgaaaatattttcctcgttcctgttatataaacaacctaatactaaagttttggtcccgargcttacatagcactgggcctttgttcagtcaagattaaataaagtaaattgaacactatcaattttctactcacaattactagagattattattctaatt

SEQ ID NO: 67848 - DNA, 201 bp, Homo sapiens
gtatttattctcccttgttcattcccatgcagttgaagctaaaactctttgtgatgaatgttgagcctctgtcctatagaggacctcccctgcttaaccgmgagttcctcaatgtaactgtgtctcctaggtcgtataagaaggcattgattatttattttacaattaggaatttaggcaaagcccttagattcagagatg

SEQ ID NO: 67849 - DNA, 201 bp, Homo sapiens
aactttattcctattagaaaaactgttaaactaaaagatctgacaacaacattcttgaataagtttaaagaatttatggcttaaattaatctgaattctartttaccttttaccttgagcttggctgctgttttcaatttatatgcattttatacattaactgctaccctcaatttcctgtcaactttgtagtaagtgata

SEQ ID NO: 67850 - DNA, 201 bp, Homo sapiens
tcattcacctctggaaatagcagcagtagtttctaatctttggctagcagataatttctaaaatcatttttctttctccccgaattgtagtttgagtagcmcttgtctttcagagaaaatgaactttattcctattagaaaaactgttaaactaaaagatctgacaacaacattcttgaataagtttaaagaatttatggc

SEQ ID NO: 67851 - DNA, 201 bp, Homo sapiens
tgtgataattgactaatttattatataacctgttataatctgaactatttaaaaataattttctgctttaaaatctctcacagggtctttcttaagacacyttcattcacctctggaaatagcagcagtagtttctaatctttggctagcagataatttctaaaatcatttttctttctccccgaattgtagtttgagtag

SEQ ID NO: 67852 - DNA, 201 bp, Homo sapiens
agtcatttggtttgattgccccacaaagcataagatgtaaactgattaagggtatgaaagcaaagtgaaagacctcagatcttgtgcacattttgttttcytattatttcttttattgactgtagtgcatgatacctaatcaaggctccaatgtcttgcacaattcctactttaatgctagtggttttcagtgtccttaca

SEQ ID NO: 67853 - DNA, 201 bp, Homo sapiens
ctggtttggaattagggatctttttttgaggataggaagaaatttgcaaattatatttgagttttgatttattgtgataattgactaatttattatataayctgttataatctgaactatttaaaaataattttctgctttaaaatctctcacagggtctttcttaagacactttcattcacctctggaaatagcagcagt

SEQ ID NO: 67854 - DNA, 201 bp, Homo sapiens
cttggctcactgcaacctccgcctctcggattcaaacgattctcctgcctcagcctccagagtagctgggactacaggtgcgcgccaccacgcccggctawtttttgtatttttagtagagacgggattttgccttcttggccaggctgctctcgaactccggacctcaggtgatccacccacctttgcctcccaaagtgt

SEQ ID NO: 67855 - DNA, 201 bp, Homo sapiens
gatgaaattgtaaaagtcatttggtttgattgccccacaaagcataagatgtaaactgattaagggtatgaaagcaaagtgaaagacctcagatcttgtgmacattttgttttcctattatttcttttattgactgtagtgcatgatacctaatcaaggctccaatgtcttgcacaattcctactttaatgctagtggttt

SEQ ID NO: 67856 - DNA, 201 bp, Homo sapiens
aggaatagaaaatcaaataccttatattctcatatataaattggagctagacatgggtatccatggacatacagagggaaacgctgtaggtaatatacacyggggactctaaaagaggagaactggaggaggatgaatgttgaaaaattatctgttgggcacaatgttcattgttaaggtgatgagtatgctagaagctca

SEQ ID NO: 67857 - DNA, 201 bp, Homo sapiens
cctctccccccccagagtgcagggatacctgggtctgcagccgcaatatgggctgctcccttgaccctagggaagtggagctcctggtcccccaaaagtamagggaagctccattctgcagccacagctcgggcacctgcagcccttcccaggagggttaggctcctgcctcctccaaggaggcagaggcccaggtctgca

SEQ ID NO: 67858 - DNA, 201 bp, Homo sapiens
gtacctccagatacaggcttactcaggttatgtggagaagactaaagattaaattgctggcccccattcctggttactgtactctcctgcttcagatcctyagttttccaaagacatctgcaactacttgtgttctgtatgagtttctcatcagctgttttattaattgatgaataagaccctgaagcccatacaaagtct

SEQ ID NO: 67859 - DNA, 201 bp, Homo sapiens
atttcaagtattcagggaaataatacaatgccacttctttagaggagatcacctaatatttacaagtagaagagctaagataaaacagaaaagagtacctwctcaccttttcatcactgatgctgtctgcagtgaatatattgttagtggtgaagaccaaactatattaaagtttaagggatgcaaataagcatgagaatg

SEQ ID NO: 67860 - DNA, 201 bp, Homo sapiens
tacagccactctgggggacagactgacagttctttaatgaaaataaacacactctcatgatctgacccagctgaaaacttttgtccacacaaaaacttacrcatagatgtttatagcagttttatttataactactccagtttggaagccaccaggatgtcctacactgggtgaatgtaaaaagtgtggtagatccagaca

SEQ ID NO: 67861 - DNA, 201 bp, Homo sapiens
taagggtgaggtgaagtcagataagggacagataataaaaaaatttaaatgtcaaaaatgataatctaggatgaaaataccagaattaggtgaagacccartgctgaagaaacttgaaaactaggccaagtgattagaaatatattttattggaatgatgaagctgatggtgtttcagataaaattgttctctaagattta

SEQ ID NO: 67862 - DNA, 201 bp, Homo sapiens
ctcatttatgcaaaaagcacccttgttccatatttagatgtgaagtttatgtgtgtgtatgtgtatatatatatatatatatttttttttatggttttttkttttttttttgagatggagtctcactctgtctcccaggctggagagcagtggtgccgtctcagttcactgcaacctctgcctcctgggttcaagtgattc

SEQ ID NO: 67863 - DNA, 201 bp, Homo sapiens
acagtttttatttaataatcctcatttatgcaaaaagcacccttgttccatatttagatgtgaagtttatgtgtgtgtatgtgtatatatatatatatatwtttttttttatggttttttgttttttttttgagatggagtctcactctgtctcccaggctggagagcagtggtgccgtctcagttcactgcaacctctgc

SEQ ID NO: 67864 - DNA, 201 bp, Homo sapiens
ttttataggtgtatagtattctatggtgcatatgtgccacatttttctctgtctagtccactgttagtggacacctaggttggttctgtgtctttgctgtsattaatagatttgcagtgaacatgtaagtgcatgtgtctttctggtaaaatgatttgttttcttttggatatctacccagtaatgggattgctggattga

SEQ ID NO: 67865 - DNA, 201 bp, Homo sapiens
ttattctaagtgaagtaactcaggaatggaaaaccaaacatcgtatgttctcacttaaatgtgggagctaagctatgggtacacaaaggcatgagtgatamgttggactttggagactcaagtgaaaaggtggggtggcaagaggttaaagactacacattgggtacagtgtacactgctcaggtgatgggtttaccaaaa

SEQ ID NO: 67866 - DNA, 201 bp, Homo sapiens
tgagatggagtctcactctgtctcccaggctggagagcagtggtgccgtctcagttcactgcaacctctgcctcctgggttcaagtgattctcctacttcrgcctcccaagtagctgggattacaagtatgcgccaccacacccagctaatttttgtatttttagtagagacgtggtttcgccatgttggccaggctgttc

SEQ ID NO: 67867 - DNA, 201 bp, Homo sapiens
attatatgatataatctatttttagttttctccacagggctaaatatggtaacaatttattgtttattcagggcactcagtaaactgaggatttgtgaatmctgtatgaattcattttatagagaataacagtttaaaaaaactaatgactggaacattagtattgaacttttgtcttacaataaactttttaaaaaagtt

SEQ ID NO: 67868 - DNA, 201 bp, Homo sapiens
agaaatagaaggatgattatcttaagttatgtttacactttggtaatatttgaaaatggatgtatatactggaaatgtctgtaagtgtcttgtttttgcayctaatttatgatctattatattgcattttcttaaatatcttagaagtatttttctttataactttgtatattgaatgtttagataaatgtccaactgaca

SEQ ID NO: 67869 - DNA, 201 bp, Homo sapiens
gcctctccacaccatcttgtatttttacttacactgttactcatcacgattagggtcaaagaagataggcttattaatattattcctctgagcagttgcaraggataatgaattctgtacccttgaagagcaattgaagaattgtctctctaaaacatctatcctttcatcacatggagaaagcacccagaattccctcaa

SEQ ID NO: 67870 - DNA, 201 bp, Homo sapiens
cttagtgacttaggtgaacattgactgggaggataccatgtgtcccatcccagaagattgtataatgttatgacagggacaagattatatatatatatatrtgtatatatatgtatacatacatgtatatatgtgtacacacacacacacacacacacacacacgtcccaggagattgtatagtgttatgacccaaactta

SEQ ID NO: 67871 - DNA, 201 bp, Homo sapiens
cctaatgtgtactgtgtcattttgggactgtggaaaccttggattctgatctagaccttgtttcaccccttttgctttcgttttgcaagacttggaggggrgacgggaacatcaaggactctgaaaaatgtgtggttgaggtgttttgcctcagatgttgggaggggttaaggtgcgggagaagatacaggctgagagaga

SEQ ID NO: 67872 - DNA, 201 bp, Homo sapiens
ggtagatgacccaggaaagttgcgagccagtgtattgtgactgtgatatggactgttggtggagtacataaatagaacattacctctgaccctgtatgtgygtgtataaattgattacaacagaatcccatagtaacatggaatttaagaaaatcatttgtgttataaggggactcctaagtccagataatcaaaaacaaa

SEQ ID NO: 67873 - DNA, 201 bp, Homo sapiens
aataatgagaattgactacaagtagttttgccaaaaattgtaaattatggaataacctgtgtagtcacttaaatgcttgcagaatctggagaattaatgaraacttttgatgtggtataacatattaaaatgactttactgtaacatctttgatttaaataatgaaattaaccacatttgtataatgtcttataaaatttt

SEQ ID NO: 67874 - DNA, 201 bp, Homo sapiens
ttaagctttaggtatggatatcattagcttatctgatcaatacactattatcagaattttaagaagttcaggttaactagtattttctgaaaacagaaackcaacatccctacaaaattatggagaaaacacagctatgtatttcagacaaaatttttaaatcagtctgatttgtccaaagaatcagtttttagctttaaa

SEQ ID NO: 67875 - DNA, 201 bp, Homo sapiens
tggcatgctctccttggggaatctggaaggttatggtggcagaatgtgtagttttagaccacattctaggggcttctagcttacacagtgtgtatatatgrtagacttggaatttgatatattcctgtaaattttctcctcaaaatctaaaatcactgtctgttattttcattttgggaccttccatataaggctctaaaa

SEQ ID NO: 67876 - DNA, 201 bp, Homo sapiens
tcatcactggattaagctgacaataaactactgttattcttcaagaaacatccatcttctgcacagaccaaagtagtgatttaatttgagtgcacagctcrgttgtactttgtcttgggatgtgaaaagccagaaagaatgtcactcccatagtgatatcactcccacagaacaataaggataaagacagataatctacac

SEQ ID NO: 67877 - DNA, 201 bp, Homo sapiens
acttgggtctatgttagaggcagcctatcatagtacggatcaataactagttggatggatggatggatggatggatggatggatggatggatgtggagggrtggtcagtcaggcagacagatgatgggcaaatagattaatgctataccacaatataatttaatttatgttgcatacccaacttaatcctgaaaaacttga

SEQ ID NO: 67878 - DNA, 201 bp, Homo sapiens
ggagacagggacatttatttatgattcatatcaaactggaaggtagttttcaattgtgactatacactaaagattgtcacttgattcacatgtattcaggrcttataaaactaagtcatcatacttagaaatggtttcatgctatcacggtgtctgtcagaattagcaggcaatatctcattataggaaattttaagtata

SEQ ID NO: 67879 - DNA, 201 bp, Homo sapiens
gacagggacatttatttatgattcatatcaaactggaaggtagttttcaattgtgactatacactaaagattgtcacttgattcacatgtattcagggctyataaaactaagtcatcatacttagaaatggtttcatgctatcacggtgtctgtcagaattagcaggcaatatctcattataggaaattttaagtatatta

SEQ ID NO: 67880 - DNA, 201 bp, Homo sapiens
tggaaaaaaatcaagtcctgttgaaatgaaattaagggttgatggcagtaggatatttggcaggtaaataaatggaaacatacatgatgtttgtagaacaraaggctcactgtctttcagatgtgaaatttccccatattgatctgtagagtcaaagaaatcccaatcaaactctagcaggttttttgttgttcttgttgt

SEQ ID NO: 67881 - DNA, 201 bp, Homo sapiens
ttatgattcatatcaaactggaaggtagttttcaattgtgactatacactaaagattgtcacttgattcacatgtattcagggcttataaaactaagtcaycatacttagaaatggtttcatgctatcacggtgtctgtcagaattagcaggcaatatctcattataggaaattttaagtatattagtgattttttaaaaa

SEQ ID NO: 67882 - DNA, 201 bp, Homo sapiens
tcttactgtatgtgtatgtcctttagcttcatgttacttagcttactgtatgtcctttagcttcatgttgtcaatgtaggaaatactactatatgctgttyatgttgttagcacacagtaaactgatctcttcttactctttgagcctacaaccataaaattcccttctatttcttattgtcttcaagcatttttaaaaaa

SEQ ID NO: 67883 - DNA, 201 bp, Homo sapiens
gtcatcatacttagaaatggtttcatgctatcacggtgtctgtcagaattagcaggcaatatctcattataggaaattttaagtatattagtgattttttwaaaaatgtaaaattttgagattttaggatttggagaataactacctgagcccatcctctttgttgtgaattagcaatgggacagaagtatttgtaatata

SEQ ID NO: 67884 - DNA, 201 bp, Homo sapiens
tgctgatgtttggtctttattacaattaaaataccagaaaattttgttagaaggagatattgggaatatgaagacataacccaaatatgtgtatattacarttctggaggaaatacctcagttaaaacaaaacaaaaatcaagaatattaaaagtcttttataatttgacaatagatcctccatatcttctcatattctgg

SEQ ID NO: 67885 - DNA, 201 bp, Homo sapiens
cactgatttcttggttatttcttggttacaggctgtcatggtggtcacctgatccttacctgatgttactggttaccttgagattttatcagtgtctgtgrtctcttcatcagttctctccaaaggtttctctcactgattatctttcaatattcttagacttgaatgaagcagtcccagagacagagcgcctggattcaa

SEQ ID NO: 67886 - DNA, 201 bp, Homo sapiens
aatttcagagcctgttattggtatattcagggattcaacttcttcctggtttagtcttaggagagtgtatgtgtctgggaatttatccatttcttctagawtttctagtttatttgcgtagatgtgtttatagtattctgtgatggtagtttgtatttctgtgggatcagtggtgatatcccctttatcatttctaattgc

SEQ ID NO: 67887 - DNA, 201 bp, Homo sapiens
gagtatttattctcccttgttcattcccatgcagttgaagctaaaactctttgtgatgaatgttgagcctctgtcctatagaggacctcccctgcttaacygagagttcctcaatgtaactgtgtctcctaggtcgtataagaaggcattgattatttattttacaattaggaatttaggcaaagcccttagattcagaga

SEQ ID NO: 67888 - DNA, 201 bp, Homo sapiens
tgctgaattgtagagtaaatcacatggatggtaactgacaaaggatgttaataatgctgtgctaaattagaggcaaattaaaagtccattttggacacackttgtttttgggtcctgtttttgtttcacaagcttttgctcatcatcattttcaatcactgtccttttcaattttattggaagagataccacatatgaaat

SEQ ID NO: 67889 - DNA, 201 bp, Homo sapiens
tatcttcttgctctatttttatcccatttggaaaatccctttaatgcttttaattgaatttgaagcagactgccattgaataacgtgatcaaagtaaagaygtatgttctcaatttgggacaaataaaactctaacatttttagtttttttgttaatgttattttatttactagtctttgaaaacttttgtgaaatagttc

SEQ ID NO: 67890 - DNA, 201 bp, Homo sapiens
cccccctttttttctttttaatagatgaggatggtcttggtataagtattattggaatgggtgttggagcagatgctggacttgaaaagctgggaatattygtcaagacagtaacagaaggtggtgctgctcaacgggatggcaggtaaattaaggactgttgttaataacttaaaatctttagagaactttcctggaagt

SEQ ID NO: 67891 - DNA, 201 bp, Homo sapiens
gaaagtgaaggttattgctgaaaagtcttttaaaagtgtcattctgttgagtatatggaccaatatttctttaataatccatcactgttgattagttagtrtttttatgctgctagtaaagcatgattacaaagactttgaggctatcagaaaataaccttgaactttaactaaaacatgtggcacgcaaaatagtgtatc

SEQ ID NO: 67892 - DNA, 201 bp, Homo sapiens
accagcactttgggaggctgaggcaggagattgcttgagcccaggaggttgagaccagcctgggcaacatggtgaaaccctgtctgtacaaaaaaaaaaamaaaaacacaaaaaattacccagatgtggtggcacatggctatagttccagcacctcggaggctgaggtgggaggatcaccagaacccaggaggttgaggc

SEQ ID NO: 67893 - DNA, 201 bp, Homo sapiens
ctgagtcttcaggtgaacgaaccactctcagaagtgcctctcctcacaggaatgcatatcgaactgagtttcaggcactgaaaagtacctttgacaaaccyaagtcagatggggaacaaaaaacaaaagaaggtgagggctcccagcagagcagggggaggaaatatggctccaatgtcaacagaattaaaaacctattta

SEQ ID NO: 67894 - DNA, 201 bp, Homo sapiens
ggcgtggtggcacgtgcctgtagtcccagctactcaggaggctgaggcagaagaattgcttgaacctgggaggtggaggttgcagtgagccgagaccacascactgcactccagcctgggtgacagaacaagactctgtctcaaaaaaaaaaaaaaaaagaaagaaagactcattaggatcaaatggagttttagatacaa

SEQ ID NO: 67895 - DNA, 201 bp, Homo sapiens
gtatctccaaattgtgtttggaacttttttttttttttttttaccaaagaccaatcagaatgataactttttgacttttaacttcccatttcaatgagtartctcttctgtttgccacgtggctaagccatttggaaaaaaaaatgtatgttatttgactagacataaattcaaataagtaaatgaattcagaaattcatt

SEQ ID NO: 67896 - DNA, 201 bp, Homo sapiens
ttaaaaagtagggaatgattaacacaatgtttagtataatggtcactgaggaaagagttgctgtgtcagggagggatatatagtggcttttgtgatgtcgrtaatattctgtgtctttgtacatggatgtttgttttatttttatgctttaaacataatgttttgtagataaatattaaactcatttgtatgttgccatat

SEQ ID NO: 67897 - DNA, 201 bp, Homo sapiens
atgtgtttgtgtgtgtgtgagattttgataggtatctccaaattgtgtttggaacttttttttttttttttttaccaaagaccaatcagaatgataacttyttgacttttaacttcccatttcaatgagtaatctcttctgtttgccacgtggctaagccatttggaaaaaaaaatgtatgttatttgactagacataaat

SEQ ID NO: 67898 - DNA, 201 bp, Homo sapiens
tttacaagcctataagtaagctgaagatgaagagtgtattacattattttctttttctttttcttttcttttctttttcgtttcttttctttttttttttyttttttttttttttgagacagtctcgctctgtcacccaggctggagtgcagtggcgcgggagctcactgcaatctccgcctcctgggttcatgccattct

SEQ ID NO: 67899 - DNA, 201 bp, Homo sapiens
ataggcagaagggacttgccttgtctcggatgagatgttgaactgtggacttttgagttaatgctgaaataagttaagactatgggggactgtttggaagrtgtaattggttttgaaatgtcaggacatgtgatttggcaggggctggggcagaatgatatggtttggctgtgtcctcacccaaatctcctcttgaattgt

SEQ ID NO: 67900 - DNA, 201 bp, Homo sapiens
acttaatttacaagcctataagtaagctgaagatgaagagtgtattacattattttctttttctttttcttttcttttctttttcgtttcttttctttttyttttttttttttttttttttgagacagtctcgctctgtcacccaggctggagtgcagtggcgcgggagctcactgcaatctccgcctcctgggttcatgc

SEQ ID NO: 67901 - DNA, 201 bp, Homo sapiens
caattttgtcaaagattagatgtctgtaggtgatagagtttggctgtgtccccacccaaatctcatcttgaattgtaagtcccacagttcccacatgttgwgggaggaacctggtgggaggtgattgaattttgggggtggaggcattcctacattattcttgtgatagtgaatgaacctcatgagatctgatgattttaa

SEQ ID NO: 67902 - DNA, 201 bp, Homo sapiens
tttttattgtcttgaattcataaattaacttagggtaaactgatatttacagttatttagaaatgtggatgtctttataatattaaggattttaatccagsgaaataatatggcattgcactttcttcagggctttttgtactcatcacttagttttatagagagaaaaatgcttgtacatttatggttggtaattactaa

SEQ ID NO: 67903 - DNA, 201 bp, Homo sapiens
gtgggtcctaatccaatatgactggtgtccttattagaagagaagagacgcagtgggaagacagccatatgaagatggagacagatactggaattatattscctcaagccaaggaacttctaggacaaccagaagctagaagagggaaggaagaattttttcctagaggctttggagggagcatggcccagtaacacctta

SEQ ID NO: 67904 - DNA, 201 bp, Homo sapiens
taggttaaaattgggaccataccaattggggatcgtatgaattgggaatatctttctctttatctgcagcatgctcttcagcttaacgatgtatgtatctyggggtcttccatgtcagtagagagatatacatctcttcaatcactgcattgaattacatatttgtatatatcatgatttagcaagccattttctctactg

SEQ ID NO: 67905 - DNA, 201 bp, Homo sapiens
ttacagagctttgcccatttctatccagttttgattagtctaagcagagcaggtttgtgggattttgcctgtgtgtgagcttggctgggcttacatggagstgactcaagggctagcacttgcttttgggagttgaaatgtcagttttctcaaaactctcatatgccttttggtttctacactcacagatttccaccattc

SEQ ID NO: 67906 - DNA, 201 bp, Homo sapiens
cttcatgacctattagattgattcacaacctccttaggtcacagtcagcactttgaaaactactgctctaaattactgtaccttttctatgaggaagagtkgaactgttggtgtatcagtcagggtcaaccaaagaagcaccgccagtagaagataacattttaagagatttaccaccaggaattggtttatgcatatgtt

SEQ ID NO: 67907 - DNA, 201 bp, Homo sapiens
tctccttcagttccactctgatcttagtgatttcttgtcttctgctagcttttgaatgtgtttgctcttgcttctctagttcttttaattgtgatgttagrgtgtcaattttctatctttcctgctttctcttgtgggcatttagtgctataaatttccttctacacactgcaaatgtgtcccagagattctggtatgtag

SEQ ID NO: 67908 - DNA, 201 bp, Homo sapiens
caacctttgttttattatttgactcttacagatagtgctaaacctcaagtatgaattctctttatatgagaccagaacactgtggaaatacaggattttarataggcctttacaatgcatatattttacataatttcaccctaaaaatgtaacatgtatttggcaaaggaagggcttttgttgctgtcattctccctcatg

SEQ ID NO: 67909 - DNA, 201 bp, Homo sapiens
cttttaccaactatgcttcatttgtcgaggtccttcacccctgtgaaaagcaattttcttttcctcatgaaatggagataacttgggtccatcttgctcaytttgcttggaaagtagggtccacgtctggacaaacaggccaaagacacatgacatctgatctggctataggaacaaaagactaaacaagccatccagcag

SEQ ID NO: 67910 - DNA, 201 bp, Homo sapiens
tttgggaggctgaggcaggcggatcacaatgtcaggggatcaagaccatcctggctaacacggtgaaaccccgtctctactaaaaatacaaaaaaaattakcctggtgtggtggcgggtgcctgtagtcccagctactcaggaggctgaggcaggagagtggtgtgaacctgggagtcagaggttgcagtgagccgagatc

SEQ ID NO: 67911 - DNA, 201 bp, Homo sapiens
gtttctgagttcagtaggacttaataccttaaatagaacttaattcctgaggtaatcagaaatgagatattttctttcattttattttctctcattattgkatatatatgaaaatggctttaggttatgtttactagttttataacctgacttcttagttacactgctaatcttttccagtttattttttagttatattct

SEQ ID NO: 67912 - DNA, 201 bp, Homo sapiens
ttttctttccctcaaatatctgacttcagtaagcaatgattgttatgagataaatgtttgctcttaattatatcaacttctttttatttttttgtttctartaatcactttgttttctggttttcgctttgtggtctgtgtctttgttactttcacttaagtagtgatcttcaaacagttaatttatataatctgtgattt

SEQ ID NO: 67913 - DNA, 201 bp, Homo sapiens
aacctccgcctgctgggttcaagcgattctcctgcctcagcttcctgagtagctgggattacagatgctcaccacaatgcctggctaatttttgtattttyagtagtgacggggtttcgccatattggccaggctggtctccaactcctgacctcaagtgatccacctgccttggcctcccaaagtgctgagattacaggc

SEQ ID NO: 67914 - DNA, 201 bp, Homo sapiens
ggtaccagtatcttgctgttttggttactgcagccttgtagtataatttgaagtcaggtaacatgatgccttcagctttgttgtttttgcttaggattatyttggctatatgggctcttttgtggtttcatatgaaatttaaagtagattttcaaattctatgaagaaagtcaatggtagcttgatgggaatacattgaat

SEQ ID NO: 67915 - DNA, 201 bp, Homo sapiens
cagtgcctagcacaatgtcaaacatgagtttagaactgtaaaatattgttgaatgaataaatgtgaataagtgattactaaaaatataagaggaagtgaargatcaaaagagctgtctaagagaaagttgtaagtatgacaatgtaagaagaatattaggccaggcatagtagcttaagctggtaatcccagcactttggg

SEQ ID NO: 67916 - DNA, 201 bp, Homo sapiens
ggtagctgcacttctccttttcctcacctcctcattatcacctacctgttatttctctctttaggcatttttgaacagaattgaaggaaaacgccattcargtctgctatttgcctgtaaacagagtggatacaatctcactgaccacccaatagtcactgttaaaatcttttcaattcttatgatgacagctgatggata

SEQ ID NO: 67917 - DNA, 201 bp, Homo sapiens
aagactagttctctgtgttgcatttttatgccaactttagctgctgccagaatcttggatgccctaaataccagtgcttacagtggaagccagcagggtgkaccagacagtgaaaaagattcctttgctcatgttgtcagcttatctgaaatcttgaacagctgtttgaatgaatgaatgaagtacatattaaagggagtt

SEQ ID NO: 67918 - DNA, 201 bp, Homo sapiens
acccatcaaaaggagagaagtctttttttatattgtctaccatatgatacaaaaattaattttggtaatattaacaaatgttccttttttggtaatacttsattcctgacataaacattacatctatgttattaagtcatgtcttctagaatacagcctgaactatgcataagacttctttgttttgaagttataaatttt

SEQ ID NO: 67919 - DNA, 201 bp, Homo sapiens
tcactcgatggtagctgcacttctccttttcctcacctcctcattatcacctacctgttatttctctctttaggcatttttgaacagaattgaaggaaaaygccattcaagtctgctatttgcctgtaaacagagtggatacaatctcactgaccacccaatagtcactgttaaaatcttttcaattcttatgatgacagc

SEQ ID NO: 67920 - DNA, 201 bp, Homo sapiens
ttaatgtcagtgtgcagaaatatttctgtatatctgtgatttcattaaactgttagaatctgttaggtcagcttatactaaagttttcaatatttttgtcycccagaaagttatgcctgttaaaattttattcacagtgtattagagtgagttggtctgtctctttgccttgttttaactctttttttttttttttttttt

SEQ ID NO: 67921 - DNA, 201 bp, Homo sapiens
aaattagccaggtgtggtggtgtgcacatataatcccagctacttgggaggctaaggcaggagactcgcttgaacccaggagccagaggttacagtaagcygagatcaccccactgtactccagcctcggcaacagagtgagactccatctcaaaaaaagaaaaagaaaaaaatcattcataatcttagcatccagaaatt

SEQ ID NO: 67922 - DNA, 201 bp, Homo sapiens
aggccaaggtaggcagatcacctgaggtctggagtttctgaccagcctggtcaacatagtgaaacaccatctctactaaaaatgcacaaattagccaggtrtggtggtgtgcacatataatcccagctacttgggaggctaaggcaggagactcgcttgaacccaggagccagaggttacagtaagctgagatcaccccac

SEQ ID NO: 67923 - DNA, 201 bp, Homo sapiens
tatcagatacataatatgtaaacattttcttttaacttatgagttgccttttcactttcttgatagtttccttagaaacataaaatattttaattttgatraagttcaattcatctagttttttttgtcacttatactttgatctcatatcctagaagactttacatattctgagatcataaagatttactcgttcatctt

SEQ ID NO: 67924 - DNA, 201 bp, Homo sapiens
aaaaatattatacaagcatgttcacactcacacacgctattaggcaacatgaattttcattttaagatatgttgtaagaatgatgaatgaggttagaagcmcagtatcttcagctatgctgcttggaattgaaccccaattcccacgtttactatgtgtgacatcttgggaaagttatttcacatcttaatgtgtctcagt

SEQ ID NO: 67925 - DNA, 201 bp, Homo sapiens
aaattatgtggttgggcacagtgacatgcacctatagtctcagctaccagggaggccaaggtgggaggattacttgatcccaggagtttgagaccagcctkggcaacatatcaagaccttatttcaaaattaaaatcataaataaataaaatgatgcaagtcgtatataaacatgcacaaagatataaagttaaaaatggt

SEQ ID NO: 67926 - DNA, 201 bp, Homo sapiens
aaattaattgatgcttatcccaattgttttattttttacctaatttctacacaattagtttcttttgattttgcactgttattcaatgcaatacctgaaakaaataagttttttttttttttttttttttgtcaaggctcacacaccagaagaactaatgataaatattctttgtaatcttctagaaattttagatgcata

SEQ ID NO: 67927 - DNA, 201 bp, Homo sapiens
gtgtttaccctaaattgtctgatgattataaactccagtttggcttacttcattttgcagcaagcacctaacatactcccgggcacacactggacaatcartacactagataattctacctattgtcgatcagtgaactaaccttaatttgggggaagaaaaggaaagttgagattatacattgctctaaagctattagaa

SEQ ID NO: 67928 - DNA, 201 bp, Homo sapiens
taatataatatataatattatattaaatatatatattaaatatatatatttatatattatatttataattattatatataataattattatatatataatwattattatatataataatataagttatataatataatataatattatataatataccatatatagcatatatgtgcaatatatattatatattgcatata

SEQ ID NO: 67929 - DNA, 201 bp, Homo sapiens
ttaaatgtttctgtgatgaggacacctgtccagtggaaactggaccaaggccaccaatttatttcatgctggccaccagttgtcagttagcaaaacatacrtctccagtttaaaactctggctgaactgaaagagaacattgctaatttctcatggatagttcaattgtttacaataaattgaaaaatactgaggaaaaca

SEQ ID NO: 67930 - DNA, 201 bp, Homo sapiens
atgtatatttattacatataatataatatataatattatattaaatatatatattaaatatatatatttatatattatatttataattattatatataatwattattatatatataataattattatatataataatataagttatataatataatataatattatataatataccatatatagcatatatgtgcaatata

SEQ ID NO: 67931 - DNA, 201 bp, Homo sapiens
ttcctctttttgctcttgttgcaaggacagtgcaatcatattcttgccttccttcttctgttgcacaaatgactggcccccctcaccaggatcacttggaraaaaatctcttagtattctgagagggcctagactcccactgagtcctccaaaaggactgaagatagaggtttcctagagcttctggctcctctctttctt

SEQ ID NO: 67932 - DNA, 201 bp, Homo sapiens
ttatttatgattcatctcaaactggaaggtagttttcaattgtgactatacactaaagattgtcacttgattcacatgtattcaggactcataaaactaaktcaccatacttagaaatggtttcatgctattacggtgtctgtcagaattagcaggcaatatctcattataggaaattttaagtatattagtgatttttta

SEQ ID NO: 67933 - DNA, 201 bp, Homo sapiens
gcacaatgccaaattttggagatacagtggaagtaagacactagtcctgtgctgaagatggcagatttaaacaagaaaatagcattaacaaatgaaatgcrgcatataagtacgaaaggactacaggtgttctagacaagaggatagtcatctaatattggaggatattgtcataggaaagttccaagatattcaagaaat

SEQ ID NO: 67934 - DNA, 201 bp, Homo sapiens
cctggctaacacggtgaaaccccgtctctactaaaaatacaaaaaaaattagcctggtgtggtggcgggtgcctgtagtcccagctactcaggaggctgargcaggagagtggtgtgaacctgggagtcagaggttgcagtgagccgagatcgcgccactgcactccagcctgggcgacagagcgagactccatctcaaaa

SEQ ID NO: 67935 - DNA, 201 bp, Homo sapiens
actatacagagcaccccacttaaatgactaatactaaaatttaaatttcaattattttttaaatctctggtatatatatatatatatacacacacacacayatatatataaggtgtttttgcttatgaagtaagacttttgtcagaattcatgtacttgtaaaattctaagttcaggatcataagaagtgagactttttgt

SEQ ID NO: 67936 - DNA, 201 bp, Homo sapiens
aagccttaggctaggtgaacaggaaatgaggcagttacagtgttttagttgtttgtcctttatttctggagggggtctgccagtggctgttctaactgctycctcttgcctcagatcttgaaagccacactttatccatcattctcacctatttactaaaaagaatgagccacctgaagggacttccctctactttctcct

SEQ ID NO: 67937 - DNA, 201 bp, Homo sapiens
agttaagggtaaattttctggagaaattaacgtatatactggtatttttttttaaccatgacagcgttttgttgttgttgttgttgttgttgttgttgttkttttgagacagagtctcattctgttgcccaggctggagtgcagtggcgcgatcttggctcactgcagccttcgcctcctgggttcaatctattctcctgc

SEQ ID NO: 67938 - DNA, 201 bp, Homo sapiens
tattttgttattgcttctgagtattatgtcattcttcaaaatatctttgccaacacaggatcacatttaaaaagattcactaatctgttcctagatcctcktgtaattttatttttacctttaaatcttagatctactaaaaatgtaggggaggaaaaaaaagtcatcttctgccctcttaagttcagagtctagaaccca

SEQ ID NO: 67939 - DNA, 201 bp, Homo sapiens
cagaaactagtcagatgtggtggtgcacacccgtggtctcagctacttgggaggttgaggtgggaggattgcttgagcccaggaggtcatggctgtagtgrgccatgattgtgccactgccctccagctgggtgacagaatgagaccctgtgtcgaatgaatgaatgaaaataaagagccatggctttgtctgtgtttgca

SEQ ID NO: 67940 - DNA, 201 bp, Homo sapiens
tgtattatttaatgttacattatgaaatacattaaggtaattattttaatataaaagcatgtttgttttagaaaatacagaaataaactttttttgtagcyccactacccagtgttaattattacactattacgatttgaaattggatttccaggctatttccctatgaagacatatgcttttattttctaaaagatcgta

SEQ ID NO: 67941 - DNA, 201 bp, Homo sapiens
caaaaaatacagaaactagtcagatgtggtggtgcacacccgtggtctcagctacttgggaggttgaggtgggaggattgcttgagcccaggaggtcatgsctgtagtgggccatgattgtgccactgccctccagctgggtgacagaatgagaccctgtgtcgaatgaatgaatgaaaataaagagccatggctttgtct

SEQ ID NO: 67942 - DNA, 201 bp, Homo sapiens
aatgatccatctgccttggcctcccaaagtgctgggattataggtgtgagccaccatgcctggcttttattttggatttaattctatatcattaccgtacrttgtctggaactagggtgaccatttaatttatcattgaaattagaactcttttgagagtaaaaggaagtgctattactgattgtacctggagcacaggtg

SEQ ID NO: 67943 - DNA, 201 bp, Homo sapiens
tttattataaaagaaagaatatgcttagtaaaatttaaatctgtattatttaatgttacattatgaaatacattaaggtaattattttaatataaaagcawgtttgttttagaaaatacagaaataaactttttttgtagccccactacccagtgttaattattacactattacgatttgaaattggatttccaggctatt

SEQ ID NO: 67944 - DNA, 201 bp, Homo sapiens
tataaatttactgaggtatgaaaaagtatactattttctggggttacccagtttgctactattggaacataccattcagagttagaagataaaactggagmggtatttagaaactcaattacaaaagatcctttatgccaaaacaacaaaaaaagtcagccatgaccatcactatttattgaacatctacagaaccagatg

SEQ ID NO: 67945 - DNA, 201 bp, Homo sapiens
aggtccaacatccaactaatacacagaaacttagagaacagaggaaaaggaagtgaaattatcaagcaagtaatactgagattgtcctagagctagacgtragtgaatattgagatagaaagccttattaaatgtgcaataaagaagaaaggaattttcaccaagacatgtcatttagaaattcttatgcaccagagataa

SEQ ID NO: 67946 - DNA, 201 bp, Homo sapiens
taaagtacattaatatcagaaataagattagtggatcactccttagtttgatcaagatttaaatccttcttattgcagaagcacaacaatacattggagaytgcttcaaaactcaactgaaaaagagaaaaatcaaaagaagccttaggctaggtgaacaggaaatgaggcagttacagtgttttagttgtttgtccttta

SEQ ID NO: 67947 - DNA, 201 bp, Homo sapiens
agagaatcacttgagcccaggcggtcaagtctgcagtgagctgtgattgtgccactgtactccagcctgggcaacagagcaagacttttttaaaaaaaaawtttaaataaaataaaggtgcatcttacctttatcttctcatttgctgcagattcttacatgtgtatgtgatgaaatttggatgtgataggtttgcatatt

SEQ ID NO: 67948 - DNA, 201 bp, Homo sapiens
ccatagtcagacttactatgtgcatggagtagaggggaacttcataatgcatatgttttctggcctgtgaactggagtccctgggtgagtactggagttcyaaagacacgtgagctaaccctgctcccctgtgtcttctgaacaagacatggcaaggcagcgatacacacatgtgctttcaggcaacacatgttttagggt

SEQ ID NO: 67949 - DNA, 201 bp, Homo sapiens
atagcatggctgagtcagtaacggctccatgcatgatgatgttaaggagttattttacttataagcagccagcatcctttgagaccagcctgggcaatatrgggaaaccttgtttctacaaaaaaaaattaaaaataatacaggatattattttaataataataatacaggatgtactcctgttgcccacaggagttgact

SEQ ID NO: 67950 - DNA, 201 bp, Homo sapiens
gtctctcattctaccccagaatgcccttttgctcaagtaccttgtactctaggaagcgtttcctgacaatacactctaagtttgacctcaacatacgttargaatttcttgttcttattttctctcacataaaccattgcatacctatttgagcttctacctactgagaacctaccatgtgccagaataacatactaataa

SEQ ID NO: 67951 - DNA, 201 bp, Homo sapiens
tcaagtagctaaaactacaggtgcatgccaccacacctggcttttttttttttttttaagggacgggtctcattgtgttacttaggctgatcttgaactcytgggctcaaacattcttcccaccttggcctcccgaagtgctggggttacaggcatgagccaccgtgtccagcatgaatatttataacaaagtgataaatt

SEQ ID NO: 67952 - DNA, 201 bp, Homo sapiens
ttaagattttcctatgtgtcattgcaacaggagaattgaaaaagcaagagtacaaggggagttggaatagttcaggttaatatttactgagaaaaagtcayatatcgaagggaaaatgggagtaagtaagtctgactgccatagtcagacttactatgtgcatggagtagaggggaacttcataatgcatatgttttctgg

SEQ ID NO: 67953 - DNA, 201 bp, Homo sapiens
aaaaaagacgttattattcacatcgttagaacaagaaaaaactggacaaactgaaaaactagtgacttttcttggaccctgaagcagatatttgaggttayagggcaaaccccctccctgaaatctggagacaggtgcctccagagagtctcagccaagatctatttacctggagaagaagctgctagagtcataaactgg

SEQ ID NO: 67954 - DNA, 201 bp, Homo sapiens
tttgaccagaggaataaaaaggaaaagacaccaccaggtatggagaagctgagttaggagaccctatgaggtggtgccctctaaagaggagcagtagacartgacaggaaagaatgattcaaggacccttgagacataccttgactaggtaacaggtaagaaagtgaggcaaaactatcatgggcttcacgcctcagaaca

SEQ ID NO: 67955 - DNA, 201 bp, Homo sapiens
tagtgggtatcatgttgttgttttaatttgcagttccctaatgacatatgtggagcatcttttcatctacttatttaccatgtgtatatcttcattggtgrgatatatctgtttaatcaaattgattgttttgttattgttggcttttaagaatttttaaattactttagataatactcctttatctgatacctcttgtga

SEQ ID NO: 67956 - DNA, 201 bp, Homo sapiens
tgtgtctgtgctgtgtggcagcctctctgatgctctgcgggtgcagtgagagagttgtatttcagcatgtaactactagtgtattgtcaggctgtgacctyccccagaactcatcatcttgaagggtacatccaggagaggatctgccatttctcatagtatttatcacagccaacaataagcgatccttcccaggaggtg

SEQ ID NO: 67957 - DNA, 201 bp, Homo sapiens
cacagggtgaggaagtgttttatgggaggccaagctactttttaaaagatggtatgaaaacatgaattgaaatgtattattgttattgttattattgttgkgtagtaagtcctaacttaatggaaatttttgtgttctggaactgtaagcaagttttgagtccattggaagtagaccagattttgatttataaaaaatatt

SEQ ID NO: 67958 - DNA, 201 bp, Homo sapiens
tcagtgttcctgggaacgcactttggcaaatgtgtgagataaagatgtaaggttgcctagcaccaagctctgtgataggcagaatcaggcttttagtcgcrtgatgtccaaataactgcaacactcatgggttacagagtgttttcgtgtacattgcctcagctggtcttctcagcgctcattgtaacatctcccagctac

SEQ ID NO: 67959 - DNA, 201 bp, Homo sapiens
ataaagcaaaagagaataaaacaaacacaaacaagcacagggagaagtctggtcagaccctgggctatcatgcttctgtttgtgtgaccactgggtgcttkgttgtagcatcccaaacccacaccatgccggaaagagatatgcataggagtatgtagaaggtcacatgtggaataaacttcatcaacagtcacttccagg

SEQ ID NO: 67960 - DNA, 201 bp, Homo sapiens
atgaataaattttatcagcagggactattaagcagtgtttcggcacaaatgctttagagtacattttttagttgatgtgtactatgccagttatagagagytgtcaatacagtttcagtcttcagtgacaaaatctatcattttctaacttgctagaaacctttctttttagaaattcactttttgagacataatggcttc

SEQ ID NO: 67961 - DNA, 201 bp, Homo sapiens
tttcacagggtgaggaagtgttttatgggaggccaagctactttttaaaagatggtatgaaaacatgaattgaaatgtattattgttattgttattattgktgtgtagtaagtcctaacttaatggaaatttttgtgttctggaactgtaagcaagttttgagtccattggaagtagaccagattttgatttataaaaaat

SEQ ID NO: 67962 - DNA, 201 bp, Homo sapiens
ccccagatggggaagaacagtgaacaactgttctgagagatggctaatcacaaacaacacaagggcacagtgatctcgacctacttctgcaggcacagtgwccttgttctccaggtaccccctctagcatgaccctgtaaaacttccctccagcccctgcatctttgcggacagcccccttctctgctgtgctgcctgtct

SEQ ID NO: 67963 - DNA, 201 bp, Homo sapiens
acaaatctttttcacagggtgaggaagtgttttatgggaggccaagctactttttaaaagatggtatgaaaacatgaattgaaatgtattattgttattgktattattgttgtgtagtaagtcctaacttaatggaaatttttgtgttctggaactgtaagcaagttttgagtccattggaagtagaccagattttgattt

SEQ ID NO: 67964 - DNA, 201 bp, Homo sapiens
tgttgaaaacattttttagctatgtggagacttgcctgaatgctgtctcctatttaggtagaggccaataagatgatagctggaaaagcttcgattgtctrtcatgaagaccaggatggaataaaagaaaaataagtaatgcagttgtgatattctgcagtatacttcggctctcttaataagatcatgctgtaagcagtg

SEQ ID NO: 67965 - DNA, 201 bp, Homo sapiens
ggtgttacttgtttttaaatgcatgatggttatttccagcatgacactgcaaaccttatctaacattttattgaaacacatatggtggctaactttcacaygttgtttggtctccttttatctgtgttcgcttttctttctcaaacagaaacgtgattaatgttacttgaatttaattcttttcagtttcaatttaaatct

SEQ ID NO: 67966 - DNA, 201 bp, Homo sapiens
ttcctctcctcactatgtacgctcaagtttttgtcctcattttgtttctttttaattctggagcaacctttcactttatctgagaactaaaattctgtccyttttcttgaaaaataaacatttatcctattacatcacctacatagttacactttttcttaaaactgtccctgctaaaatagactcagttacccatattac

SEQ ID NO: 67967 - DNA, 201 bp, Homo sapiens
actaagtggagcacagaggatttttttagggcaatgaaaccattctgtatgatactataatggtggatacatgtcatccatcatacatttgtcaaaacccrtagaatgtgcaataccaagagtgaatgcttatgtcagctgtgggctttgaacaataatgatgtgtctttaaaggtttttttttttttctgtaatatgtga

SEQ ID NO: 67968 - DNA, 201 bp, Homo sapiens
taatgctttgcatagagaaggtttgaaataaatcttttgagtgaacattcagctgtctacatttaaaacaaagaatgtggaatatgactatcttgtgtccyaaattaacttattaacagtcttcctccttttcagagtagttaaggaaataacctctttgcccctttaataaattatatataatgatagtagtatttccag

SEQ ID NO: 67969 - DNA, 201 bp, Homo sapiens
cccacacacacccaccacacatacccacaaacaccacacacacacaccacacacacaccacacatgcccacacacacatcacacacaccacacataccctyacaaccacacacacaccacacacacgacaaacaccaccctcacacaccacacacaccacaaatacatacacacctcacgcccccacaccatacacacacc

SEQ ID NO: 67970 - DNA, 201 bp, Homo sapiens
aatgtttttcagataggtatctaattcttttcataatttattaaatagaccactctaatttgaatagaaaaggagtggaacagaatagaatataaaaatgratctatcccagagctcaaactatattgccttaataagcgaagttttattatgtgttttgatatccactagggcctgattctacccttattctttttcaaa

SEQ ID NO: 67971 - DNA, 201 bp, Homo sapiens
accacactcacaccacacatacccacacacacccaccacacatacccacaaacaccacacacacacaccacacacacaccacacatgcccacacacacatsacacacaccacacataccctcacaaccacacacacaccacacacacgacaaacaccaccctcacacaccacacacaccacaaatacatacacacctcacg

SEQ ID NO: 67972 - DNA, 201 bp, Homo sapiens
tgggggacagagtgagactccatctcaaataaataaacaaacacacaaacaaaccaagcttcagttttttctcctgtaaaattgaaataatgtctattttrtggttttatggtaagaaacaaattacatgataaatatggtcagctaagctcagctgagaatcagatgcctttggtgggttgtagtttgatggtactcttc

SEQ ID NO: 67973 - DNA, 201 bp, Homo sapiens
atctgtcgaatgtttccctgtggaaaagaggattttaatatatttttctcttgctgacttgagtaaagatttctgattatcctagaacagagataatggargtaatttttcatggaaaaactatatactttcgtttgtaagctgttagaattggcattttgttggttgggtgccaggctgctagactatgcaccacgtggg

SEQ ID NO: 67974 - DNA, 201 bp, Homo sapiens
tctgtcacaaatctttttcacagggtgaggaagtgttttatgggaggccaagctactttttaaaagatggtatgaaaacatgaattgaaatgtattattgktattgttattattgttgtgtagtaagtcctaacttaatggaaatttttgtgttctggaactgtaagcaagttttgagtccattggaagtagaccagattt

SEQ ID NO: 67975 - DNA, 201 bp, Homo sapiens
attagttattgatttgcttttgtaaagcaacagcagaaaatgttgcccttatctgattgtaatatttctagaactagagctctcttaaaacatttcctgcraagatatttttcactttttaaagaaaaatgtttccatgctctcacaggataagtagagagagggcaaaagttcagtctcactatttaagtttctgtgtaa

SEQ ID NO: 67976 - DNA, 201 bp, Homo sapiens
gaggaactggatttgttttctgaccacgatagtaagcataatgtcttcaacttaggcaaagcctgggtagggttgctagcagccactgtgtaagagtgagkgtttgctaagtttatggttcctcagttgtgacactgacccgctgtgtgccagccttcatctgaccttgcttctgcatttccctgtgggcgttggtggtta

SEQ ID NO: 67977 - DNA, 201 bp, Homo sapiens
gtctaaaagttggtttattttatttatttaattctatgaaaaagaatctagaaaagttataaaatgcatgggataataacattaagttatctttatggaaktttccactaccatgtagggaagctataaattgctgcctacttaatagcaaacagttacttatttaaaaaagagctgtaattacaggccatcaactacatc

SEQ ID NO: 67978 - DNA, 201 bp, Homo sapiens
atttagtttggtttgctaccagtgcaaaaagaaatttttcagttcacatttaaaaggtagaagtgatttaaaaattattaatattgcagcccttctcaaayctttcacttgatcaacaagtttttagcattttctctttacttttctaactttttgttttgaaataatttcagatttaaagaaagattgtagaaagaatta

SEQ ID NO: 67979 - DNA, 201 bp, Homo sapiens
ttagtataatatactactgccttcttaacaagtgaccacagttcattttcttgatattgaaaatctccttaggaagttctgtctattaccaagttaatgcrttggcattcttggatttattcttttaaaaatatttgctgagatcctgttatatgtcaggtcccatcctaggcacatatttatattaattctctcacatgt

SEQ ID NO: 67980 - DNA, 201 bp, Homo sapiens
ttgggtattgggaaggagaggatactggcaaagtccacaaaagaatcaagaagaacgcttaacaacgtatgtttattaagataattttcataatgaaagtrtatatggatgacaaagtgcagctaaaaggtaagaattgcatatgttatgcataccctaatcctgttattcacagtaaggttgttagtataatatactact

SEQ ID NO: 67981 - DNA, 201 bp, Homo sapiens
gcaggacaccagtcacatagggtcttcaggggagaaggtggggagaattctttttatggacccaggaagaaagggcgggagaagatcagagtgatctttgwgttcatgccaagatgccgtattttgggatataatgtcctgagccctgaaaaggaaaacactgagtctttcaccattaagtaagatgttagctggattttt

SEQ ID NO: 67982 - DNA, 201 bp, Homo sapiens
ggaaggggggagggatagcattagaagatatacctaatgtaaataaggagttaatgggtgcagcacaccatcatggcacatggatacatatgtaacaaacytgcacgttgtgcacatgtacactagaacttaaagtataatgaagaaaatatatattaaaaaaagactcttgctttaaagaaagaggttgctgcctactct

SEQ ID NO: 67983 - DNA, 201 bp, Homo sapiens
cctttaccattatgtgatggacttctttgtttcttttgatctttgttggtttaaaatctgttttatcagagactgggattgcaactcctgcttttattttyttttgctttccatttgcttggtacatcttcctccgtccctttattttgagcctgtgtgtgtctctgcacgtgagataggtcttagaggagagtttcttat

SEQ ID NO: 67984 - DNA, 201 bp, Homo sapiens
ctacagtgaccaaaacagacatggtcccttctttatgtaggttatattcttgctggggatctagagaataaatgagaattgaataagtaagtgtgtgttgmgatatattgggaaggtagatccaacttggctaacagattggctatggtatatgagagtaaaggatatcagccaggtttttggtctaaacagctagaatcc

SEQ ID NO: 67985 - DNA, 201 bp, Homo sapiens
aaagtagcctggtagcttgaagctgttcttttagctttgctgcagatttataaaatgttcaacatttccatttacctctggacaggctgtagttttttttkttttttttttgttttttttttttttaaggattaagatccttgaagctagaggtctttgaaactgcatctgagtggaagaggtctagtgtaaagtgactca

SEQ ID NO: 67986 - DNA, 201 bp, Homo sapiens
gactggctagcctggtgtgtcaggattccaaaagatccatccagactaggacttaggatgagtatagacctcatcagtgaaggggtaggaattgcagggayttctgagcagcactgttgtgtctttacaccttcttccaatctagtcattgagaaaacttgtgattaggttccttgccaggtgcactaatactctgagcat

SEQ ID NO: 67987 - DNA, 201 bp, Homo sapiens
acatcaatcatttccaacaaacaaaatgtaattttctaaaatatgccataaaaatagcaaaaactatgtataaggtagtcagtgatgaatttaacaaaagwtctcaagacccatggaaagacatgaaagaagacttacataaattgaaagagaaaggaagcctcaatattataaaaatgctttttatgcaaaattaatcta

SEQ ID NO: 67988 - DNA, 201 bp, Homo sapiens
catagacattcaacttcactggcaaaaatcaaacaattggcaaagataaagtgtcacagtaaaatgtgatagccagcacatggaaaaacaggaaaattcayaaaactgtttcattaaaataatttggcattatccattaaaatagaagatgtgaaaatcctatggcccgacaaatttacttcgatgtgtatatatatcctc

SEQ ID NO: 67989 - DNA, 201 bp, Homo sapiens
aagaaagccctctgtaaaaggaggattgaaagagaaaatttcagcttcccctttctgactgcttactatcattacagggcgcctttgcgaaggaattccarcaagggaaagaagtggaaagaaaaagaaaaagaagccagtaggttttctgcaggtagcaggtacggttgtgtgattaagaacacgtgtatttctatacct

SEQ ID NO: 67990 - DNA, 201 bp, Homo sapiens
taaccctggttttaatatttatgtaactttttgcagaaataatttaaaatagggagaggtaactttcaatcccaaacatagatcaaatacttagtaatttrtttgacctataatgctggttctcaaccctggctactctttacaatcacctgggagcttcttaaaattaccagtgtgatcttaaccccagagattctgatt

SEQ ID NO: 67991 - DNA, 201 bp, Homo sapiens
aaataaggacttggcttgcatgataagtaacatttctttatatagctattcagttgagctattgaaagtaaaacatacaaacaaacaaacaacaatagcaraaaacgctttgtgttgttgttgacagaaaagttgaagcttttcaatggtgttttcctctctcatgtcgcataaccatgatggtgataagcgtacaattat

SEQ ID NO: 67992 - DNA, 201 bp, Homo sapiens
cagtgtgtgcacatgacaggcctaacagatctcaagaaaactgttctttcatggctgttgatttcatgtagatttttgcatgtacacttcacatacacatrtgtttacatctctatgatgtatattagtagccatttcctttctaacattggtacttagtagtttgatttttttttaaacaaatcttattttatgtagtaa

SEQ ID NO: 67993 - DNA, 201 bp, Homo sapiens
ttacttgaggccaggagtttaataatatcctgggcaacatggtgagacccctgcctctacaaaaaataaaaaaaattagggcaggcatggtggtgtgtgcytgtaggcctagctactcaggagactgaggcaagaagatcttttgaacctaggagttcaaggttacagtgaaccatgattgcgctactgcacttcagcttg

SEQ ID NO: 67994 - DNA, 201 bp, Homo sapiens
aaatggtatttctagttctagatccttgaggaattgccacactgtcttccacaatggttgaactactttacagtcccacccacaatgtaaaagtgttcccrtttctccacatcctctccagcacccgttgtttcctgactttttaatgatcgccattctaactggcatgagatggtatctcattgtggttttgatttgcat

SEQ ID NO: 67995 - DNA, 201 bp, Homo sapiens
ttctgcttatccgttttacaaaaactgtatgaagatggctacatacttcttggtgtttttttgtttgtttttgagacagaatcttactctgtcacccaggytggggtacagtagtgtaaccatggctcactgcatccttgaccttggggctcaagtggtccttccatctcagcctcccaagtagcagggactacagatata

SEQ ID NO: 67996 - DNA, 201 bp, Homo sapiens
aaacacttggacacaggaaggggaacatcacacaccggggcctgtcatggggtcggggaaggggggagggatagcattagaagatatacctaatgtaaatraggagttaatgggtgcagcacaccatcatggcacatggatacatatgtaacaaacctgcacgttgtgcacatgtacactagaacttaaagtataatgaag

SEQ ID NO: 67997 - DNA, 201 bp, Homo sapiens
acattctgttatggtagcttaataataatccttaaaagcaggaacagttagcctttgaactgtgttcttttccagttgtttggctcctctaagtattttcwtttgtctatgaattttagaattagcttgtcaatttatacaaaagagcctgctggtattttgatttgtattgtttggaatctgtgaatcaatttggggaga

SEQ ID NO: 67998 - DNA, 201 bp, Homo sapiens
tatggtctcctggaggtgagacagggtttatttgctaatagcctgttgagcaattcagttgtcttaccattgtctcctttccctgcctgatcttttttcaytgaatggccataataattttttttttttttgagagacggagtttcgcgcttgttgcccaggctggagtgcaatgctgcgatcttggctcatcgcaacctc

SEQ ID NO: 67999 - DNA, 201 bp, Homo sapiens
taaatccagcctttttgttcagcataattgtccatgttgtgcaagtatcaatactttctaacttcttgttgctagctaggattcttttttttatggctgtrccacaattcatttgtttgttcgcctgatgacagatgtgggaattgttttcagttttgggtattacaaatagagctgctatgaacagatgtatacaaattt

SEQ ID NO: 68000 - DNA, 201 bp, Homo sapiens
ggcaaggcagcgatacacacatgtgctttcaggcaacacatgttttagggtaagtacttttggggtcacacactgttatttaatatctgacaattgacatractgatttatccattttagtgagaaggatttttatggtaaatgaggttttcaagtattccaagactgatttgatagtgtattctcaaaaaaaagccctac

SEQ ID NO: 68001 - DNA, 201 bp, Homo sapiens
cataaaggaaatgagaagaacaaatattggatagctaatggataaatgctccttgaataattgagttaatttcatatataattgaacaatttattgattartatatctttgttaatcagtcacttggtttttttacttttatgatttatagaatcatcttgtgatttcaaagttagagttatttttatttgacagtatctc

SEQ ID NO: 68002 - DNA, 201 bp, Homo sapiens
gtgcatggagtagaggggaacttcataatgcatatgttttctggcctgtgaactggagtccctgggtgagtactggagttctaaagacacgtgagctaacyctgctcccctgtgtcttctgaacaagacatggcaaggcagcgatacacacatgtgctttcaggcaacacatgttttagggtaagtacttttggggtcaca

SEQ ID NO: 68003 - DNA, 201 bp, Homo sapiens
gggtggatcacctgaggtcaggtgttcgagaccaggctggccaacatggtgaaaccccgtctctactaaaaatacaaaaattagccgggcatggtggtgtktgcctgtagtcccagctatccgggaggctgaggcacaagaatctcttgaacctcggaggtagaagttgcagtgagccaagatcgcaccactgcactccag

SEQ ID NO: 68004 - DNA, 201 bp, Homo sapiens
ttgcttgcattcactacatggaaaacatcacaatgggagaaatagatcctgaaattataaacctacagtggagctctaaaaactatattgagaaagattamcttacaatatattgcttatgcttagacatatctgtttcaatgctttaggaaattataagtcatactctagtagaatttaagctatgtagataattttcaa

SEQ ID NO: 68005 - DNA, 201 bp, Homo sapiens
ttctggatttcagttttctcatgtgcaaaataaggattatagagccaaatgagacccaaggttgtcttaagcactaacattatgtgatactttgaatattrcacagtggaaaacattaaacaagtgtgtgctaaatcggagttgttcaccatttctctctcatttttcttttttttaacttttaaaactgacacgtaataa

SEQ ID NO: 68006 - DNA, 201 bp, Homo sapiens
gttttttgacccaaacaaaatgttcctgtttattacttcaagtcagtgattcttaaacaactgttggtggttctcaatttattggcaaaacattttcccgraaatgccagactatcatcataacaagtgccttagaaaaacttcgtttctggctgggtgtggtggctcgcacctgtaatcccagcactttggaaggccaag

SEQ ID NO: 68007 - DNA, 201 bp, Homo sapiens
ggtagaattcagctgtgaatccgtctggtcctggactttttttggttggtaggctcttaattattgcctcaatttcagagcctgttattggtatattcagrgattcaacttcttcctggtttagtcttaggagagtgtatgtgtctgggaatttatccatttcttctagattttctagtttatttgcgtagatgtgtttat

SEQ ID NO: 68008 - DNA, 201 bp, Homo sapiens
tatgtcagtgcgaaaatttagatctgggaatcacagaatacatgaattaagctgttttcctctttttcacaatgtatgttatgaaatttctaaccaagccrtgtccctttttgagtgatcttgagtatgtgctgtgtcaaattggataggcttttgtttcttcagtggaatttgcttatctatcatcaagaacaagaaaga

SEQ ID NO: 68009 - DNA, 201 bp, Homo sapiens
tggagtgcagtggtgcaagcatagctcactatatccttgagctcctgggctcaagccaacctcctgccttgcctcagcctcctgagtagctggggcaacargcacacagaaccacatcctgctaattaaaaaaaaaaaaattttttttttatagatgaggtctcactatgttgtccaggcctgtcttgaactcctggcctc

SEQ ID NO: 68010 - DNA, 201 bp, Homo sapiens
aaatccattaacttagtattgcccttcttagaaataatggattatgatgatgatgatttttcaaaacagatgagtacttaccagccaaaaggcttttgtgycattatattttgctttatgattttgtaaattgtgtcaaaaagattgaattggtgccagctccatgtttgaattctctaaaaaataagtgctggtttagat

SEQ ID NO: 68011 - DNA, 201 bp, Homo sapiens
aactcatccatttttatggctgcatagtattccatggtgtatatgtggcacattttctttatccagtctatcattgatgggcatttgggttggttccaagyctttgctattgtggacagtgctgcaataaacatacatgtgcatgtgtctttatagtagaatgatttataatatcctttgagtatatacccagtaatgaga

SEQ ID NO: 68012 - DNA, 201 bp, Homo sapiens
aaccacaagaagtttgaccagaggaataaaaaggaaaagacaccaccaggtatggagaagctgagttaggagaccctatgaggtggtgccctctaaagagragcagtagacaatgacaggaaagaatgattcaaggacccttgagacataccttgactaggtaacaggtaagaaagtgaggcaaaactatcatgggcttca

SEQ ID NO: 68013 - DNA, 201 bp, Homo sapiens
ttcaggggagtacagtgacatcaagtggtggaaggggacatggccaggctttctagtctgtgtgccttggtgtctttggcatgaaagcacagggattgggytagatcacaaaattccttccagcttctaatgttccatgaatatgaaataagacatcaagtctaacaagcagagggggcaaagaaagaagatagtcacatt

SEQ ID NO: 68014 - DNA, 201 bp, Homo sapiens
gattagatatctgcgcaccatggcccagccaagttgacttataaaattaaccatcacggtcaagctttcttgttttgattgccccttctgaagctgtttcrgggaggaaactcatttttccccccacatgtcttagtgggggagttggttcctctctccctctcattcttagaaaatttgctgaagggattccctctgttg

SEQ ID NO: 68015 - DNA, 201 bp, Homo sapiens
ctgtagcttgcaataaggaaatatcttacttgtttttctctttaggctttttttataggcattaataacaaatatttcctttcctcccttatttattgaaycacaccccttctcatactatctttccccccaaaggaagtgaattaattcactacctcttgttattacagtttttcattttaaaaacaaaaaacacttaag

SEQ ID NO: 68016 - DNA, 201 bp, Homo sapiens
ggctggtctcaaactcctgacctcaggtgatctacccacctcggcctcccaaagtgctgggattacaggagtgtgccactgcgtctggcctaccaaacgarattcttactcttaatctagaatgagaactattgagagttcatccattagaacccttgaagcctgtccctcagatggttgaaagtctgtagctggaggacg

SEQ ID NO: 68017 - DNA, 201 bp, Homo sapiens
ttttcattattcactcataataaaattgaatacattaaaaaactcgagtcttctgattattagatgttataagaattaacagggtagatggatttaagaarcatcagacatcaatcatttccaacaaacaaaatgtaattttctaaaatatgccataaaaatagcaaaaactatgtataaggtagtcagtgatgaatttaa

SEQ ID NO: 68018 - DNA, 201 bp, Homo sapiens
ggccaaaatttttaaagacagtactaagtgttgatgaggatgcaaagcaactacagcttttatgcattgctagtgggaatatgaaatgatactattacttygaaaaacaatttgacaatttctttataagttaattatacatttaccatatgacttatcaattccattatttgtctaaaggaaatgaaaacttatgttcac

SEQ ID NO: 68019 - DNA, 201 bp, Homo sapiens
actatgacacttgtggaatttttatcttgctggctccttctctgtataacgagttctgtgagtagtagcattagtgaactggagctccctcaggagattgkcccatttgcagatgtggcaatcagaagagttttagtttgagttactgggttttgactcttattacctaatacaattctttatttatttagttttgagatg

SEQ ID NO: 68020 - DNA, 201 bp, Homo sapiens
tctggagtttttctctgccaagctctgagctcactagtactcagccctacaaactctggcctcttcagtctccctagagtcttatttttaactcctcaacygagtgagactgctgtgatctacttgggattcctagcctgcactgttatggaaagggtcttatggaaaagggatttactcagtttttttccttcactcatg

SEQ ID NO: 68021 - DNA, 201 bp, Homo sapiens
ttaatttaattaattttttttgagacaaggtcttgctctgtcaccctggctgtagtgcagtgatgcagtcatggctcactgcagccctgacctctggggcwcaagtaattctcctgcctcagcctcccatgcagctaggactacaggcaagcgccaccatgcctgttattattttttttttttttgtagagatgaagtctc

SEQ ID NO: 68022 - DNA, 201 bp, Homo sapiens
ttctggctagttagaacaaataagtagtaccagtaccttttctggtcttccatgccaagcctcagaagctaagcatatatgtaagattaaccatatttctkttatttcctattatgtggaagaatgtttttaatatttaaaagagttttgctatcaaaagtttcttgttaaaaggggagtaattattctctgtgactataa

SEQ ID NO: 68023 - DNA, 201 bp, Homo sapiens
tgcctgtaatcccagcactttggggggccaaagtgagaggatcacttgaggccaagagttcaagaacagcctgggcaaaacaatgagatgtcatctctacraaaaattataaaatgagctttgccaggcatggggcacatgcttgttagctactcagaaggctgaggcaggagaattgcttgagcccaggagttctaggat

SEQ ID NO: 68024 - DNA, 201 bp, Homo sapiens
caaatgtgtgaccttggacaaatcatttcacttttcaaggcttccattttatcatctgtggaattataaaaataatacctgcttttctcatctcaagtggwttcagtgattgtttatgataatagaacttgatctacaacatgctataaaaatgagagatttttgccacaaaagtggccaaattatctttgccttgacgtt

SEQ ID NO: 68025 - DNA, 201 bp, Homo sapiens
cttcaacgaatgcctattgaattcatccttattttctaaggaaagtggcaatggatcagaacgagaagatccaggttttagttctggttttaatggtgatycactgtgaggaaaagaccaggttggctgtcttctccaatctttagtcttcccgtgtctaaaatgagttcagaagagcctacagttggagcgtccactggg

SEQ ID NO: 68026 - DNA, 201 bp, Homo sapiens
accgcttgcttttgcctcgcagctcttaagattctttccttagataacctgatggctacgtgcctgggtgatgatctttttgctggtggtcatctttttgygatttatttcccaggtgttctttgagcctcattgtatttggatcctcttcctcctcaggaacaccagttattcttaggtttggctgtttaacataatcct

SEQ ID NO: 68027 - DNA, 201 bp, Homo sapiens
tagatggtctttaaaggtgcctttcccccaagcctatccagtgagctcctaaactttgccattcgcatcccccttgaacatcatctttctaccctttaggragaaagcaataagattaaatcgtttcacattgagaaaggcaggaataactgaaatgaactcttcaaggagttgttaaacccagtgactaactttttaata

SEQ ID NO: 68028 - DNA, 201 bp, Homo sapiens
tgttgctaagctttgtgtcactacataataagcacgctcccttccagtttccactcacaatctgtgcagtgcaatttagtcttgctccaatacactcttcrgaatcctagccttcgcccactgcctgtttccaagccacttccctgtttttttctgtatttgttttggcagcatccctcttcaatttgctgcattacaaac

SEQ ID NO: 68029 - DNA, 201 bp, Homo sapiens
aaaactctcaaaacatgttgacattcgttggatatatcaaactctgaaacatcttttactgctcacagaatttcagatcacctggtgtgatggaaatatcrtgtgaggtggaatccaatccatgttttatcacttatcaaatgtgtgaccttggacaaatcatttcacttttcaaggcttccattttatcatctgtggaat

SEQ ID NO: 68030 - DNA, 201 bp, Homo sapiens
gtacggacttgcctgggttcatattcagccataatcatttactattaatagccaataaagaagcgggtaagttacaaaacctaaaccttagtttttccatyagtgaaatggggctaaaaatagttatgttgggaaaacttgtgaaagactttgaaatgagcaaaagattactgtttgtcctttcaatggaatgctggatgt

SEQ ID NO: 68031 - DNA, 201 bp, Homo sapiens
tctatgtggggagacacttcactgttttctacttcaaagtctgatcatgatgtggaagaatctccttgccatcaccaaaccaccaacaagaaaatattacvagaaaaaggtattgttaatttctttttctgacttcataacacctcagcttgtacagtataaaaatgactttttctcataatcataagtcatttgttttct

SEQ ID NO: 68032 - DNA, 201 bp, Homo sapiens
cattttttttcatatctgagggacatcagtggaaattaggatggagaagtcccattataactggctaaatgataagcatctaacggaatatcaaattagargaagtaaaagatttttttctagagatttgtaaaacaggttatatgccagtagaaggcatgaaaatattttcctcgttcctgttatataaacaacctaata

SEQ ID NO: 68033 - DNA, 201 bp, Homo sapiens
gaactttaccttcatagaatttaattgatttgcccagggttatgcagcaggcagttaatgtcaacctggggcttgctcctcctgtgtagatgtttttccawcatactatgccaccttcagttacttatgcatctaatgatgcttaaatttctttataaaatttggaaataatctcaatatcatagactaaggaagaaacac

SEQ ID NO: 68034 - DNA, 201 bp, Homo sapiens
aaaccacagcttgtcaagggcaggtggccatcagcacactgcttcaccacagtcgatgcctgctttgaacccacagctagacttctagattggctgcctcrccaccactgtatttttaaaactctggagtccccctgattcagcagtcagaaattattgtacacatacccacactacaaactagtttctaattagaatcat

SEQ ID NO: 68035 - DNA, 201 bp, Homo sapiens
ctgagctggaatccaaggtagtagtccttacttttccattaggcaagtctctgaattcctgggaccttggtttcctaccaaaaaataagtggattgggctracactgcatggctctgacttcccattcacctctgcgtacactgtccagtatggttgcctctagtcagataaggctagtctatattgggatatgtgtagga

SEQ ID NO: 68036 - DNA, 201 bp, Homo sapiens
attccccataactgtctagcccatttttagctgcatttatcaatttaatattcagttttctttttaagtacagtatttcaaatgcctgaagcctgacaaayttacattcttaacaggcaaacacttttccatacttaaaaaagctcttgaaaatctaataagttactgtttaactgtagtgactctaaacgtcccaatata

SEQ ID NO: 68037 - DNA, 201 bp, Homo sapiens
aggtagaatcagtggacacatttctctttcagatttctattcatacaaattttcttaaacacctaagcaatatatctgttattcttaaacttagcatttakattttgatagtatggattttatttacgtgatcctcttctatttcattttaaacccctccagtatggggaagactcattaagggaatagtttcaccatctc

SEQ ID NO: 68038 - DNA, 201 bp, Homo sapiens
gagctttagatggacatgtttctcacagctgttatccattagggtctctagatcccatttagatgaggctagctttacaacctcaaactccttggtggatrttagaaccttatagaattacttcattcgatttaggtaaatacaagtctgcaatcttcctctggttgcaactaattttcttcaattaacttcttttactcc

SEQ ID NO: 68039 - DNA, 201 bp, Homo sapiens
caactaattttcttcaattaacttcttttactcctgggcttaaattctgtatttcttttatacttcatctgttctggcagtttctgaactcttaatgataytttgatgacatccagttagatgctgaatacttcacacacctgtattcaaagttagaatgacaacaacaaagatcaccttggaatgtttagctggcaattt

SEQ ID NO: 68040 - DNA, 201 bp, Homo sapiens
tcttgattgcctataaaggaattaaatatgcatttatataataaagtagttgtgaagtttttgaacataattagaaaaaagactctttgttgatcgagtayaaaatgtgcttcatgaagcgtttgattagttaaaatatgaaaaattttagttgaagagcttttaatagggcttatctttagtcagtcattttatacataa

SEQ ID NO: 68041 - DNA, 201 bp, Homo sapiens
tttgagaaccatcggcttaatgtaacagacaaaatatttagtatatttgtaatacttatttactaaatcatgttttcttatacaacttatttcttatacarattatttcatacgtagccagttcattatttgaaaaatcaaggtcagattgcccctgttagctgatattttaacctcttgattgcctataaaggaattaaa

SEQ ID NO: 68042 - DNA, 201 bp, Homo sapiens
tgctgcttaaaattaaaaaatacatagaactgagtattgagtagttacaaaatccttctgaaatgaaaagattttgctcccagagtatatagaatttgtgyacggacttgcctgggttcatattcagccataatcatttactattaatagccaataaagaagcgggtaagttacaaaacctaaaccttagtttttccatca

SEQ ID NO: 68043 - DNA, 201 bp, Homo sapiens
tcactcttccatttttgttagtttgtattgcagtgtgttaaaatttactgtaattttcatttttcagttcagatactctgtgtttttttttttttttttttgagatggagtttttgctcttgttgcccaggctggagtgcaatggcacaattgcagctcactgcaacctccacctcccaggttcaagcaattcccctgccc

SEQ ID NO: 68044 - DNA, 201 bp, Homo sapiens
atgttaatgaggctggttttagaaccatatgtgaaaaaaaaccccactgacttagggtttcaaagagatgtaaaattaacactcttatctagatacaaatratgagttatctaagtattgaacacattttgaagattttatttaagtcattaatgatggaactagtcagatattataaacagttcaaagaagcacaaattt

SEQ ID NO: 68045 - DNA, 201 bp, Homo sapiens
acagtggaaaagtgaaatgagaaacgtctactttctaaaaaaatgaaaataagaagttatgagtcaaaatatatgttgagagtaaaccattctgtaggtgyaaagtaggcagagtttcagctttagaatagatgtaatacaaatacatatacatatacttatactgtttcatatcctaacatcctggattgataacctgcc

SEQ ID NO: 68046 - DNA, 201 bp, Homo sapiens
acacagagagacaactatgacatgttttcagtcctatataggagctaaaaatgttgatcttatagaggtagagagtagaatgatagttaccagaggctggraagagtgtaggggtgtgggtgggcggatgaagagaggttgcttaaaatgtacaaaaatacagtccctagaagaaataagatttaatgttcagtagcagaa

SEQ ID NO: 68047 - DNA, 201 bp, Homo sapiens
aaacagtatcttaactatatagataaagtaatactccttttgcatcaagtgtgatagtaggagaggaggtatttcttccagtaaaaatcaagatgtattcrtatcctttgagctagtaagcctacttctcatagtgtattctatgtaaataattcaaaaggatgaaagttctctgtagcgttatttaaactagtgaacagt

SEQ ID NO: 68048 - DNA, 201 bp, Homo sapiens
ctaggtagatgtttgattgaagagaaaattataactcatatcccaaaccatcgtggaaaggattaaacttaaaaagtccgtctcaaaaaaaaaaaaaaaargtctgtagcacacagcaaaacctttactcagaggaaaagctatatccttgatttctttctttaaaataaaaaacttgaaaagcaaaaaatggacctgtct

SEQ ID NO: 68049 - DNA, 201 bp, Homo sapiens
tctcttgaacccgggaggcggaggttgtagtgagccaagatcacaccactgcactccagcctgggtgacagagggagacattgtctcaaaaaaaaaaaaargaaagaaagaaagaaagaaaaaatgtgactcaaatatagcacaatgctaggattttataaaggtgagtattgggtacatgaaagtttattatctgtttga

SEQ ID NO: 68050 - DNA, 201 bp, Homo sapiens
tgaccccgatttgctccaagatgggagcaggtgcccacagcagggagaagccaagcagcgggagcaggcacttctgagcctgcaggggcaggggggccttytcagctccccctctccccccccagagtgcagggatacctgggtctgcagccgcaatatgggctgctcccttgaccctagggaagtggagctcctggtccc

SEQ ID NO: 68051 - DNA, 201 bp, Homo sapiens
atcctcatctttggctgctcttaagagtttccttttattgctgattttgagtaatttggttatgatatgccttggtgcctttttctccatgtttctcatgyttgggttttgttgagcttcttggatctatgggtttagagtttttataaaacttggaaaaatttggccattttttccccccaatgttttctttcccttctt

SEQ ID NO: 68052 - DNA, 201 bp, Homo sapiens
cttgcttaggcccgctgggtttgttctgcctacctggcctggcaggctttacttggctgacactactggcctggatcccatacctgccaagggtaagtcakgcatggagtggcaaggggtgtgtgagggagcatggggttcagccagtgtgcaatcggacatgccggctgctgcaatggggcgggcagttacaggtgctgg

SEQ ID NO: 68053 - DNA, 201 bp, Homo sapiens
caataggatgtgtatatatacagagaaaaatgtaaggagttggctcacaggattatggagactggcaagtcaaaaagctgcagggtgggttggcaggctakagattcagggaagagctgacattgcagttcaagtataaaagccttttgctggaaaattttttttttgcttgtgggggagtcagtctgttgtcctattcag

SEQ ID NO: 68054 - DNA, 201 bp, Homo sapiens
ttactatagattcatgaacttcttatactatgtaaaccaattatatcttagctccttaaaattcagagacttctaaattttatttattaatactcttcttwggaaaatacttcatacagaatgagagagaatgacttctgagttatagcaacacagagaaaattgtagctttaattataacaatctctgcaacagattaag

SEQ ID NO: 68055 - DNA, 201 bp, Homo sapiens
gagtagctgggactacaggtgcgtgccaccacgtggggctaatttttgtatttttagtagagacggggtttcaccatgttggccaggatggtctccatctyttgacctcgtgatccacccgccttggctttccacagtgctgggattacagaagtgagccactgcgcctggcctgaaaatcattctgatgagaagcataat

SEQ ID NO: 68056 - DNA, 201 bp, Homo sapiens
ccctgggtgagtactggagttctaaagacacgtgagctaaccctgctcccctgtgtcttctgaacaagacatggcaaggcagcgatacacacatgtgcttycaggcaacacatgttttagggtaagtacttttggggtcacacactgttatttaatatctgacaattgacataactgatttatccattttagtgagaagga

SEQ ID NO: 68057 - DNA, 201 bp, Homo sapiens
gcatgtgtgcagacaggatctatagagaagctctccaaatttcccacttaattttgttctgaacataaaaaaactctacaaaaggaaagtttattaatttycaaaacaggtaggagaagggtaatgttactgtaggaagctttgcttatttataagtttgtttttattttttacattaataaaggaagtgataatgtcagc

SEQ ID NO: 68058 - DNA, 201 bp, Homo sapiens
cagtctcactctgttgcccaggctggagtgcagtggcacaatcttggttcactgcaacctccacctcctggattcaagcgattctcctgcctcagcctctygaataactgggattacaggcatgcgccaccaccacactggctaatttttgtatttttagtagagaggggatttcaacatgttggccaggctggtcttgaa

SEQ ID NO: 68059 - DNA, 201 bp, Homo sapiens
attcacacctgtaatcgcagcactttgggaggccaaggcaggaggtcaatagcataataaacccctatctctacaaaaaataaaaaagttagccaggcacrgtggcacacgcctataagtcctagctactctggaagctgaggtgtgaagattgcttgagcccaggaggtccaggctgcagggagccatgactgtgccact

SEQ ID NO: 68060 - DNA, 201 bp, Homo sapiens
cagcactagttatgcagacaccagaatggacatggccactctgctcaataggcagcactcaagcccatttatatcactggccaatactccccttgatgaarcatgttatatttttactaactctgggtctattacgactgacttgttgggtctgtcactcctaaaattacagactgacatataaaagtttgggatagatag

SEQ ID NO: 68061 - DNA, 201 bp, Homo sapiens
gtttacactttggtaatatttgaaaatggatgtatatactggaaatgtctgtaagtgtcttgtttttgcacctaatttatgatctattatattgcattttyttaaatatcttagaagtatttttctttataactttgtatattgaatgtttagataaatgtccaactgacaatgttataaatcaaattcttattcctaaaa

SEQ ID NO: 68062 - DNA, 201 bp, Homo sapiens
aaactcacatggtcataatatattatcctttcaacatactgtttaatgcagtttgctaatgtagtgatgaattcttccagcttttatgtatctgaaaaaargtatttttcttgcctttatttttgaagatatttttactgattatacaattctaagttgatattttttttcattactttaaagaagttgctgcattatctt

SEQ ID NO: 68063 - DNA, 201 bp, Homo sapiens
aaactcctgggctcaagtgatcctactgcaccaagccttcctagtagcttggactacagttgcgctccactgcacccagcttataattttttgattaacarcaattctaagagaatattatgtaatgaagtgtgagaataattagtgcagtggtttgaactttaagacatacgaattttatgttcatgaataatgtacatt

SEQ ID NO: 68064 - DNA, 201 bp, Homo sapiens
ggttaaaaatgtttttacaagtgcagctacgtagtcattgttgtttgattttcatatccactgaatattttaatgaagttctggggaagttttatttacaygctcccacctcccccacccccaggtgattatttggaaacctgtgtctgtgctgtgtggcagcctctctgatgctctgcgggtgcagtgagagagttgtat

SEQ ID NO: 68065 - DNA, 201 bp, Homo sapiens
ggaggctgggcagtgcagagttaaacatgggggaacagctcagaaatcacatagaagtttcctaattactcctttctttttttccttgcctcccctgacarccacactcactccaagattctgatactgcctctgattagggtgaggtctctgattgagaatcaatagttttgataaagagggaaaatagcatgagaacca

SEQ ID NO: 68066 - DNA, 201 bp, Homo sapiens
ttaatgcagccatgggatattgggatctgttgaccttgctactgctgtgtgttcagcatttcagcaacactggcaaacacaacacagttcctcttcccccyacctaacccaagaaattgaacaggaaattgatttttaaggaaaccaccattttcaggtttcctctcctggggaacattctggctggtcttcagcctgcct

SEQ ID NO: 68067 - DNA, 201 bp, Homo sapiens
tagcatgtaatgaaccatattttattgaaagtatgaggctgttcccttcactggaagttcctaggggacacagattgtcatttattcattgttatatcctyagcactgagcacacggtagttaaaaataaatttgaactgaacttgaaacttgaaaatcaatatccaatgttttaattttaaagtcttggcctgtctttta

SEQ ID NO: 68068 - DNA, 201 bp, Homo sapiens
attgctagctcttatcttttttttctgtcatcttccttaatgtggtttatttaaaaaatttctttgactggtcctgtttcaaattgaatgattatgctgtwgaaaagatcagaaatggtcctggctctcatctttcttgggcaagccaatttttaaactaatctgtaaatttcattaaaccatgtgaacaaacagtaaaac

SEQ ID NO: 68069 - DNA, 201 bp, Homo sapiens
gctttcaaaagcataagctatcagagatagaatcagttggttctcctctaagttcctttttggggggtagaaactgaaatatgccatgctgtacgtagttstgaggattgaaagagttcttgcagtattttctcatataatcttagacacgtatcgtgatgtggatacgctattcctgtgtttttaaagggagagataaat

SEQ ID NO: 68070 - DNA, 201 bp, Homo sapiens
tgtttgtataataaaagaaaaggaaaacatttagccttaaagtaaaataagttggctctgttagcctctagagttcttaaaaataattataagtctcttcrgaatccctctaaatgtcttcatctcctttattgtctttatctgcttaaaactgcttctcttgaaagaccagaatgcaagatcaaaaaatcaaatattata

SEQ ID NO: 68071 - DNA, 201 bp, Homo sapiens
ctccaggaaggatcccatccaccagagctgccccacatggaccatggtcaggcagaggaagatgcaaaggataaagccagatgacctcaaaggtctcatgrgattctaatctgtccgctccttgttctacagattccaaaccaaaagaagcaagcaagtctgtgctgatcccagtgaatcctgggtccaggagtacgtgta

SEQ ID NO: 68072 - DNA, 201 bp, Homo sapiens
caggcagaggaagatgcaaaggataaagccagatgacctcaaaggtctcatgagattctaatctgtccgctccttgttctacagattccaaaccaaaagargcaagcaagtctgtgctgatcccagtgaatcctgggtccaggagtacgtgtatgacctggaactgaactgagctgctcagagacaggaagtcttcaggga

SEQ ID NO: 68073 - DNA, 201 bp, Homo sapiens
cagatgacctcaaaggtctcatgagattctaatctgtccgctccttgttctacagattccaaaccaaaagaagcaagcaagtctgtgctgatcccagtgartcctgggtccaggagtacgtgtatgacctggaactgaactgagctgctcagagacaggaagtcttcagggaaggtcacctgagcccggatgcttctccat

SEQ ID NO: 68074 - DNA, 201 bp, Homo sapiens
agatgacctcaaaggtctcatgagattctaatctgtccgctccttgttctacagattccaaaccaaaagaagcaagcaagtctgtgctgatcccagtgaawcctgggtccaggagtacgtgtatgacctggaactgaactgagctgctcagagacaggaagtcttcagggaaggtcacctgagcccggatgcttctccatg

SEQ ID NO: 68075 - DNA, 201 bp, Homo sapiens
agggaaggtcacctgagcccggatgcttctccatgagacacatctcctccatactcaggactcctctccgcagttcctgtcccttctcttaatttaatctyttttatgtgccgtgttattgtattaggtgtcatttccattatttatattagtttagccaaaggataagtgtcccctatggggatggtccactgtcactgt

SEQ ID NO: 68076 - DNA, 201 bp, Homo sapiens
gccagctgtggtgtgagtatcaacccctgggctgccctgggaggcaagggtgagggctggattttaaaagagggcctgttttggggagggggtgatgagcrttggggaggcagctcccagggctgaagccttccctgagagcagtgaggacacaggtcatgaactcacttttcaagtgctgaaggcggcagagtgggagcc

SEQ ID NO: 68077 - DNA, 201 bp, Homo sapiens
gctgatcccagtgaatcctgggtccaggagtacgtgtatgacctggaactgaactgagctgctcagagacaggaagtcttcagggaaggtcacctgagccyggatgcttctccatgagacacatctcctccatactcaggactcctctccgcagttcctgtcccttctcttaatttaatcttttttatgtgccgtgttatt

SEQ ID NO: 68078 - DNA, 201 bp, Homo sapiens
cctgagcccggatgcttctccatgagacacatctcctccatactcaggactcctctccgcagttcctgtcccttctcttaatttaatcttttttatgtgcygtgttattgtattaggtgtcatttccattatttatattagtttagccaaaggataagtgtcccctatggggatggtccactgtcactgtttctctgctgt

SEQ ID NO: 68079 - DNA, 201 bp, Homo sapiens
ttctctgaagatccactattcaaaataagactcctgctcatgttaggtgggaatggatatttggggttctggtagctccacagggatgctcaatgaagatrcaaaattagaagtcaaaataaacagctcccacgggcagtgttgatctcaccctggcctttcctttcagtgggctcagaccctcccaccgcctgctgcttt

SEQ ID NO: 68080 - DNA, 201 bp, Homo sapiens
tgggtccaggagtacgtgtatgacctggaactgaactgagctgctcagagacaggaagtcttcagggaaggtcacctgagcccggatgcttctccatgagmcacatctcctccatactcaggactcctctccgcagttcctgtcccttctcttaatttaatcttttttatgtgccgtgttattgtattaggtgtcatttcc

SEQ ID NO: 68081 - DNA, 201 bp, Homo sapiens
agctctgcgtgactgtcctgtctctcctcatgctagtagctgccttctgctctccagcgctctcagcaccaagtaagtctacttttgcagctgctatttcragtcaaggtgtaggcagagtccttttttctagtcatggctggcaaacagtgggatctggggatgggacaaaaggcagctaggaagattgccatgtagtct

SEQ ID NO: 68082 - DNA, 201 bp, Homo sapiens
gagcccggatgcttctccatgagacacatctcctccatactcaggactcctctccgcagttcctgtcccttctcttaatttaatcttttttatgtgccgtrttattgtattaggtgtcatttccattatttatattagtttagccaaaggataagtgtcccctatggggatggtccactgtcactgtttctctgctgttgc

SEQ ID NO: 68083 - DNA, 201 bp, Homo sapiens
ggtccaggagtacgtgtatgacctggaactgaactgagctgctcagagacaggaagtcttcagggaaggtcacctgagcccggatgcttctccatgagacrcatctcctccatactcaggactcctctccgcagttcctgtcccttctcttaatttaatcttttttatgtgccgtgttattgtattaggtgtcatttccat

SEQ ID NO: 68084 - DNA, 201 bp, Homo sapiens
agcctcacctctgagaaaacctcttttccaccaataccatgaagctctgcgtgactgtcctgtctctcctcatgctagtagctgccttctgctctccagcrctctcagcaccaagtaagtctacttttgcagctgctatttcgagtcaaggtgtaggcagagtccttttttctagtcatggctggcaaacagtgggatctg

SEQ ID NO: 68085 - DNA, 201 bp, Homo sapiens
catgagacacatctcctccatactcaggactcctctccgcagttcctgtcccttctcttaatttaatcttttttatgtgccgtgttattgtattaggtgtyatttccattatttatattagtttagccaaaggataagtgtcccctatggggatggtccactgtcactgtttctctgctgttgcaaatacatggataacac

SEQ ID NO: 68086 - DNA, 201 bp, Homo sapiens
tcagagacaggaagtcttcagggaaggtcacctgagcccggatgcttctccatgagacacatctcctccatactcaggactcctctccgcagttcctgtcycttctcttaatttaatcttttttatgtgccgtgttattgtattaggtgtcatttccattatttatattagtttagccaaaggataagtgtcccctatggg

SEQ ID NO: 68087 - DNA, 201 bp, Homo sapiens
ctgcagcctcacctctgagaaaacctcttttccaccaataccatgaagctctgcgtgactgtcctgtctctcctcatgctagtagctgccttctgctctcyagcgctctcagcaccaagtaagtctacttttgcagctgctatttcgagtcaaggtgtaggcagagtccttttttctagtcatggctggcaaacagtggga

SEQ ID NO: 68088 - DNA, 201 bp, Homo sapiens
ggataaagccagatgacctcaaaggtctcatgagattctaatctgtccgctccttgttctacagattccaaaccaaaagaagcaagcaagtctgtgctgaycccagtgaatcctgggtccaggagtacgtgtatgacctggaactgaactgagctgctcagagacaggaagtcttcagggaaggtcacctgagcccggatg

SEQ ID NO: 68089 - DNA, 201 bp, Homo sapiens
agctgggttctgaagcttctgagttctgcagcctcacctctgagaaaacctcttttccaccaataccatgaagctctgcgtgactgtcctgtctctcctcrtgctagtagctgccttctgctctccagcgctctcagcaccaagtaagtctacttttgcagctgctatttcgagtcaaggtgtaggcagagtccttttttc

SEQ ID NO: 68090 - DNA, 201 bp, Homo sapiens
gtcatggctggcaaacagtgggatctggggatgggacaaaaggcagctaggaagattgccatgtagtctgctgctaaatgtagagtctagtagatattcartaacattcaagttcctattttcttaagaattagcaaccagcagaggaaaacgatgggctggaagtcagactgttgaattggctctgcctttaattatttg

SEQ ID NO: 68091 - DNA, 201 bp, Homo sapiens
tgcaaaggataaagccagatgacctcaaaggtctcatgagattctaatctgtccgctccttgttctacagattccaaaccaaaagaagcaagcaagtctgygctgatcccagtgaatcctgggtccaggagtacgtgtatgacctggaactgaactgagctgctcagagacaggaagtcttcagggaaggtcacctgagcc

SEQ ID NO: 68092 - DNA, 201 bp, Homo sapiens
ttactatgagaccagcagcctctgctcccagccagctgtggtgtgagtatcaacccctgggctgccctgggaggcaagggtgagggctggattttaaaagrgggcctgttttggggagggggtgatgagcgttggggaggcagctcccagggctgaagccttccctgagagcagtgaggacacaggtcatgaactcacttt

SEQ ID NO: 68093 - DNA, 201 bp, Homo sapiens
cagggctgaagccttccctgagagcagtgaggacacaggtcatgaactcacttttcaagtgctgaaggcggcagagtgggagccgagagagaagggggttsctggggaggaagttattcagaggacagggaagcaggggaaggcagacaggtcccatgagatatggaccgattccttaaaccatgctagaaaaacatgtgg

SEQ ID NO: 68094 - DNA, 201 bp, Homo sapiens
agtcttcagggaaggtcacctgagcccggatgcttctccatgagacacatctcctccatactcaggactcctctccgcagttcctgtcccttctcttaatktaatcttttttatgtgccgtgttattgtattaggtgtcatttccattatttatattagtttagccaaaggataagtgtcccctatggggatggtccactg

SEQ ID NO: 68095 - DNA, 201 bp, Homo sapiens
gtccctataaagagagattcccaagtcagtatcagcacaggacacagctgggttctgaagcttctgagttctgcagcctcacctctgagaaaacctctttkccaccaataccatgaagctctgcgtgactgtcctgtctctcctcatgctagtagctgccttctgctctccagcgctctcagcaccaagtaagtctacttt

SEQ ID NO: 68096 - DNA, 201 bp, Homo sapiens
gaagtcaaaataaacagctcccacgggcagtgttgatctcaccctggcctttcctttcagtgggctcagaccctcccaccgcctgctgcttttcttacacygcgaggaagcttcctcgcaactttgtggtagattactatgagaccagcagcctctgctcccagccagctgtggtgtgagtatcaacccctgggctgccct

SEQ ID NO: 68097 - DNA, 201 bp, Homo sapiens
cccacatttgtcctaggcctcagagtccctataaagagagattcccaagtcagtatcagcacaggacacagctgggttctgaagcttctgagttctgcagmctcacctctgagaaaacctcttttccaccaataccatgaagctctgcgtgactgtcctgtctctcctcatgctagtagctgccttctgctctccagcgct

SEQ ID NO: 68098 - DNA, 201 bp, Homo sapiens
cctgctcatgttaggtgggaatggatatttggggttctggtagctccacagggatgctcaatgaagatacaaaattagaagtcaaaataaacagctcccaygggcagtgttgatctcaccctggcctttcctttcagtgggctcagaccctcccaccgcctgctgcttttcttacaccgcgaggaagcttcctcgcaactt

SEQ ID NO: 68099 - DNA, 201 bp, Homo sapiens
caggagcatgacgtcatctctaccatggaaattccactcactctcctgtgcccccacatttgtcctaggcctcagagtccctataaagagagattcccaastcagtatcagcacaggacacagctgggttctgaagcttctgagttctgcagcctcacctctgagaaaacctcttttccaccaataccatgaagctctgcg

SEQ ID NO: 68100 - DNA, 201 bp, Homo sapiens
ttctcgcctgcacctccctcatctttcctctatgatgacatcgccctggggaagagaagctgagaggaactcctcactcagctagcttcaggagcatgacrtcatctctaccatggaaattccactcactctcctgtgcccccacatttgtcctaggcctcagagtccctataaagagagattcccaagtcagtatcagca

SEQ ID NO: 68101 - DNA, 201 bp, Homo sapiens
tggaaattccactcactctcctgtgcccccacatttgtcctaggcctcagagtccctataaagagagattcccaagtcagtatcagcacaggacacagctrggttctgaagcttctgagttctgcagcctcacctctgagaaaacctcttttccaccaataccatgaagctctgcgtgactgtcctgtctctcctcatgct

SEQ ID NO: 68102 - DNA, 201 bp, Homo sapiens
cattctgctacagagcggaatgaaaaaccctggggagcaaattcctgagccagagaatggagcggaggaaccagccaaggaggataaagaggtgggaacargcaagaaaacctgggtgcgtgcacgcattgacatccacctgcatgtgagggcgggaggggacagaacagggacagcgaggaggagacactcaggtcacag

SEQ ID NO: 68103 - DNA, 201 bp, Homo sapiens
gtggaggtcgccgtccctcctgaggggcagccggtgcatttgggacccgggagcagagcccgcgcctccccagcggcctccccgggggtctcaccgggtcwcccgagagcggaggccccggctccgcagaaacccggggcggccgcggggaagcagcgccctcaggcgtcggaggagcccccagaaggacctcgcgcctcc

SEQ ID NO: 68104 - DNA, 201 bp, Homo sapiens
gcctcgggaggcgtccaggctgcgggagcgggaggagcggccgtgcgggcgccagcgccgtgggtggaggtcgccgtccctcctgaggggcagccggtgcrtttgggacccgggagcagagcccgcgcctccccagcggcctccccgggggtctcaccgggtctcccgagagcggaggccccggctccgcagaaacccggg

SEQ ID NO: 68105 - DNA, 201 bp, Homo sapiens
actcaccctcggtgtgctggagtcctcggcggtgctcctggctgggcgtgggggctttgctaccagtctgccctgggtcacgtctagaaacctcagctggrggcgcgggtcgtaaagtcctgacacttcctgttcctctcagctcctccttggaggaagtggtgggttgcaccaccgtggcccttcacccctgcccctctc

SEQ ID NO: 68106 - DNA, 201 bp, Homo sapiens
cagcccctgccaggaggccctgcttctccagcccagcccacgcccaccaggaaatgcccctatttactcccttgaggcaaaggcccttgggtggctaagcrtcccctctcccagcactcggagctgagcgtcccctctcccagcactcggagctgagcattcccctctcccagcactcggaggcacctgcagttgctcagc

SEQ ID NO: 68107 - DNA, 201 bp, Homo sapiens
caaacccgcaggcgttgcgccaccgtcacggggaaggcgagtgacagcgagtgtcccctatgcccccacagctcgctcccaggctgagctctccggccatmcccccccttccccattgcagccatgccacccctccttctccccacccaggaactgacagaggagaggggccccggatggacagggacagcagggcagaat

SEQ ID NO: 68108 - DNA, 201 bp, Homo sapiens
atgccagcccctgccaggaggccctgcttctccagcccagcccacgcccaccaggaaatgcccctatttactcccttgaggcaaaggcccttgggtggctragcgtcccctctcccagcactcggagctgagcgtcccctctcccagcactcggagctgagcattcccctctcccagcactcggaggcacctgcagttgct

SEQ ID NO: 68109 - DNA, 201 bp, Homo sapiens
actgcaggggcagggtgggggacatgcccagcggggctggtgaatatgccaccgcaggggcggggagggcagaatatgcccagtgaggctggtgaatgcgscaggggcagagggcggggagggggaagatgcccagcgaggctggtgaatgtggcactgcaggggtggggtgggcggatgcaatgatgagcatttcctccc

SEQ ID NO: 68110 - DNA, 201 bp, Homo sapiens
aataaattaattaattaattaaataaaggctggtggagggagtgaaggggaggggctagggaccgtggggcttcccagagccgtgaccttgctatggggggacccagacctccattccggggactcactcagcactcatcttactatcccccatctgatgtgcctgttgcacaaggctggaagtcagaggctgtgcacgtt

SEQ ID NO: 68111 - DNA, 201 bp, Homo sapiens
gtaggacttcagttttagggaataaaacaataaaggaaatagaagaataggtatctaagagtaaggaaacctcagcataaaagctaaggggaggccgggcrtggtggctcatgcctgtaatcccagcactttgggaggctgaggcaggcggatcacctgaggtcaggagtttgagaccagcctgagcaacatagtgaaacc

SEQ ID NO: 68112 - DNA, 201 bp, Homo sapiens
atatacaataaataaataaattaattaattaattaaataaaggctggtggagggagtgaaggggaggggctagggaccgtggggcttcccagagccgtgamcttgctatggggggacccagacctccattccggggactcactcagcactcatcttactatcccccatctgatgtgcctgttgcacaaggctggaagtcag

SEQ ID NO: 68113 - DNA, 201 bp, Homo sapiens
tgcagtgagccaagatcgtgccactgcactccagcctggacaacagagcgagactccgtctcaaaaaatatatatacaataaataaataaattaattaatwaattaaataaaggctggtggagggagtgaaggggaggggctagggaccgtggggcttcccagagccgtgaccttgctatggggggacccagacctccatt

SEQ ID NO: 68114 - DNA, 201 bp, Homo sapiens
taaggaaacctcagcataaaagctaaggggaggccgggcatggtggctcatgcctgtaatcccagcactttgggaggctgaggcaggcggatcacctgagrtcaggagtttgagaccagcctgagcaacatagtgaaaccccatctctactaaaaatacataaattagctgggcttggtggcgggcgcctgtaatcccagc

SEQ ID NO: 68115 - DNA, 201 bp, Homo sapiens
agcttgcagtgagccaagatcgtgccactgcactccagcctggacaacagagcgagactccgtctcaaaaaatatatatacaataaataaataaattaatwaattaattaaataaaggctggtggagggagtgaaggggaggggctagggaccgtggggcttcccagagccgtgaccttgctatggggggacccagacctc

SEQ ID NO: 68116 - DNA, 201 bp, Homo sapiens
catctctactaaaaatacataaattagctgggcttggtggcgggcgcctgtaatcccagctactcgcgaggctgaggcaggagaatcacttgagcccgggwggcagagggtgcagtgagctgagatctcacctctgcactccagcctgggcaacaagagtgaaactgtctcaaaagaaaaaaaaaaaaaaagctaaggggg

SEQ ID NO: 68117 - DNA, 201 bp, Homo sapiens
tgcttcccagggccctccagccaagcagccacaggaaagagtagatgttgatcccaagctaggactgaggagtccgtccctaagagccgagggagtcaggygggcgaaactggccgcatgtctgggtacaactgctcagggtttctcatctgctgaatcaccaagctaggttctgaagccaggcgtgagtgagcaggactg

SEQ ID NO: 68118 - DNA, 201 bp, Homo sapiens
cagcttccacccccataacacacaaccccagagcttgggaaggaggtctctctgtgacaggtgggattctggaagtttccacggaggagaccccataggascagggtttgaaggtcaagaaagatgctaaggatggagagggccagtggggagagggtggttccaggctcacttcacagaggtgcttggggagctgcaata

SEQ ID NO: 68119 - DNA, 201 bp, Homo sapiens
gtgacaggtgggattctggaagtttccacggaggagaccccataggagcagggtttgaaggtcaagaaagatgctaaggatggagagggccagtggggagrgggtggttccaggctcacttcacagaggtgcttggggagctgcaatattttggcagcaccaagggaagagtcaggtcagtgaggttcataagggatgaga

SEQ ID NO: 68120 - DNA, 201 bp, Homo sapiens
tcagtgaggttcataagggatgagaaaggagtctaaccagccctggagacccctggggtctggccccacagggagatgtccaagtggcagaaagtcccttyctgcctggagagcacccccacgaggaccctggggccacccgggaaccgctgctccctcccagtcactcaccacacttccctctcccgcccaccctccaac

SEQ ID NO: 68121 - DNA, 201 bp, Homo sapiens
ggatgagaaaggagtctaaccagccctggagacccctggggtctggccccacagggagatgtccaagtggcagaaagtcccttcctgcctggagagcaccyccacgaggaccctggggccacccgggaaccgctgctccctcccagtcactcaccacacttccctctcccgcccaccctccaacctgcctgcaaattcccc

SEQ ID NO: 68122 - DNA, 201 bp, Homo sapiens
tgtgggcagccttcctcaccctggatgcctgtgacttggtttccatgggggcttcctaagctcagggaccccaagcctccatcaaatctaatgacccgccytgtctctgaacacacctgtgttgtccccgagcccctcaccaaccccctctgcaacccggcccacgcatttcccatcctgaagggtccagctcataggccg

SEQ ID NO: 68123 - DNA, 201 bp, Homo sapiens
ccacttgctgtcaaagcatgccactcttctttctgatacttgacatatttcttttcccgttcaattcatggtttctgcccaaacggagccacgtgaggacktctttggggatgtgtctccaagaaaagtgtgggctgccttcctcaccctggatgcctgtgggcagccttcctcaccctggatgcctgtgggcagccttcc

SEQ ID NO: 68124 - DNA, 201 bp, Homo sapiens
gagttgctgtatttttactaagggatggagagacacagcccccaacccccagggagctgggctggctctcctatggctcagcccatagctccagccccagrgatgtccagaggatcagaaaactccctccctcctttaaagcagctactggcagagtccgtggagctcttgggggctgggagacaggcaggaaacccacct

SEQ ID NO: 68125 - DNA, 201 bp, Homo sapiens
tttcaggagtttcaggtggagacaaaggccaggcccaggtgaaaatgtggcagtgacagagtatggggtgagaaccacggagagaggaagtccccgaggcrgatgatgggacagagagcggggaccagaattttttaaaacgcatctgagatgcgtttggcagactcatagttgttttcctttcacggagaaagtgtgggc

SEQ ID NO: 68126 - DNA, 201 bp, Homo sapiens
agtttcaaaatgactcctcctctgaggggactcaggctccccaccctgctccccagttcccaccagaaaccccaagtgggtgttccagcctctgccccacmaggcccccatggaaggcagcaccgccaggcagggacctttcctcgctgcccctccctcttccagttctgagtcctgtcccggagatgacctctcaaccca

SEQ ID NO: 68127 - DNA, 201 bp, Homo sapiens
ccagggaaagctgatccgccccgacccagggccccccgggtgcccctttgagcgtggaatcgttgccaggtcatggctccctgctatcgaacaccggacaygggtcgtgtgctgcacctggcagttgcaggaccgacacccgcaatgccttaagaggtgatgactgccttccaggggcctggctggctgacactttgcatg

SEQ ID NO: 68128 - DNA, 201 bp, Homo sapiens
cctacagcaagacgtcacccaggggtccccacggaggaggcagggaagctcgagggtcccagaggagcatggagcatgtgccacaccacaccacactacaytacacatgtgcaccatacatgtacatacaacagactccccacatcacatgcgcacactcgcacaccatacatgcacacacacacaccacactacgctatg

SEQ ID NO: 68129 - DNA, 201 bp, Homo sapiens
tgcaaggggtggtgccaggggtggaggatgcatggggagggctggccccaagagtgcagtgttgggggaagggggccaggtgggcctgggacccaggggcrtggcttcaatccccctcccaccaggaccttgggaatggcctccaggagcctgttgtggggaggccagggtcaccagctgaaccaactcgaccagaatcgc

SEQ ID NO: 68130 - DNA, 201 bp, Homo sapiens
gatgcctgtgggcagccttcctcaccctggatgcctgtgggcagccttcctcaccctggatgcctgtgggctgccttcctcaccctggatgcctgtgggcwgccttcctcaccctggatgcctgtgggctgccttcctcaccctggatgcctgtgggcagccttcctcaccctggatgcctgtgggcagccttcctcaccc

SEQ ID NO: 68131 - DNA, 201 bp, Homo sapiens
aagaacacagaggccatgggagtgaaaagtttgatgctggaaagcaacagtagcacattctgctacagagcggaatgaaaaaccctggggagcaaattccygagccagagaatggagcggaggaaccagccaaggaggataaagaggtgggaacaggcaagaaaacctgggtgcgtgcacgcattgacatccacctgcatg

SEQ ID NO: 68132 - DNA, 201 bp, Homo sapiens
cagcagagcaggggtgaggctgagtgggtatattactccgatttgggtgggaccccatgcagtcacacgtgggggacgcagggctgacagccttgcatgamcctttcacactttagccatagcaatgccaagcccagagaggctgcaaggccctggggagaacagaggccccggaaggggtggccagctgggcttcactgc

SEQ ID NO: 68133 - DNA, 201 bp, Homo sapiens
gggtgttccagcctctgccccacaaggcccccatggaaggcagcaccgccaggcagggacctttcctcgctgcccctccctcttccagttctgagtcctgkcccggagatgacctctcaacccagagggacctgaccagaaaggtctggccccctccacccaggaagcccctgaaggctggagggcagccctcccccctcc

SEQ ID NO: 68134 - DNA, 201 bp, Homo sapiens
acccagccgctcactgggacatctcggtgcagggaaagggctgaagctggcgcagccacggcagcatcccctctcgtggcagtgctcctgaaacagagacrtggtctgggcagcatgctgaaaggcatttctgaatgaagcctcctactgacctagagccagcacacaccactccaggggcagagaggagagagcaggagc

SEQ ID NO: 68135 - DNA, 201 bp, Homo sapiens
tccctaagagccgagggagtcaggtgggcgaaactggccgcatgtctgggtacaactgctcagggtttctcatctgctgaatcaccaagctaggttctgargccaggcgtgagtgagcaggactggagcaggattctgggaacaatcttttccctccagtcagcccagaaattccatttgcagtcactttcacttatgtat

SEQ ID NO: 68136 - DNA, 201 bp, Homo sapiens
ttttttttctttttcacttcttccccccagtgacttccttctgcagtgttgattcagctccctttgaaggcgggtgagaccttttgcaggctgggggcagrggcgggggcggagaagagggctgcaggcagggctggcagaggggaggaggtgacacacactccctggaggcgagtggggagggctcggggcaggaaatgg

SEQ ID NO: 68137 - DNA, 201 bp, Homo sapiens
gcggagcttgcagtgagccaagatcgtgccactgcactccagcctggacaacagagcgagactccgtctcaaaaaatatatatacaataaataaataaatwaattaattaattaaataaaggctggtggagggagtgaaggggaggggctagggaccgtggggcttcccagagccgtgaccttgctatggggggacccaga

SEQ ID NO: 68138 - DNA, 201 bp, Homo sapiens
gcaccgagacacccaggcagggcgtcacctgcaaggtcagctgcaaggctgggactggggtttgtaatcgctgttgtctcttggcctgcaggatcctcacrcgtgccgcttcggtcctgatgggcaggacgcaggtctctcactagaccagtgtttccctctgtgaggcctggagaggagccttctggccactcctgggta

SEQ ID NO: 68139 - DNA, 201 bp, Homo sapiens
ctgtcagaaagaaagaaaggaagaaggaagggagggagggagggaaggaaggaaggaaggaaggaaggaaggaaggaaggaaggaaggaaggaaggaaggraaaagaaaagaaaaaataaaaactgaactcacatgagaaccacagcccacaagaggcaggtctggacttgtggtctaaccctaaccagactgactgctag

SEQ ID NO: 68140 - DNA, 201 bp, Homo sapiens
ctatggtgagccaagatcacaccactgcactccagcctgggtgacagagtaagatcctgtcagaaagaaagaaaggaagaaggaagggagggagggagggaaggaaggaaggaaggaaggaaggaaggaaggaaggaaggaaggaaggaaggaaggaaaaagaaaagaaaaaataaaaactgaactcacatgagaaccaca

SEQ ID NO: 68141 - DNA, 201 bp, Homo sapiens
gctatggtgagccaagatcacaccactgcactccagcctgggtgacagagtaagatcctgtcagaaagaaagaaaggaagaaggaagggagggagggagggaaggaaggaaggaaggaaggaaggaaggaaggaaggaaggaaggaaggaaggaaggaaaaagaaaagaaaaaataaaaactgaactcacatgagaaccac

SEQ ID NO: 68142 - DNA, 201 bp, Homo sapiens
ggctatggtgagccaagatcacaccactgcactccagcctgggtgacagagtaagatcctgtcagaaagaaagaaaggaagaaggaagggagggagggagggaaggaaggaaggaaggaaggaaggaaggaaggaaggaaggaaggaaggaaggaaggaaaaagaaaagaaaaaataaaaactgaactcacatgagaacca

SEQ ID NO: 68143 - DNA, 201 bp, Homo sapiens
aggctatggtgagccaagatcacaccactgcactccagcctgggtgacagagtaagatcctgtcagaaagaaagaaaggaagaaggaagggagggagggarggaaggaaggaaggaaggaaggaaggaaggaaggaaggaaggaaggaaggaaggaaggaaaaagaaaagaaaaaataaaaactgaactcacatgagaacc

SEQ ID NO: 68144 - DNA, 201 bp, Homo sapiens
taagatttggtaagatgagaggtagctgtttggggattggtactagtgctctccatgctgttctgtattcttaaaatagtttatatcttttttttttttttaaaggagctaggaggaagtgactgcaaatgagcagaaggatctttcagggggtggaaatgctctgaaattagattgtggtgatgattgcacaattccgta

SEQ ID NO: 68145 - DNA, 201 bp, Homo sapiens
gtgctggagtcctcggcggtgctcctggctgggcgtgggggctttgctaccagtctgccctgggtcacgtctagaaacctcagctggaggcgcgggtcgtraagtcctgacacttcctgttcctctcagctcctccttggaggaagtggtgggttgcaccaccgtggcccttcacccctgcccctctccgctctacagcag

SEQ ID NO: 68146 - DNA, 201 bp, Homo sapiens
cattgagtgctgggagtggaaactcatacgctgagcggcagtgacgctgcggagctgacaaaccccacagcccgcccggtcacctgcttcaccgagggccrcagcccccccggggtcaggtggccacaggggtcctggccatgtgggacatccgttctgtggccctgctcaggatggcacccggcggggactggccctggg

SEQ ID NO: 68147 - DNA, 201 bp, Homo sapiens
gcccctttgagcgtggaatcgttgccaggtcatggctccctgctatcgaacaccggacatgggtcgtgtgctgcacctggcagttgcaggaccgacacccrcaatgccttaagaggtgatgactgccttccaggggcctggctggctgacactttgcatggctcctggagaagagggattgagtggagtccacgggtcatg

SEQ ID NO: 68148 - DNA, 201 bp, Homo sapiens
ccagttcagcctctaaccggtggtcttcatgcctaggaacccactgggggcttatgaaactgcaggtggctgagtccttgccatggggtctctccttcagsaggtctgggtggggccggagactgtaccccacaaaaggtcccaggtgaggcggatgtggcctggcgctgtgtggctctggacctagtccttgggcttggg

SEQ ID NO: 68149 - DNA, 201 bp, Homo sapiens
gaacccactgggggcttatgaaactgcaggtggctgagtccttgccatggggtctctccttcagcaggtctgggtggggccggagactgtaccccacaaarggtcccaggtgaggcggatgtggcctggcgctgtgtggctctggacctagtccttgggcttgggctggcgcccagggcctgggcttgagacagctgtgac

SEQ ID NO: 68150 - DNA, 201 bp, Homo sapiens
cctcatccccagggaggtgagggggctctgtgagcagaggggccccggtggagaaggcgctgctagccaggggcggggcaggagcccaggtggggacttargggtggctgaagggaccctcaggctgcagggatagggagggaagctaggggtgtggcttgggcaggtgctgggggaccgcgggcgccctttattctgaag

SEQ ID NO: 68151 - DNA, 201 bp, Homo sapiens
tgggtggggccggagactgtaccccacaaaaggtcccaggtgaggcggatgtggcctggcgctgtgtggctctggacctagtccttgggcttgggctggcrcccagggcctgggcttgagacagctgtgacgcaggcaagccatttaccccgtttgtggggacattacatcttcctagcttggaacacacaggcagccagg

SEQ ID NO: 68152 - DNA, 201 bp, Homo sapiens
aaacgatcatttttaaccccagacgtccctgaaccaaagccaaagtctacaggtcactggggcagaggccgcccgaaaccagctgtcccctcccggcctakgcgcgccaggtccccgcccagccggggcgatcctttggtcggacagtgaggttgggagcccaccgcacccaagtgccgccgcatccacccggcgcaggcg

SEQ ID NO: 68153 - DNA, 201 bp, Homo sapiens
tagccaggggcggggcaggagcccaggtggggacttaggggtggctgaagggaccctcaggctgcagggatagggagggaagctaggggtgtggcttgggsaggtgctgggggaccgcgggcgccctttattctgaagccgaatgtgctgccggagtccccagtgacctagaaatccatttcaagattttcaggagtttca

SEQ ID NO: 68154 - DNA, 201 bp, Homo sapiens
cccagagggatctgaccaggaaggttcaccccccctccacccaggaagcccctgcagacagtatgtgttttaggctttgctggccaaatggtctctgccgygactactcagctctgccattgtggctgcagagtgaccatagaccttctgaaagtgaatgagtatgactgtgttccaataaaactttattgacaaaaacag

SEQ ID NO: 68155 - DNA, 201 bp, Homo sapiens
ccagcatgtctgcaggggcctctcctagccccctctctgcattctgaggcttcacttgttgaacagaaagaggtagcagaatcccaaataagagtgcaacrtgtcacctaccagctccagcgcctgggggccaagtgtggactcagagcttctgtccagcagaggcccctgatgtgcagctgcaccgagacacccaggcag

SEQ ID NO: 68156 - DNA, 201 bp, Homo sapiens
ctgcaccgagacacccaggcagggcgtcacctgcaaggtcagctgcaaggctgggactggggtttgtaatcgctgttgtctcttggcctgcaggatcctcrcgcgtgccgcttcggtcctgatgggcaggacgcaggtctctcactagaccagtgtttccctctgtgaggcctggagaggagccttctggccactcctggg

SEQ ID NO: 68157 - DNA, 201 bp, Homo sapiens
agctgacaaaccccacagcccgcccggtcacctgcttcaccgagggccacagcccccccggggtcaggtggccacaggggtcctggccatgtgggacatcygttctgtggccctgctcaggatggcacccggcggggactggccctggggccgaggcatgggctcagccgccgccctgcagggacgtagccagggacctct

SEQ ID NO: 68158 - DNA, 201 bp, Homo sapiens
gggacccgggagcagagcccgcgcctccccagcggcctccccgggggtctcaccgggtctcccgagagcggaggccccggctccgcagaaacccggggcgsccgcggggaagcagcgccctcaggcgtcggaggagcccccagaaggacctcgcgcctccccgccgggctccgaccgcctgggttcggtgcgggacggccc

SEQ ID NO: 68159 - DNA, 201 bp, Homo sapiens
gggcaggacgcaggtctctcactagaccagtgtttccctctgtgaggcctggagaggagccttctggccactcctgggtacaacacgaagggagaagcagrcctgagttttttatttttacttatttttttttttttgagacagagtctcgctccatcgcccaggctggagtgcagtggtgcgatctcggctcactgcaag

SEQ ID NO: 68160 - DNA, 201 bp, Homo sapiens
ctagcggaggctgggcggcgggcttcgcgcctgcctcagtctcccaatccgtggcccgggggatggagcccgctgcgcgcagaggctgcggcaggtcccakccaggtgccctggaacgtggctcctccttccctgaggcgctcccctgggcacgaggatgggtctcgaagcaggaggaagccgccttccctcacccgctgt

SEQ ID NO: 68161 - DNA, 201 bp, Homo sapiens
ataaggaaaaggaacggaaagctgaaaggacccccgggctctggaacccgacccaagggtgatgccgccagggctaccaggaagcggctccgtgctgggckcagccggtctcctacccaccccagcacacctcagcccccagcctcttcctcccgcgcctcccccgccctcaccacttcctctcaatggtccctggggatt

SEQ ID NO: 68162 - DNA, 201 bp, Homo sapiens
cacagatccgtaacactgagattcttctgaaaagcaaaatgtagaaggaggcattgaagaataacatgcacctcgtccctgcagacccacacacccctagrgcaggacagtggttacccctgaagacagagaaggctacgggcctgggagatggaagcagagggcttcaaagttctattgtagagttttctttactaaaaa

SEQ ID NO: 68163 - DNA, 201 bp, Homo sapiens
gctagagaacctaaacactgacgctggaccctggtcaacactaggtctctccacagcctcctcttttagcctctccctccagtttcaaaatgactcctccyctgaggggactcaggctccccaccctgctccccagttcccaccagaaaccccaagtgggtgttccagcctctgccccacaaggcccccatggaaggcagc

SEQ ID NO: 68164 - DNA, 201 bp, Homo sapiens
agctagagaacctaaacactgacgctggaccctggtcaacactaggtctctccacagcctcctcttttagcctctccctccagtttcaaaatgactcctcytctgaggggactcaggctccccaccctgctccccagttcccaccagaaaccccaagtgggtgttccagcctctgccccacaaggcccccatggaaggcag

SEQ ID NO: 68165 - DNA, 201 bp, Homo sapiens
ctgccgcgactactcagctctgccattgtggctgcagagtgaccatagaccttctgaaagtgaatgagtatgactgtgttccaataaaactttattgacaraaacaggtggagggccagcctaagggcccaagtttgtaggtctctattctagaccagtgattctctggagaggaatggggcatggggagtggggacagtg

SEQ ID NO: 68166 - DNA, 201 bp, Homo sapiens
tgaggacttctttggggatgtgtctccaagaaaagtgtgggctgccttcctcaccctggatgcctgtgggcagccttcctcaccctggatgcctgtgggcwgccttcctcaccctggatgcctgtgggctgccttcctcaccctggatgcctgtgggcagccttcctcaccctggatgcctgtgggctgccttcctcaccc

SEQ ID NO: 68167 - DNA, 201 bp, Homo sapiens
cacacttgggagaggggcccggcctccaggagcgccaggcagaaagggcacccattaggaagaagaacacagaggccatgggagtgaaaagtttgatgctrgaaagcaacagtagcacattctgctacagagcggaatgaaaaaccctggggagcaaattcctgagccagagaatggagcggaggaaccagccaaggagga

SEQ ID NO: 68168 - DNA, 201 bp, Homo sapiens
tctgctcttggtggcaggcacttccccttgccgggtctcaaaggggaccctggagcagacggtctggagaccccttcctgccagacacccctgggccgggrctataagcagggccaccagggtcactccaggctggggcaggagagtgcttccctccaaaaatcaccgtggacatagcggggcctctgcacactcaccctc

SEQ ID NO: 68169 - DNA, 201 bp, Homo sapiens
cgggtgcccctttgagcgtggaatcgttgccaggtcatggctccctgctatcgaacaccggacatgggtcgtgtgctgcacctggcagttgcaggaccgayacccgcaatgccttaagaggtgatgactgccttccaggggcctggctggctgacactttgcatggctcctggagaagagggattgagtggagtccacggg

SEQ ID NO: 68170 - DNA, 201 bp, Homo sapiens
tccgaccgcctgggttcggtgcgggacggcccaggccgccaggacccccaagcgcagctcagtctgcggggcacgacccagaggccagcagcagaggacgrggccggggccgggagagggcggggagggcgctcctgggaggtcaaggccagggctaggctttcagggtcatggcctggcccctcatccccagggaggtga

SEQ ID NO: 68171 - DNA, 201 bp, Homo sapiens
cgatttgggtgggaccccatgcagtcacacgtgggggacgcagggctgacagccttgcatgaccctttcacactttagccatagcaatgccaagcccagaraggctgcaaggccctggggagaacagaggccccggaaggggtggccagctgggcttcactgcagtcctcaccagacaggattgagattttaacgtgttaa

SEQ ID NO: 68172 - DNA, 201 bp, Homo sapiens
gatgcctgtgggcagccttcctcaccctggatgcctgtgggctgccttcctcaccctggatgcctgtgggcagccttcctcaccctggatgcctgtgggcwgccttcctcaccctggatgcctgtgggcagccttcctcaccctggatgcctgtgggcagccttcctcaccctggatgcctgtgacttggtttccatgggg

SEQ ID NO: 68173 - DNA, 201 bp, Homo sapiens
gaaaagtgtgggctgccttcctcaccctggatgcctgtgggcagccttcctcaccctggatgcctgtgggcagccttcctcaccctggatgcctgtgggcwgccttcctcaccctggatgcctgtgggcagccttcctcaccctggatgcctgtgggctgccttcctcaccctggatgcctgtgggcagccttcctcaccc

SEQ ID NO: 68174 - DNA, 201 bp, Homo sapiens
aggatggcatgaaagaaaaaaaacagcactcctgaaaagtggacccaaatatagcctagatcacatacatccatggtgccacactcacgctacggggtaaygaataagagcccttgaagtgctgctctgaagcctcgtgacccacagatccgtaacactgagattcttctgaaaagcaaaatgtagaaggaggcattgaag

SEQ ID NO: 68175 - DNA, 201 bp, Homo sapiens
cagcaccgccaggcagggacctttcctcgctgcccctccctcttccagttctgagtcctgtcccggagatgacctctcaacccagagggacctgaccagamaggtctggccccctccacccaggaagcccctgaaggctggagggcagccctcccccctccctccccctgttagtttttctttctgatagaaacagcagca

SEQ ID NO: 68176 - DNA, 201 bp, Homo sapiens
ttcacggacacaattgaatgaaattagatgctgtccaaaggatggcatgaaagaaaaaaaacagcactcctgaaaagtggacccaaatatagcctagatcrcatacatccatggtgccacactcacgctacggggtaatgaataagagcccttgaagtgctgctctgaagcctcgtgacccacagatccgtaacactgaga

SEQ ID NO: 68177 - DNA, 201 bp, Homo sapiens
tgagaaggaaactcttactcaaaaacaaaaacaacaacaaacaaacaagaaaaaatcaaatagaaatgcaaatttggcaggtagagaatttgaggaacgtraccattcgtctccaacttaaacacaattatgttacaaagtgggacaatgataaacacataattactagaccacaagggaaataaccacatattctaaagc

SEQ ID NO: 68178 - DNA, 201 bp, Homo sapiens
tgctcttggtggcaggcacttccccttgccgggtctcaaaggggaccctggagcagacggtctggagaccccttcctgccagacacccctgggccggggcyataagcagggccaccagggtcactccaggctggggcaggagagtgcttccctccaaaaatcaccgtggacatagcggggcctctgcacactcaccctcgg

SEQ ID NO: 68179 - DNA, 201 bp, Homo sapiens
accccccagccgtccccctaggggcttgtgggcccagcctcttcctggccttgccggcctcacagccccttgtcctcccatgccggccccatcctcagccrcaagcgctcccagcacaccatgtggctctgctcttggtggcaggcacttccccttgccgggtctcaaaggggaccctggagcagacggtctggagacccc

SEQ ID NO: 68180 - DNA, 201 bp, Homo sapiens
ctacttgggaggctgaggtgggagaattgcttgagcccaagaggttgaggctacggtgaaccatgcttacaccactgcactccagtctgggtaactgagaraaaaaaaaaaaaaaaaaggcaaatcctttaaaagaaaaaagtaagggaaaatagaacaaacaagaaaggtaaataaaaaccaaacaataaaacattggga

SEQ ID NO: 68181 - DNA, 201 bp, Homo sapiens
aagcctccagaatccggcctcagcccccaaacccgcaggcgttgcgccaccgtcacggggaaggcgagtgacagcgagtgtcccctatgcccccacagctygctcccaggctgagctctccggccatccccccccttccccattgcagccatgccacccctccttctccccacccaggaactgacagaggagaggggcccc

SEQ ID NO: 68182 - DNA, 201 bp, Homo sapiens
gtttgtttgtttttttgagatggagtctcactctgtcatccaggctggagtgcaatggctagatctcggctcactgcaacctccgcctcccatgttcaagmaattcttctgcctcagcctcctgagtagctgggactataggtgcacaccactaggcccagctaatttttgtatttttagtagagatggagtttcaccata

SEQ ID NO: 68183 - DNA, 201 bp, Homo sapiens
tagccatgcattaattttataatcagaaaagcatgttattataactcaagttaaatggctccaaaacaaaagtacccagaccccagagcctgcccctctcyagctggagagagggacgaagtataaggaaaaggaacggaaagctgaaaggacccccgggctctggaacccgacccaagggtgatgccgccagggctacca

SEQ ID NO: 68184 - DNA, 201 bp, Homo sapiens
tggagtctggaggccactcttggtaaagtgctggcccccggggattctgcagtgagctgggcatggattctgcagtgagctgggcttcactcatggtgaarcgctggggtgacggcagacagcccagagcttctagcagctcatttctgtgaagcctccagaatccggcctcagcccccaaacccgcaggcgttgcgccac

SEQ ID NO: 68185 - DNA, 201 bp, Homo sapiens
ccccactcatccccagaatactgaggggcacgctgggtgccaggctggcagggaccctggggattctgctgtgagctggatggggaaggagttccttcctraaatgtggagtctggaggccactcttggtaaagtgctggcccccggggattctgcagtgagctgggcatggattctgcagtgagctgggcttcactcatg

SEQ ID NO: 68186 - DNA, 201 bp, Homo sapiens
gatgcctgtgggctgccttcctcaccctggatgcctgtgggcagccttcctcaccctggatgcctgtgggctgccttcctcaccctggatgcctgtgggcwgccttcctcaccctggatgcctgtgggcagccttcctcaccctggatgcctgtgacttggtttccatgggggcttcctaagctcagggaccccaagcctc

SEQ ID NO: 68187 - DNA, 201 bp, Homo sapiens
gggccagcctaagggcccaagtttgtaggtctctattctagaccagtgattctctggagaggaatggggcatggggagtggggacagtgtgtgggagaagrggtgggacacaggcacgtgggaatggtgcggacatggaggacattggaggtggggaagagctagagaacctaaacactgacgctggaccctggtcaacac

SEQ ID NO: 68188 - DNA, 201 bp, Homo sapiens
gcagcttggcttcgtggtaaaagtgaatttatggggaaaaaaagagagacacagttccaaaatattctgcatttctctgggtggtggcactatgagtattytcaattttcattattcctgtttgtattttccaccctttttgtgataaatgaataaaggacattttaaaaatggaatttcatggtggccgacgaattatgc

SEQ ID NO: 68189 - DNA, 201 bp, Homo sapiens
cactgggagcacagttcctccctcctctgccttcctctgcgtggtgtggctcctccttgagggagagagctgaggaggtggcattcttgcttccctgactsacccaaaggaagatttcacagcccctggcaagggctgccagacaggctcacctgtcaccccctgtccagggacagactgaccggtagccttggctgggtg

SEQ ID NO: 68190 - DNA, 201 bp, Homo sapiens
gactcacccaaaggaagatttcacagcccctggcaagggctgccagacaggctcacctgtcaccccctgtccagggacagactgaccggtagccttggctrggtggggagttatgctgggaagtcttccaggccccctgggggtgggaagatgctcaatgttcaaaggagatggaacgaggaaaacagttaagcaacgatg

SEQ ID NO: 68191 - DNA, 201 bp, Homo sapiens
gagaaatacaagagcagatgatacaaagttgggcaaagaaataagtaaaaattatgatgtcataacctgttgatttaaaaaatagtggtaagaatattaaygctgtgaaacaaaacgcctagaggactgggttgggaggggccagggagcacattgccgttccatcctatctggggaggaatatagatgcttgtcagtggg

SEQ ID NO: 68192 - DNA, 201 bp, Homo sapiens
gaccctggtcaacactaggtctctccacagcctcctcttttagcctctccctccagtttcaaaatgactcctcctctgaggggactcaggctccccacccwgctccccagttcccaccagaaaccccaagtgggtgttccagcctctgccccacaaggcccccatggaaggcagcaccgccaggcagggacctttcctcgc

SEQ ID NO: 68193 - DNA, 201 bp, Homo sapiens
cgccaggcagggacctttcctcgctgcccctccctcttccagttctgagtcctgtcccggagatgacctctcaacccagagggacctgaccagaaaggtcyggccccctccacccaggaagcccctgaaggctggagggcagccctcccccctccctccccctgttagtttttctttctgatagaaacagcagcaaccgct

SEQ ID NO: 68194 - DNA, 201 bp, Homo sapiens
ggagggttgatctttgatcttcctctgatggcccaacgggaactgtgagcacccagccgctcactgggacatctcggtgcagggaaagggctgaagctggygcagccacggcagcatcccctctcgtggcagtgctcctgaaacagagacgtggtctgggcagcatgctgaaaggcatttctgaatgaagcctcctactga

SEQ ID NO: 68195 - DNA, 201 bp, Homo sapiens
ttcatggtttctgcccaaacggagccacgtgaggacttctttggggatgtgtctccaagaaaagtgtgggctgccttcctcaccctggatgcctgtgggcwgccttcctcaccctggatgcctgtgggcagccttcctcaccctggatgcctgtgggctgccttcctcaccctggatgcctgtgggcagccttcctcaccc

SEQ ID NO: 68196 - DNA, 201 bp, Homo sapiens
gggacaaaaacaggtcagatcaaataggaacaagtcggagcagagaggatgcaggaaaacccagcccatgtcgcctctgaacctgcgaccctgcaaaagcrtattttcccaagggtcagggagacgtgttcctactgttggtttgactatctgtgaagtttgatagcacagttttgtttgtttgtttgtttttttgagatg

SEQ ID NO: 68197 - DNA, 201 bp, Homo sapiens
atggcagtgggacctccctgctggcatgggcttgttgccactgtcactcacccattcacccatccatgggacaggggcttgccagcctctcctctaggcayggcgcaggggctgagagctgcactccaggactcctggactctgccctctgctgagactctcagcacctcttttccccaacacctaccccaagtttccatc

SEQ ID NO: 68198 - DNA, 201 bp, Homo sapiens
aataaataaataaattaattaattaattaaataaaggctggtggagggagtgaaggggaggggctagggaccgtggggcttcccagagccgtgaccttgcwatggggggacccagacctccattccggggactcactcagcactcatcttactatcccccatctgatgtgcctgttgcacaaggctggaagtcagaggctg

SEQ ID NO: 68199 - DNA, 201 bp, Homo sapiens
cagggaaagctgatccgccccgacccagggccccccgggtgcccctttgagcgtggaatcgttgccaggtcatggctccctgctatcgaacaccggacatrggtcgtgtgctgcacctggcagttgcaggaccgacacccgcaatgccttaagaggtgatgactgccttccaggggcctggctggctgacactttgcatgg

SEQ ID NO: 68200 - DNA, 201 bp, Homo sapiens
ggggcccggcctgggccagagtggacagacctgggcctggcaggagccctggggaagtgagttcaagttacacggttgactatagagacagctggagtgcrcacaattggccagaccacccctcctgtttcacagatggggaaactgagtcacgggggaccaaatagcctgctcaccccatgccccttccagacagggtgc

SEQ ID NO: 68201 - DNA, 201 bp, Homo sapiens
acttccttcatgggcacctcgctgtctgggggcctcttccccagggagtctcctggtggtggccgtgttgcctcaggctcactgtgcactaggcaggtcaygtcgatgccgcctgaggggcaggggttaccaccctgtggttcaggtgagaagctccaggctcaggagtgtccagctgcctgggcagtgtttggatctcat

SEQ ID NO: 68202 - DNA, 201 bp, Homo sapiens
gacctcgtgatccgcctgcctcggcctcccaaagtgctgggattacaggcgtgagccactgcgcccggcctgatagcacaaattttaaaggccacaatttstggccaaatgaaataaaatgagacaccccacccccccgacacacacatattaataaggaatgctaaagtactctgctaaatacctgaagtcaaagggaaa

SEQ ID NO: 68203 - DNA, 201 bp, Homo sapiens
tgcacaccactaggcccagctaatttttgtatttttagtagagatggagtttcaccatattggccaggctggtctcgaactcctgacctcgtgatccgccygcctcggcctcccaaagtgctgggattacaggcgtgagccactgcgcccggcctgatagcacaaattttaaaggccacaatttgtggccaaatgaaataa

SEQ ID NO: 68204 - DNA, 201 bp, Homo sapiens
gctgggaactgaaggctcaagggatgattataaactaggcatccaccttttaagccaaaagccagagcatcaagatggactcatttctgctttgtaggaaygtgataaagaactggagagaagtgccgtcaggtggggactggaacactgtccttggatcacagaggctccaggaaatccagggacaaaaacaggtcagat

SEQ ID NO: 68205 - DNA, 201 bp, Homo sapiens
cccgcagacccattggaactttgcatcagagcttcctcctgcctgtgctgaaacccaccttgcgctgtcctagaggagaggcactcgcatcaaagtgactyggaggtgcgcgggaagtgatggacgatgccgccaggggacaaggttggaaggaagaggacatgggagccaacccctgcgctgggaactgaaggctcaagg

SEQ ID NO: 68206 - DNA, 201 bp, Homo sapiens
ctaagacgagactgcttgaggaaccagaggccccgcagacccattggaactttgcatcagagcttcctcctgcctgtgctgaaacccaccttgcgctgtcytagaggagaggcactcgcatcaaagtgactcggaggtgcgcgggaagtgatggacgatgccgccaggggacaaggttggaaggaagaggacatgggagcc

SEQ ID NO: 68207 - DNA, 201 bp, Homo sapiens
gcccacctcggcctcccaaagtgctgggattacaggcgtgagccaccgtgcccagtctcaggcttcctttttgcaaccccgtaaaaccctaagacgagacygcttgaggaaccagaggccccgcagacccattggaactttgcatcagagcttcctcctgcctgtgctgaaacccaccttgcgctgtcctagaggagaggc

SEQ ID NO: 68208 - DNA, 201 bp, Homo sapiens
tgcaccaaggttttgtgactattgacccttgactttgagttgggagttgctgtatttttactaagggatggagagacacagcccccaacccccagggagcwgggctggctctcctatggctcagcccatagctccagccccagggatgtccagaggatcagaaaactccctccctcctttaaagcagctactggcagagtc

SEQ ID NO: 68209 - DNA, 201 bp, Homo sapiens
taagagggattttccaactcgaaggatgacagatgggaatcacatgactctggggctccagagaattgtgggggcagggaatttattattgcagttcccawgatgaagtatctatgatgacagagaagggctttgggtatggggcaggaaggagaccaaggcggaggagacgcacagagggacaagcctgagggacgctgg

SEQ ID NO: 68210 - DNA, 201 bp, Homo sapiens
tttgtagcctaggagcaataggctaaactacatggcctaggtgtgcagtaggctatgacatctaggtttgtgtaagtacactctatgatgttcatacaacratgaaaccatctaacgacacatttctcagaacacatccctgtcattaaagtacaaaccctcattatatcatgtctgactattccaaacgcctcttcaata

SEQ ID NO: 68211 - DNA, 201 bp, Homo sapiens
atgtagttggtctaagagggattttccaactcgaaggatgacagatgggaatcacatgactctggggctccagagaattgtgggggcagggaatttattaytgcagttcccatgatgaagtatctatgatgacagagaagggctttgggtatggggcaggaaggagaccaaggcggaggagacgcacagagggacaagcct

SEQ ID NO: 68212 - DNA, 201 bp, Homo sapiens
tgcttcagggccctctggggactttgcttcctcaagggctgccaggactatggctggaggggaccctgcggctgggagggctgtgggggctgctaaagctragagggctgctgggatttgtggggacactgctgctcccgctctgtctggccacccccctgactgtctccctgagagccctggtcgcgggggcctcacgtg

SEQ ID NO: 68213 - DNA, 201 bp, Homo sapiens; identical to SEQ ID NO: 21382

SEQ ID NO: 68214 - DNA, 201 bp, Homo sapiens
ctcacctgctctgtccttcttaggggagctgaactcacggctgagctcggataccaccctgatgagtaactggcttcctttaaatgccaatgtgctcttgsgaagcctggtgaaagtggtggggctgtatggcttcatgctcagcatatcgcctcgactcaccctcctttctctgctgcacatgcccttcacaatagcagc

SEQ ID NO: 68215 - DNA, 201 bp, Homo sapiens
ggcttgctccttctctgcatctccctcccctcttattctcctaccccacagctcactgtctgcaggctgccgaggaggctgcttcacctacaccatgtctygaatcaacttgcggatccgggagcagcttttctcctccctgctgcgccaggacctcggtttcttccaggagactaagacaggtggggcctggagtccagg

SEQ ID NO: 68216 - DNA, 201 bp, Homo sapiens
atgggaatcacatgactctggggctccagagaattgtgggggcagggaatttattattgcagttcccatgatgaagtatctatgatgacagagaagggctytgggtatggggcaggaaggagaccaaggcggaggagacgcacagagggacaagcctgagggacgctgggacagaagcaagcactgggatacttgttttca

SEQ ID NO: 68217 - DNA, 201 bp, Homo sapiens; identical to SEQ ID NO: 21385

SEQ ID NO: 68218 - DNA, 201 bp, Homo sapiens; identical to SEQ ID NO: 21386

SEQ ID NO: 68219 - DNA, 201 bp, Homo sapiens; identical to SEQ ID NO: 21388

SEQ ID NO: 68220 - DNA, 201 bp, Homo sapiens
tctcctctttcttcttcctctgtgtattccttacctcttctctctctgtgtgtctgtctctcatttctttctcttttgcccctcctggcatgctttccccygactttgcgcttctctgcactcctggcttgctcctctgtttcacccgctggcttgctccttctctgcatctccctcccctcttattctcctaccccacag

SEQ ID NO: 68221 - DNA, 201 bp, Homo sapiens
acggagcggacctcagcgctgaagcagaagtccccggagctgcggtctccccgccgcggctggtgagttggtgcggaggggaacctggagcgccaacaggracgcagcccaagtgactacccactccacgctcctgcttcccagtccctctgcacccggcgataggagggagcggagcccggaccacttagctcgccgcgg

SEQ ID NO: 68222 - DNA, 201 bp, Homo sapiens; identical to SEQ ID NO: 21394

SEQ ID NO: 68223 - DNA, 201 bp, Homo sapiens; identical to SEQ ID NO: 21400

SEQ ID NO: 68224 - DNA, 201 bp, Homo sapiens; identical to SEQ ID NO: 21401

SEQ ID NO: 68225 - DNA, 201 bp, Homo sapiens
ttccttcgttcatattcatccaatatcttcaaagtttatctgatcttattataggaacaagttatgagtgaaggtagtacaaaaggaatttaagtctcagrtggaatgtctctcagttgtctctcaacattcctaggtccatgaaattccatttctttctgcctcctacctcctacccctaagtctgtctccaaagtatct

SEQ ID NO: 68226 - DNA, 201 bp, Homo sapiens; identical to SEQ ID NO: 21402

SEQ ID NO: 68227 - DNA, 201 bp, Homo sapiens; identical to SEQ ID NO: 21403

SEQ ID NO: 68228 - DNA, 201 bp, Homo sapiens
catgatgaagtatctatgatgacagagaagggctttgggtatggggcaggaaggagaccaaggcggaggagacgcacagagggacaagcctgagggacgcygggacagaagcaagcactgggatacttgttttcacaatatcttttcccttctattgtagtcttctattgtgtctagtacagagtgcactccataaatact

SEQ ID NO: 68229 - DNA, 201 bp, Homo sapiens
aggggaccctgcggctgggagggctgtgggggctgctaaagctaagagggctgctgggatttgtggggacactgctgctcccgctctgtctggccaccccmctgactgtctccctgagagccctggtcgcgggggcctcacgtgctcccccagccagagtcgcttcagccccttggagctggctgctggtggggtacgggg

SEQ ID NO: 68230 - DNA, 201 bp, Homo sapiens; identical to SEQ ID NO: 21411

SEQ ID NO: 68231 - DNA, 201 bp, Homo sapiens; identical to SEQ ID NO: 21412

SEQ ID NO: 68232 - DNA, 201 bp, Homo sapiens; identical to SEQ ID NO: 21413

SEQ ID NO: 68233 - DNA, 201 bp, Homo sapiens
caggcctgtacagtgcgaaccagagttcgggctccagttccgctgtctgcgggtctcgcgcgccccctcccggcggcccagcccagaatgaaggccttggytggggaagcgaaagcgaaagctgcccgagccctgacgcccgccctggccgagcgtagctggcggaccagagccggtagcgaggttgggagagacggagcg

SEQ ID NO: 68234 - DNA, 201 bp, Homo sapiens
ctatgatgttcatacaacgatgaaaccatctaacgacacatttctcagaacacatccctgtcattaaagtacaaaccctcattatatcatgtctgactatyccaaacgcctcttcaatatggtaactaaatttgtattagaaacatatattttgtaaaatacatgcttttatgctttatattttttcctctaagtgttact

SEQ ID NO: 68235 - DNA, 201 bp, Homo sapiens
tacagtgcgaaccagagttcgggctccagttccgctgtctgcgggtctcgcgcgccccctcccggcggcccagcccagaatgaaggccttggctggggaarcgaaagcgaaagctgcccgagccctgacgcccgccctggccgagcgtagctggcggaccagagccggtagcgaggttgggagagacggagcggacctcag

SEQ ID NO: 68236 - DNA, 201 bp, Homo sapiens; identical to SEQ ID NO: 21414

SEQ ID NO: 68237 - DNA, 201 bp, Homo sapiens; identical to SEQ ID NO: 21418

SEQ ID NO: 68238 - DNA, 201 bp, Homo sapiens; identical to SEQ ID NO: 21421

SEQ ID NO: 68239 - DNA, 201 bp, Homo sapiens; identical to SEQ ID NO: 21420

SEQ ID NO: 68240 - DNA, 201 bp, Homo sapiens; identical to SEQ ID NO: 2415

SEQ ID NO: 68241 - DNA, 201 bp, Homo sapiens; identical to SEQ ID NO: 21424

SEQ ID NO: 68242 - DNA, 201 bp, Homo sapiens; identical to SEQ ID NO: 21425

SEQ ID NO: 68243 - DNA, 201 bp, Homo sapiens; identical to SEQ ID NO: 21426

SEQ ID NO: 68244 - DNA, 201 bp, Homo sapiens; identical to SEQ ID NO: 21427

SEQ ID NO: 68245 - DNA, 201 bp, Homo sapiens; identical to SEQ ID NO: 21428

SEQ ID NO: 68246 - DNA, 201 bp, Homo sapiens; identical to SEQ ID NO: 21432

SEQ ID NO: 68247 - DNA, 201 bp, Homo sapiens; identical to SEQ ID NO: 21433

SEQ ID NO: 68248 - DNA, 201 bp, Homo sapiens; identical to SEQ ID NO: 21435

SEQ ID NO: 68249 - DNA, 201 bp, Homo sapiens; identical to SEQ ID NO: 21437

SEQ ID NO: 68250 - DNA, 201 bp, Homo sapiens; identical to SEQ ID NO: 21439

SEQ ID NO: 68251 - DNA, 201 bp, Homo sapiens; identical to SEQ ID NO: 21438

SEQ ID NO: 68252 - DNA, 201 bp, Homo sapiens; identical to SEQ ID NO: 21443

SEQ ID NO: 68253 - DNA, 201 bp, Homo sapiens; identical to SEQ ID NO: 21442

SEQ ID NO: 68254 - DNA, 201 bp, Homo sapiens; identical to SEQ ID NO: 21444

SEQ ID NO: 68255 - DNA, 201 bp, Homo sapiens; identical to SEQ ID NO: 21445

SEQ ID NO: 68256 - DNA, 201 bp, Homo sapiens; identical to SEQ ID NO: 21446

SEQ ID NO: 68257 - DNA, 201 bp, Homo sapiens
atggacgggttaggcggagccgggcgggtaggagggcagggacaaggattgggactccacccccatgatttctcatctcgtatccgttgacagagccatgyggctccctgacctgagaccctggacctccctgctgctggtggacgcggctttactgtggctgcttcagggccctctggggactttgcttcctcaagggct

SEQ ID NO: 68258 - DNA, 201 bp, Homo sapiens
gttgtctctcaacattcctaggtccatgaaattccatttctttctgcctcctacctcctacccctaagtctgtctccaaagtatctctccagggtcactcyctcaggatgggtatgcttctccctctcactcttctttcccagctcatcttgctaatccctgaagatcttactctgaggcttatcacctttctttccagaa

SEQ ID NO: 68259 - DNA, 201 bp, Homo sapiens
ttccttgtccttgctgttttgggtgagtcaggagaggacgttgtgagttggaggtggtaaaagggcctgggcaccagcacattcttgtgttatttttcatkcctctttcaggtgagacattaatccctcactattctggtcgtgtgattgacatcctgggaggtgattttgacccccatgcctttgccagtgccatcttct

SEQ ID NO: 68260 - DNA, 201 bp, Homo sapiens; identical to SEQ ID NO: 21449

SEQ ID NO: 68261 - DNA, 201 bp, Homo sapiens; identical to SEQ ID NO: 21450

SEQ ID NO: 68262 - DNA, 201 bp, Homo sapiens; identical to SEQ ID NO: 21451

SEQ ID NO: 68263 - DNA, 201 bp, Homo sapiens
atggtcatacttaatttagagtaccctcgaaaaccatttcattgtgccttcattccatcctggctgctttctgctgaaactacagtcgtgcactgcataaygatgtttaggtcaatgatgggccacatataagatggtggacccacaagattataataccatatttttactgtaccttttctatgtttagatacacaaata

SEQ ID NO: 68264 - DNA, 201 bp, Homo sapiens; identical to SEQ ID NO: 21452

SEQ ID NO: 68265 - DNA, 201 bp, Homo sapiens
caataggctaaactacatggcctaggtgtgcagtaggctatgacatctaggtttgtgtaagtacactctatgatgttcatacaacgatgaaaccatctaaygacacatttctcagaacacatccctgtcattaaagtacaaaccctcattatatcatgtctgactattccaaacgcctcttcaatatggtaactaaatttg

SEQ ID NO: 68266 - DNA, 201 bp, Homo sapiens
ctctatgatgttcatacaacgatgaaaccatctaacgacacatttctcagaacacatccctgtcattaaagtacaaaccctcattatatcatgtctgactmttccaaacgcctcttcaatatggtaactaaatttgtattagaaacatatattttgtaaaatacatgcttttatgctttatattttttcctctaagtgtta

SEQ ID NO: 68267 - DNA, 201 bp, Homo sapiens; identical to SEQ ID NO: 2417

SEQ ID NO: 68268 - DNA, 201 bp, Homo sapiens
ttgtctctatttttatggtcatacttaatttagagtaccctcgaaaaccatttcattgtgccttcattccatcctggctgctttctgctgaaactacagtygtgcactgcataacgatgtttaggtcaatgatgggccacatataagatggtggacccacaagattataataccatatttttactgtaccttttctatgtt

SEQ ID NO: 68269 - DNA, 201 bp, Homo sapiens
gtcatacttaatttagagtaccctcgaaaaccatttcattgtgccttcattccatcctggctgctttctgctgaaactacagtcgtgcactgcataacgawgtttaggtcaatgatgggccacatataagatggtggacccacaagattataataccatatttttactgtaccttttctatgtttagatacacaaatactt

SEQ ID NO: 68270 - DNA, 201 bp, Homo sapiens; identical to SEQ ID NO: 21455

SEQ ID NO: 68271 - DNA, 201 bp, Homo sapiens
ccacaagattataataccatatttttactgtaccttttctatgtttagatacacaaatacttacttctgtgttacagtcgcccacagtgttaggtgcagtyatatgttgtacagatttgtagcctaggagcaataggctaaactacatggcctaggtgtgcagtaggctatgacatctaggtttgtgtaagtacactctat

SEQ ID NO: 68272 - DNA, 201 bp, Homo sapiens; identical to SEQ ID NO: 21456

SEQ ID NO: 68273 - DNA, 201 bp, Homo sapiens
tattttgtaaaatacatgcttttatgctttatattttttcctctaagtgttactgtagcatgtagttggtctaagagggattttccaactcgaaggatgamagatgggaatcacatgactctggggctccagagaattgtgggggcagggaatttattattgcagttcccatgatgaagtatctatgatgacagagaaggg

SEQ ID NO: 68274 - DNA, 201 bp, Homo sapiens
ggcggaggagacgcacagagggacaagcctgagggacgctgggacagaagcaagcactgggatacttgttttcacaatatcttttcccttctattgtagtyttctattgtgtctagtacagagtgcactccataaatacttgtaaatttgtacatgttatgattttgttctcacatctagctcaccatgtctcctctttct

SEQ ID NO: 68275 - DNA, 201 bp, Homo sapiens; identical to SEQ ID NO: 21458

SEQ ID NO: 68276 - DNA, 201 bp, Homo sapiens; identical to SEQ ID NO: 21460

SEQ ID NO: 68277 - DNA, 201 bp, Homo sapiens; identical to SEQ ID NO: 21463

SEQ ID NO: 68278 - DNA, 201 bp, Homo sapiens
ggacctgcctctcctcgttgccgccttcttcttccttgtccttgctgttttgggtgagtcaggagaggacgttgtgagttggaggtggtaaaagggcctgsgcaccagcacattcttgtgttatttttcatgcctctttcaggtgagacattaatccctcactattctggtcgtgtgattgacatcctgggaggtgatttt

SEQ ID NO: 68279 - DNA, 201 bp, Homo sapiens
gcccgagccctgacgcccgccctggccgagcgtagctggcggaccagagccggtagcgaggttgggagagacggagcggacctcagcgctgaagcagaagyccccggagctgcggtctccccgccgcggctggtgagttggtgcggaggggaacctggagcgccaacagggacgcagcccaagtgactacccactccacgc

SEQ ID NO: 68280 - DNA, 201 bp, Homo sapiens; identical to SEQ ID NO: 21464

SEQ ID NO: 68281 - DNA, 201 bp, Homo sapiens
catgcttccagctccccagaaggccgaaagctgtctgtcgtaggaggggtgtacggatgagcaccggttactcaggagagctctcagggttgaataggatraaatgagaagccgatggacgggttaggcggagccgggcgggtaggagggcagggacaaggattgggactccacccccatgatttctcatctcgtatccgt

SEQ ID NO: 68282 - DNA, 201 bp, Homo sapiens; identical to SEQ ID NO: 21466

SEQ ID NO: 68283 - DNA, 201 bp, Homo sapiens; identical to SEQ ID NO: 21465

SEQ ID NO: 68284 - DNA, 201 bp, Homo sapiens
attctggtcgtgtgattgacatcctgggaggtgattttgacccccatgcctttgccagtgccatcttcttcatgtgcctcttctcctttggcaggtaggtrgtgggcagctgggtccatttgctagccccaaatctttataggggtcttcacttccctaactccatttctaggccctttcaggcgcaaaacacaaaaatac

SEQ ID NO: 68285 - DNA, 201 bp, Homo sapiens; identical to SEQ ID NO: 21467

SEQ ID NO: 68286 - DNA, 201 bp, Homo sapiens; identical to SEQ ID NO: 21468

SEQ ID NO: 68287 - DNA, 201 bp, Homo sapiens
ttctggtcgtgtgattgacatcctgggaggtgattttgacccccatgcctttgccagtgccatcttcttcatgtgcctcttctcctttggcaggtaggtgrtgggcagctgggtccatttgctagccccaaatctttataggggtcttcacttccctaactccatttctaggccctttcaggcgcaaaacacaaaaatact

SEQ ID NO: 68288 - DNA, 201 bp, Homo sapiens; identical to SEQ ID NO: 21470

SEQ ID NO: 68289 - DNA, 201 bp, Homo sapiens
atgaaattccatttctttctgcctcctacctcctacccctaagtctgtctccaaagtatctctccagggtcactctctcaggatgggtatgcttctccctytcactcttctttcccagctcatcttgctaatccctgaagatcttactctgaggcttatcacctttctttccagaatcattactcttttcccttcacttgc

SEQ ID NO: 68290 - DNA, 201 bp, Homo sapiens; identical to SEQ ID NO: 21471

SEQ ID NO: 68291 - DNA, 201 bp, Homo sapiens
gaccaaggcggaggagacgcacagagggacaagcctgagggacgctgggacagaagcaagcactgggatacttgttttcacaatatcttttcccttctatygtagtcttctattgtgtctagtacagagtgcactccataaatacttgtaaatttgtacatgttatgattttgttctcacatctagctcaccatgtctcct

SEQ ID NO: 68292 - DNA, 201 bp, Homo sapiens
atcacatgactctggggctccagagaattgtgggggcagggaatttattattgcagttcccatgatgaagtatctatgatgacagagaagggctttgggtrtggggcaggaaggagaccaaggcggaggagacgcacagagggacaagcctgagggacgctgggacagaagcaagcactgggatacttgttttcacaatat

SEQ ID NO: 68293 - DNA, 201 bp, Homo sapiens; identical to SEQ ID NO: 2423

SEQ ID NO: 68294 - DNA, 201 bp, Homo sapiens; identical to SEQ ID NO: 21476

SEQ ID NO: 68295 - DNA, 201 bp, Homo sapiens; identical to SEQ ID NO: 21478

SEQ ID NO: 68296 - DNA, 201 bp, Homo sapiens
tcccatgatgaagtatctatgatgacagagaagggctttgggtatggggcaggaaggagaccaaggcggaggagacgcacagagggacaagcctgagggaygctgggacagaagcaagcactgggatacttgttttcacaatatcttttcccttctattgtagtcttctattgtgtctagtacagagtgcactccataaat

SEQ ID NO: 68297 - DNA, 201 bp, Homo sapiens
ccacgccctggctaatttttgtatttttagtagagacagggtttcaccatgttggccaggctggtctcgaacccctgacctcaggcgatccgcccgcctcrgcctcccaaagtgctgtgattacaggcgtgagccaccgcgccggaccagaaagaaggcacttcttaatagtaggctcagagcttgaagtagtaactttga

SEQ ID NO: 68298 - DNA, 201 bp, Homo sapiens
gccggacctgcctctcctcgttgccgccttcttcttccttgtccttgctgttttgggtgagtcaggagaggacgttgtgagttggaggtggtaaaagggcmtgggcaccagcacattcttgtgttatttttcatgcctctttcaggtgagacattaatccctcactattctggtcgtgtgattgacatcctgggaggtgat

SEQ ID NO: 68299 - DNA, 201 bp, Homo sapiens; identical to SEQ ID NO: 21480

SEQ ID NO: 68300 - DNA, 201 bp, Homo sapiens
gcccctcctggcatgctttcccctgactttgcgcttctctgcactcctggcttgctcctctgtttcacccgctggcttgctccttctctgcatctccctcycctcttattctcctaccccacagctcactgtctgcaggctgccgaggaggctgcttcacctacaccatgtctcgaatcaacttgcggatccgggagcagc

SEQ ID NO: 68301 - DNA, 201 bp, Homo sapiens
ttgcccctcctggcatgctttcccctgactttgcgcttctctgcactcctggcttgctcctctgtttcacccgctggcttgctccttctctgcatctcccycccctcttattctcctaccccacagctcactgtctgcaggctgccgaggaggctgcttcacctacaccatgtctcgaatcaacttgcggatccgggagca

SEQ ID NO: 68302 - DNA, 201 bp, Homo sapiens; identical to SEQ ID NO: 2375

SEQ ID NO: 68303 - DNA, 201 bp, Homo sapiens
cttaatagtaggctcagagcttgaagtagtaactttgagaaaattcagtgattctccaattacaaagcattctccaattacaaagcaaggacaacagatamagttgcccttgagacaactgtattttacttaatgataaagaaacatttttgcagttttatatcccagagtaaccgccactaaaggcgagtgagactcatt

SEQ ID NO: 68304 - DNA, 201 bp, Homo sapiens; identical to SEQ ID NO: 21484

SEQ ID NO: 68305 - DNA, 201 bp, Homo sapiens; identical to SEQ ID NO: 21485

SEQ ID NO: 68306 - DNA, 201 bp, Homo sapiens; identical to SEQ ID NO: 21486

SEQ ID NO: 68307 - DNA, 201 bp, Homo sapiens; identical to SEQ ID NO: 2419

SEQ ID NO: 68308 - DNA, 201 bp, Homo sapiens
agaagggctttgggtatggggcaggaaggagaccaaggcggaggagacgcacagagggacaagcctgagggacgctgggacagaagcaagcactgggatayttgttttcacaatatcttttcccttctattgtagtcttctattgtgtctagtacagagtgcactccataaatacttgtaaatttgtacatgttatgattt

SEQ ID NO: 68309 - DNA, 201 bp, Homo sapiens; identical to SEQ ID NO: 2374

SEQ ID NO: 68310 - DNA, 201 bp, Homo sapiens; identical to SEQ ID NO: 21490

SEQ ID NO: 68311 - DNA, 201 bp, Homo sapiens; identical to SEQ ID NO: 21491

SEQ ID NO: 68312 - DNA, 201 bp, Homo sapiens; identical to SEQ ID NO: 21492

SEQ ID NO: 68313 - DNA, 201 bp, Homo sapiens
caactcgaaggatgacagatgggaatcacatgactctggggctccagagaattgtgggggcagggaatttattattgcagttcccatgatgaagtatctaygatgacagagaagggctttgggtatggggcaggaaggagaccaaggcggaggagacgcacagagggacaagcctgagggacgctgggacagaagcaagca

SEQ ID NO: 68314 - DNA, 201 bp, Homo sapiens; identical to SEQ ID NO: 21493

SEQ ID NO: 68315 - DNA, 201 bp, Homo sapiens
cctcctacccctaagtctgtctccaaagtatctctccagggtcactctctcaggatgggtatgcttctccctctcactcttctttcccagctcatcttgcyaatccctgaagatcttactctgaggcttatcacctttctttccagaatcattactcttttcccttcacttgctttcctttctctttctagacatactcaa

SEQ ID NO: 68316 - DNA, 201 bp, Homo sapiens; identical to SEQ ID NO: 21494

SEQ ID NO: 68317 - DNA, 201 bp, Homo sapiens; identical to SEQ ID NO: 21495

SEQ ID NO: 68318 - DNA, 201 bp, Homo sapiens
tcctacccctaagtctgtctccaaagtatctctccagggtcactctctcaggatgggtatgcttctccctctcactcttctttcccagctcatcttgctartccctgaagatcttactctgaggcttatcacctttctttccagaatcattactcttttcccttcacttgctttcctttctctttctagacatactcaaac

SEQ ID NO: 68319 - DNA, 201 bp, Homo sapiens; identical to SEQ ID NO: 21497

SEQ ID NO: 68320 - DNA, 201 bp, Homo sapiens
ttcccagctcatcttgctaatccctgaagatcttactctgaggcttatcacctttctttccagaatcattactcttttcccttcacttgctttcctttctytttctagacatactcaaacaaacaaactgtttgataaggctgggactgggatgaggtgagcgaggcacctggggtgcaaagtttaaggaggtgtgcactc

SEQ ID NO: 68321 - DNA, 201 bp, Homo sapiens
gggcctggagtccaggtctgagattcccatggacatcccttgcccctcagtgaccttccacccacagcctctcctcctgccttcacccgtatgccaggacytggggatgcttttctcttgtttgggacagggtggagaagcagcctccactgtccctctgcaagtgaaggaggatgttcagaggagggggctgtgtcagag

SEQ ID NO: 68322 - DNA, 201 bp, Homo sapiens; identical to SEQ ID NO: 2373

SEQ ID NO: 68323 - DNA, 201 bp, Homo sapiens
atgtaagggaaccccaaagggagaataaaactgacaggtgaggaggcttccacatttgtggctagaggatcccctagagagagatgttctcttctcagccrttaggggagaaggtatattgtagtatatactacattttgtttgtccagccatccaacaatggatatttgacttcagaagattcatgattctccagaactg

SEQ ID NO: 68324 - DNA, 201 bp, Homo sapiens
ccaaagggagaataaaactgacaggtgaggaggcttccacatttgtggctagaggatcccctagagagagatgttctcttctcagccattaggggagaagrtatattgtagtatatactacattttgtttgtccagccatccaacaatggatatttgacttcagaagattcatgattctccagaactgtaaacaaaaatgt

SEQ ID NO: 68325 - DNA, 201 bp, Homo sapiens
catgtctcgaatcaacttgcggatccgggagcagcttttctcctccctgctgcgccaggacctcggtttcttccaggagactaagacaggtggggcctggwgtccaggtctgagattcccatggacatcccttgcccctcagtgaccttccacccacagcctctcctcctgccttcacccgtatgccaggacctggggatg

SEQ ID NO: 68326 - DNA, 201 bp, Homo sapiens
cccggctaaagccctgctgtggtgggagaagtgcagagattaagggtcaaggagttgttcgtcctccatccccgactactgctttctgaacctcgacaccrtgtcggaggtcggaggtgggggagggaatggatcgtaagtcacccatatagtctgcttcatttgcagcccagagaggcagggattcgaggatggagggct

SEQ ID NO: 68327 - DNA, 201 bp, Homo sapiens; identical to SEQ ID NO: 22120

SEQ ID NO: 68328 - DNA, 201 bp, Homo sapiens; identical to SEQ ID NO: 22121

SEQ ID NO: 68329 - DNA, 201 bp, Homo sapiens; identical to SEQ ID NO: 22122

SEQ ID NO: 68330 - DNA, 201 bp, Homo sapiens; identical to SEQ ID NO: 22123

SEQ ID NO: 68331 - DNA, 201 bp, Homo sapiens; identical to SEQ ID NO: 22124

SEQ ID NO: 68332 - DNA, 201 bp, Homo sapiens; identical to SEQ ID NO: 22125

SEQ ID NO: 68333 - DNA, 201 bp, Homo sapiens; identical to SEQ ID NO: 22126

SEQ ID NO: 68334 - DNA, 201 bp, Homo sapiens; identical to SEQ ID NO: 22127

SEQ ID NO: 68335 - DNA, 201 bp, Homo sapiens; identical to SEQ ID NO: 22128
  misc_feature (1)...(201): n = A,T,C or G, or insertion/deletion polymorphism (see Tables 1-2)

SEQ ID NO: 68336 - DNA, 201 bp, Homo sapiens; identical to SEQ ID NO: 22130

SEQ ID NO: 68337 - DNA, 201 bp, Homo sapiens; identical to SEQ ID NO: 22131

SEQ ID NO: 68338 - DNA, 201 bp, Homo sapiens; identical to SEQ ID NO: 22133

SEQ ID NO: 68339 - DNA, 201 bp, Homo sapiens; identical to SEQ ID NO: 22136

SEQ ID NO: 68340 - DNA, 201 bp, Homo sapiens; identical to SEQ ID NO: 22135

SEQ ID NO: 68341 - DNA, 201 bp, Homo sapiens; identical to SEQ ID NO: 22137

SEQ ID NO: 68342 - DNA, 201 bp, Homo sapiens; identical to SEQ ID NO: 22138

SEQ ID NO: 68343 - DNA, 201 bp, Homo sapiens; identical to SEQ ID NO: 22139

SEQ ID NO: 68344 - DNA, 201 bp, Homo sapiens; identical to SEQ ID NO: 22140

SEQ ID NO: 68345 - DNA, 201 bp, Homo sapiens; identical to SEQ ID NO: 22142

SEQ ID NO: 68346 - DNA, 201 bp, Homo sapiens; identical to SEQ ID NO: 22143

SEQ ID NO: 68347 - DNA, 201 bp, Homo sapiens; identical to SEQ ID NO: 22144

SEQ ID NO: 68348 - DNA, 201 bp, Homo sapiens; identical to SEQ ID NO: 22145

SEQ ID NO: 68349 - DNA, 201 bp, Homo sapiens; identical to SEQ ID NO: 22146

SEQ ID NO: 68350 - DNA, 201 bp, Homo sapiens
gccggaccagcacttcccgccctccagggatcttcccagccctctgtgaagtgctagatgcttctccactggtctgcgggctggacccaggcctgcagttkgccatacttgcgcccctgctgtttgggaaggatctgtgctgtaagcctcgcggccatactacgactgtcagatctccatccctatgggctataggatggg

SEQ ID NO: 68351 - DNA, 201 bp, Homo sapiens; identical to SEQ ID NO: 2903

SEQ ID NO: 68352 - DNA, 201 bp, Homo sapiens; identical to SEQ ID NO: 22148

SEQ ID NO: 68353 - DNA, 201 bp, Homo sapiens
cgcccactaccaaagctgccctgtcacatgttagctgtctccactcccacagcgccagagttccccagttcccatcctatgagtctcccaggctggtggcstaagccaagatatcatttgagtactggaagaataggcaaattggactgaggtttggtctttgttacaggtggtttggaaaatgctggtatatccatgacc

SEQ ID NO: 68354 - DNA, 201 bp, Homo sapiens; identical to SEQ ID NO: 22149

SEQ ID NO: 68355 - DNA, 201 bp, Homo sapiens; identical to SEQ ID NO: 22150

SEQ ID NO: 68356 - DNA, 201 bp, Homo sapiens
cggtctcggcctttctgccctcgaggggggcggacccggctaaagccctgctgtggtgggagaagtgcagagattaagggtcaaggagttgttcgtcctcyatccccgactactgctttctgaacctcgacaccatgtcggaggtcggaggtgggggagggaatggatcgtaagtcacccatatagtctgcttcatttgca

SEQ ID NO: 68357 - DNA, 201 bp, Homo sapiens
ttttgtgtatttggcataaaaggagaaagagggacttaggccctgagcagtacaagaaaagcagctaagaataaaaggaataacagtgatgtcccttaagyatgttcccccagaatctgtctccaggaaggagcttctaatggaacaagaagcattgactggtagtaatctcacaggattttccttgtattgcagctgggt

SEQ ID NO: 68358 - DNA, 201 bp, Homo sapiens
tttgtgtatttggcataaaaggagaaagagggacttaggccctgagcagtacaagaaaagcagctaagaataaaaggaataacagtgatgtcccttaagcmtgttcccccagaatctgtctccaggaaggagcttctaatggaacaagaagcattgactggtagtaatctcacaggattttccttgtattgcagctgggtc

SEQ ID NO: 68359 - DNA, 201 bp, Homo sapiens; identical to SEQ ID NO: 22151

SEQ ID NO: 68360 - DNA, 201 bp, Homo sapiens
aagtaggctgggcgtggtggctcacgcctctaatcccagcactttgggaggccaaggtgggcggatcacgaggtcaggagatcgagaccatcctggctaayatggtgaaaccccatctctactaaaaaaaaaaaaaatacaaaaaattagccgggcatggtggcgggcacctgtagttccagctacttgagaggctgaggc

SEQ ID NO: 68361 - DNA, 201 bp, Homo sapiens; identical to SEQ ID NO: 22152

SEQ ID NO: 68362 - DNA, 201 bp, Homo sapiens; identical to SEQ ID NO: 22153

SEQ ID NO: 68363 - DNA, 201 bp, Homo sapiens; identical to SEQ ID NO: 22155

SEQ ID NO: 68364 - DNA, 201 bp, Homo sapiens; identical to SEQ ID NO: 22156

SEQ ID NO: 68365 - DNA, 201 bp, Homo sapiens; identical to SEQ ID NO: 22157

SEQ ID NO: 68366 - DNA, 201 bp, Homo sapiens; identical to SEQ ID NO: 3104

SEQ ID NO: 68367 - DNA, 201 bp, Homo sapiens; identical to SEQ ID NO: 3105

SEQ ID NO: 68368 - DNA, 201 bp, Homo sapiens; identical to SEQ ID NO: 3107

SEQ ID NO: 68369 - DNA, 201 bp, Homo sapiens; identical to SEQ ID NO: 22160

SEQ ID NO: 68370 - DNA, 201 bp, Homo sapiens; identical to SEQ ID NO: 22162

SEQ ID NO: 68371 - DNA, 201 bp, Homo sapiens; identical to SEQ ID NO: 22163

SEQ ID NO: 68372 - DNA, 201 bp, Homo sapiens; identical to SEQ ID NO: 22164

SEQ ID NO: 68373 - DNA, 201 bp, Homo sapiens; identical to SEQ ID NO: 22165

SEQ ID NO: 68374 - DNA, 201 bp, Homo sapiens; identical to SEQ ID NO: 22166

SEQ ID NO: 68375 - DNA, 201 bp, Homo sapiens
ggagagcatcaggaagaatagctaatggatgcttggcttgatgtctgggtgatgggatgatctatgtgtaaatcaccatggcacgtttacctatgtaacamacctatacatcctgcatgtgtacctctgaacttaaaagatgtaaggaaaaaaaaaaaaaggaagaactttggaggcagagattttcccagggtctgctgg

SEQ ID NO: 68376 - DNA, 201 bp, Homo sapiens; identical to SEQ ID NO: 22167

SEQ ID NO: 68377 - DNA, 201 bp, Homo sapiens; identical to SEQ ID NO: 22168

SEQ ID NO: 68378 - DNA, 201 bp, Homo sapiens; identical to SEQ ID NO: 22170

SEQ ID NO: 68379 - DNA, 201 bp, Homo sapiens; identical to SEQ ID NO: 22171

SEQ ID NO: 68380 - DNA, 201 bp, Homo sapiens; identical to SEQ ID NO: 22172

SEQ ID NO: 68381 - DNA, 201 bp, Homo sapiens; identical to SEQ ID NO: 22173

SEQ ID NO: 68382 - DNA, 201 bp, Homo sapiens; identical to SEQ ID NO: 22174

SEQ ID NO: 68383 - DNA, 201 bp, Homo sapiens; identical to SEQ ID NO: 22175

SEQ ID NO: 68384 - DNA, 201 bp, Homo sapiens; identical to SEQ ID NO: 3069

SEQ ID NO: 68385 - DNA, 201 bp, Homo sapiens
caagaaaacaaagatcttattcaaaagaggtcttacagcaacccaacgtctcatcttcccatagtaaagatgacggcgccttgaggtaagctacaggcaayaccacttccgcgtttctcttgcgccctggtccaagatggcggatgaagccacgcgacgtgttgtgtctgagatcccggtgctgaagactaacgccggacc

SEQ ID NO: 68386 - DNA, 201 bp, Homo sapiens; identical to SEQ ID NO: 22177

SEQ ID NO: 68387 - DNA, 201 bp, Homo sapiens; identical to SEQ ID NO: 22178

SEQ ID NO: 68388 - DNA, 201 bp, Homo sapiens; identical to SEQ ID NO: 22179

SEQ ID NO: 68389 - DNA, 201 bp, Homo sapiens
tgggctataggatggggcgacggcaccctatacctcagggacttgctttggagtcatggattaaagacctctctgggcagcgttgagaaccagcgaccctraacttggctgcgtttccatggtgtcgatcgcggagccgtgggggcgggctcacgcaagcgccaagggaccggtgggaggagttcgggtgtggatgcgcag

SEQ ID NO: 68390 - DNA, 201 bp, Homo sapiens; identical to SEQ ID NO: 22181

SEQ ID NO: 68391 - DNA, 201 bp, Homo sapiens
gttgagaaccagcgaccctaaacttggctgcgtttccatggtgtcgatcgcggagccgtgggggcgggctcacgcaagcgccaagggaccggtgggaggakttcgggtgtggatgcgcaggcgctttgagagacggtgaagccggtggccggtggccgggcgggaccaacaaagatggcggcggcccctgcggcgggagcg

SEQ ID NO: 68392 - DNA, 201 bp, Homo sapiens; identical to SEQ ID NO: 22182

SEQ ID NO: 68393 - DNA, 201 bp, Homo sapiens; identical to SEQ ID NO: 22183

SEQ ID NO: 68394 - DNA, 201 bp, Homo sapiens; identical to SEQ ID NO: 22184

SEQ ID NO: 68395 - DNA, 201 bp, Homo sapiens; identical to SEQ ID NO: 22185

SEQ ID NO: 68396 - DNA, 201 bp, Homo sapiens; identical to SEQ ID NO: 22186

SEQ ID NO: 68397 - DNA, 201 bp, Homo sapiens; identical to SEQ ID NO: 22187

SEQ ID NO: 68398 - DNA, 201 bp, Homo sapiens; identical to SEQ ID NO: 22189

SEQ ID NO: 68399 - DNA, 201 bp, Homo sapiens; identical to SEQ ID NO: 22192

SEQ ID NO: 68400 - DNA, 201 bp, Homo sapiens; identical to SEQ ID NO: 22190

SEQ ID NO: 68401 - DNA, 201 bp, Homo sapiens; identical to SEQ ID NO: 22193

SEQ ID NO: 68402 - DNA, 201 bp, Homo sapiens; identical to SEQ ID NO: 22194

SEQ ID NO: 68403 - DNA, 201 bp, Homo sapiens; identical to SEQ ID NO: 22195

SEQ ID NO: 68404 - DNA, 201 bp, Homo sapiens; identical to SEQ ID NO: 22197

SEQ ID NO: 68405 - DNA, 201 bp, Homo sapiens; identical to SEQ ID NO: 22198

SEQ ID NO: 68406 - DNA, 201 bp, Homo sapiens; identical to SEQ ID NO: 22199

SEQ ID NO: 68407 - DNA, 201 bp, Homo sapiens; identical to SEQ ID NO: 22201

SEQ ID NO: 68408 - DNA, 201 bp, Homo sapiens; identical to SEQ ID NO: 22203

SEQ ID NO: 68409 - DNA, 201 bp, Homo sapiens; identical to SEQ ID NO: 22204

SEQ ID NO: 68410 - DNA, 201 bp, Homo sapiens
aaatacctaatgtaaatgacgagttgatgggtgcagcaaaccaacatggcacaagtatacctatgtatcaaacttgcacgttgtgcacatgtactctagawcttaaggtataataaaaataaataaataagtaaaaatgccttcagcagcctgaagttctaagagctttccaagtttgggaaggtgtccgggttttctgcg

SEQ ID NO: 68411 - DNA, 201 bp, Homo sapiens
gcttccccggacaccctccacctctagttgttactaagtagctgcagtaggcattgctggggaagaaacaaacacacaccaaacagtactgctacttagtktctaaggctgcacagggaagggaaagactgggctttggacaatctagaggtaatttatatccgcccccaggtggagcaacatgcgattctggaggcacgg

SEQ ID NO: 68412 - DNA, 201 bp, Homo sapiens
gacaccctccacctctagttgttactaagtagctgcagtaggcattgctggggaagaaacaaacacacaccaaacagtactgctacttagtttctaaggckgcacagggaagggaaagactgggctttggacaatctagaggtaatttatatccgcccccaggtggagcaacatgcgattctggaggcacgggggtaactg

SEQ ID NO: 68413 - DNA, 201 bp, Homo sapiens
aaaaaaaaaaaaaaaccggctgggtgtagtggctcacgcctgtaatcctagcactttgggaggccaaggcaggttgatcacctggggtcaggagttcgagwccagcctggccaacatggcaaaaccccgtctctactaaaaatacaaaaattatccgggcatggtggtgcacgcctgtaatcccagctactcaggagactg

SEQ ID NO: 68414 - DNA, 201 bp, Homo sapiens; identical to SEQ ID NO: 3111

SEQ ID NO: 68415 - DNA, 201 bp, Homo sapiens; identical to SEQ ID NO: 3113

SEQ ID NO: 68416 - DNA, 201 bp, Homo sapiens
ctgttctcagagggatgtgagggaactgaactctggtgccgtgctagggggtaggggcctctccctcactgctggactggagctgggctcctgtagacctsaggggtccctctctctagggtctcctgtagggcttatgactgtgaatccttgatgtcatgattttatgtgacgattcctaggagtccctgcccctagagt

SEQ ID NO: 68417 - DNA, 201 bp, Homo sapiens
atcatgccattgcactccagcctgggtgacagagtgagtctctgactctaaaaaagaagatggttagatacagaaggagacagaaagtgaaggctgggcgyggtggctcaagcctgtaatcccaccactttgggaggccgaggtgggcagatcacctgaggttagcagtttgagaccaccctgaccaacatggagaaaccc

SEQ ID NO: 68418 - DNA, 201 bp, Homo sapiens
tgtaatcccagctactgaggaaggctgaggcagaggtcgcggtgagccgagatagcgccattgcactccagcctgggcaacaggagggagactccctctcaaaaaaaaaaaaaaaaagtaaagaaaaaagaaattaagaaaagaatgaacacgtgtttattttacctaactcatgaagaaactagcagatgttataattaa

SEQ ID NO: 68419 - DNA, 201 bp, Homo sapiens
tgatggaaatgggaagagcattaaatgaagctccctctggcacaagtggagcactcaccttaggggggcagggggcccggctcaggtggtaactggcggcsaagccgctgatgcctccgcccagcacgaccacggtccggcccatgcggaaacctgggggaaagggggcgatatggacaggcagaccggggacaacctgcg

SEQ ID NO: 68420 - DNA, 201 bp, Homo sapiens
cttaagggtgagactaggactaaggagcgaaaaaataatctacactgactgatttccacagcccctatttggtagggaatgagggtgggatagggtttggrttgggggacattcccactgtgacggatggaaatgaaggccttcactcccaataatgagttttgggaattatgagggggtggggtatgaagagaagagggc

SEQ ID NO: 68421 - DNA, 201 bp, Homo sapiens
cttccccaaaatgtgcttcttcctaagttttgtttctcattaaatggcaccacccagtggtccaaattagaaatctgggtgtcctcttggagtccaattcyctaacttggcacatccagtcaatcttcaagtcctgtttgcctcctgaaagttcccaaagttactttcttccctccagtcccacgggtattacctattctg

SEQ ID NO: 68422 - DNA, 201 bp, Homo sapiens
cccaatggaagccccctccacaacctctcctagacatcccacaagcctctcaccaggagcaaggtccgggcccctagggctcccgctggcctaattccccraggtccaagctcaaagatagcaccattagggcctcgaacggagcgaatccagcctcccagacgctcactgctctccactaggaccacctggcgacaagag

SEQ ID NO: 68423 - DNA, 201 bp, Homo sapiens
agatctgacccaccaaacatacttcctcccctaaactctattccccaatggaagccccctccacaacctctcctagacatcccacaagcctctcaccaggrgcaaggtccgggcccctagggctcccgctggcctaattccccgaggtccaagctcaaagatagcaccattagggcctcgaacggagcgaatccagcctcc

SEQ ID NO: 68424 - DNA, 201 bp, Homo sapiens
agcctctccgtccctttatcatacctggacaggcagatgggctccttggtactgcagattcaccacagctacagacactgcagtgatggcactcagggcaygagccagaggggcagcctcagcagggagcagctcactgagcactagagatcaggcagaggcctgactcagaaggcattcccattacagttgtcagtcctc

SEQ ID NO: 68425 - DNA, 201 bp, Homo sapiens
caagtggagcactcaccttaggggggcagggggcccggctcaggtggtaactggcggccaagccgctgatgcctccgcccagcacgaccacggtccggccbatgcggaaacctgggggaaagggggcgatatggacaggcagaccggggacaacctgcgctccagaagccccgccggttttgagttctatcccggccactc

SEQ ID NO: 68426 - DNA, 201 bp, Homo sapiens
  misc_feature (1)...(201): n = A,T,C or G, or insertion/deletion polymorphism (see Tables 1-2)
aagtggagcactcaccttaggggggcagggggcccggctcaggtggtaactggcggccaagccgctgatgcctccgcccagcacgaccacggtccggcccntgcggaaacctgggggaaagggggcgatatggacaggcagaccggggacaacctgcgctccagaagccccgccggttttgagttctatcccggccactca

SEQ ID NO: 68427 - DNA, 201 bp, Homo sapiens
caaaagtgctaggattgcaggtgtgagccactgcacctggcctacctttttcttaacatgggggatgtgggagagaagctggggtagctcagtcactatthtaagattctcagcaactcccagtcttctcttattcttttgacagaatggcctctctctgcgtccttcctagactgcaagggcagctcctaggagcccttt

SEQ ID NO: 68428 - DNA, 201 bp, Homo sapiens
gggaagagcattaaatgaagctccctctggcacaagtggagcactcaccttaggggggcagggggcccggctcaggtggtaactggcggccaagccgctgrtgcctccgcccagcacgaccacggtccggcccatgcggaaacctgggggaaagggggcgatatggacaggcagaccggggacaacctgcgctccagaagc

SEQ ID NO: 68429 - DNA, 201 bp, Homo sapiens
gtctctgtcttcaaggccttcagtggagagctgagggaagtttatcccaacttaccttgtgtagatggaccaagcagtggctcggcatctccttcagtcckaattgtgtagcagctgcttcctgggcccgctgttgaaacagctcctgagataagacacagccactagcctccagtgtctgtaaccaggaacctcccagca

SEQ ID NO: 68430 - DNA, 201 bp, Homo sapiens
ccctagggtgactggcactgggccctgaggatttggatacatccagcttttatattctcttcagccatttccttctttctgtttgacttctgtcctgggctttttttttcttttgcctactaagtaatagttgtttttttgtgtgtacagaaacatttaatcccttccttgcttttctctactctggatcccccatgatac

SEQ ID NO: 68431 - DNA, 201 bp, Homo sapiens
gcctatgctggaatagctccctcttctggtcctggctcagggggctgggattttgatatattttctaataaaggactttgtctcgcatctgctcctgcttyctgcatcccaggcacactttgcctctttgctgccccgcattcttatgcctataggtgatagaacagccagaccaagccaagctccagcaatttttatttt

SEQ ID NO: 68432 - DNA, 201 bp, Homo sapiens
gtgtaccaccatgcccagctaattttttgtatttttagtagagatggggttttaccgtgttagccagggtggtctcaatctcctgaccttgtgatctgccygccttggcctcccaaagtactgggattacaggcgtaagccaccgcgcccggccttcacttttattctttagcccccttttctccgtgccacctacagaca

SEQ ID NO: 68433 - DNA, 201 bp, Homo sapiens
tccctcactttggcagtacttaatattttcaccctctgaatcaatcccccctcacctgcccccagcagcaggcccagtaatatggaacgatgggtttgctmagcttggaagagactgggaaagcaggacctgatgctgagctcacggctgttgcctgcaaacactccacggcagagactgtccatggctagagacgccacc

SEQ ID NO: 68434 - DNA, 201 bp, Homo sapiens
ctagggggtaggggcctctccctcactgctggactggagctgggctcctgtagacctgaggggtccctctctctagggtctcctgtagggcttatgactgygaatccttgatgtcatgattttatgtgacgattcctaggagtccctgcccctagagtaggagcagggctggaccccaagcccctccctcttccatggaga

SEQ ID NO: 68435 - DNA, 201 bp, Homo sapiens
aaaaaaaagaaaagaagaaagaaatggaaggcatatgaggatgagggcacagtaaaaggagcggaggtgctggtgttacctgaggccagtgggtagggcakgcagggcaccgcccacgtagaggaacctgttctgggcagctgggtggtctccccggacaggcagcacttctgaatccaagccaagctcagaaacctgctc

SEQ ID NO: 68436 - DNA, 201 bp, Homo sapiens
acagaagagcccctaggtggtagatttgaacagggagctctgcagctggtttaggagggaagaggtttggggcctctgggcaagtgtcacctcaggtccarggcggcgctgggcaaaactgtgcacagtctcatcaggctctttgccccggggcttggtcagctccctcagcccagcccaaaacagaggtttggagaaggg

SEQ ID NO: 68437 - DNA, 201 bp, Homo sapiens
aaaaagaaaaaaagaatcattgaatagcaccccttgtccccactccctcactttggcagtacttaatattttcaccctctgaatcaatcccccctcacctrcccccagcagcaggcccagtaatatggaacgatgggtttgctcagcttggaagagactgggaaagcaggacctgatgctgagctcacggctgttgcctgc

SEQ ID NO: 68438 - DNA, 201 bp, Homo sapiens
acaaatttttaaattaaaaaaaaaaaagtaaacaaaaaggccgggcgtggtggctcacacctgtaatcccagcactttgggaggccgaggcgggtggatcwcctgaggtcgggagttccagaccagcctgaccaacacagagaaaccctgtctctactaaacatacaaaattagccgggtgtggtggcgcatgcctgtaat

SEQ ID NO: 68439 - DNA, 201 bp, Homo sapiens
ggagccctctggaaatgccactaggcaaagtttcctcctcctcacagtcactctgaggccaggggggctcccgtcctgctcagggaaagcaactgagtcayacacgattcccaggactcctggatcttctgaagatggcaccaaatgtccaaatccctggagagaaggacattcatgcgtcagaaggaaagggctctagct

SEQ ID NO: 68440 - DNA, 201 bp, Homo sapiens
aatctgtatgtgtgtgacccccggggaccccgccatgttgccgttgctatgaacaagtttggatacaggtagagggcatggaagggtactgggaaacaggraagcctactatcctgtggaaggaggagagccaagcggattgtggttggggatgtgtccccagaagactcggggtatgcaaggatctttctctccctagcc

SEQ ID NO: 68441 - DNA, 201 bp, Homo sapiens
ggagctctgcagctggtttaggagggaagaggtttggggcctctgggcaagtgtcacctcaggtccaaggcggcgctgggcaaaactgtgcacagtctcawcaggctctttgccccggggcttggtcagctccctcagcccagcccaaaacagaggtttggagaaggggggtgaagggcggagtagccccctgcatggaga

SEQ ID NO: 68442 - DNA, 201 bp, Homo sapiens
agcccctaggtggtagatttgaacagggagctctgcagctggtttaggagggaagaggtttggggcctctgggcaagtgtcacctcaggtccaaggcggcrctgggcaaaactgtgcacagtctcatcaggctctttgccccggggcttggtcagctccctcagcccagcccaaaacagaggtttggagaaggggggtgaa

SEQ ID NO: 68443 - DNA, 201 bp, Homo sapiens
tcagcttggaagagactgggaaagcaggacctgatgctgagctcacggctgttgcctgcaaacactccacggcagagactgtccatggctagagacgccabcttaagggtgagactaggactaaggagcgaaaaaataatctacactgactgatttccacagcccctatttggtagggaatgagggtgggatagggtttgg

SEQ ID NO: 68444 - DNA, 201 bp, Homo sapiens
caacagaccgggcctacgggagctagggccgcccggcaacgtacccagtgtttgtcaacagtggcactcccccatcgccgaccaaaccagtcgccccagarcctgcacgcagcctcactcaagtatgcctttcctcttttcctcccagtacataaccttcactgctgggggacacaggtccgggtccagcaccatccccga

SEQ ID NO: 68445 - DNA, 201 bp, Homo sapiens
gagaaaatgagggagaaggagatcgaggtcctaagaccgtaccccgccggcgctctgctgggtgcagataagggccacaccctcgctatcggccctcgcasggctcgggcggcgggcagtacgcctgagttctgaggtgctctgcttgccacacctctgtaggccaacaagtgcttcaaatccgctactcccacccccagc

SEQ ID NO: 68446 - DNA, 201 bp, Homo sapiens
atcaatcccccctcacctgcccccagcagcaggcccagtaatatggaacgatgggtttgctcagcttggaagagactgggaaagcaggacctgatgctgasctcacggctgttgcctgcaaacactccacggcagagactgtccatggctagagacgccaccttaagggtgagactaggactaaggagcgaaaaaataatc

SEQ ID NO: 68447 - DNA, 201 bp, Homo sapiens
aaaactctgtctcaaaaaaaaaaaaaaaaggtaattttcagaagaaggtaaaattatgacccttaaactgttgaagaaaaaattattctgacacttgttawaacagtaaggaagactattgcaatagtcaatgagcagaatcagagtcagtggatggaaggaaaattacattaaggctaggaggattcttgctaaactgac

SEQ ID NO: 68448 - DNA, 201 bp, Homo sapiens
tgaggaactccagtcctatcggccctggcctagttaagccacttggataaagatggaaacactgacaggttcattacactccaggggttcccctaccttcyagcgcccttctgcctggaggctgagcccacagaccggctggcctctgagaacactgacccccctactagtcaggtgggtttcaagggcctgaggcaacat

SEQ ID NO: 68449 - DNA, 201 bp, Homo sapiens
ccagttcaggggcatggtgtggtcctgctgacccaggaaggtatagcttttgcttctcactggtaggggttggggaaggggaaggtggctattccattacytgaagctggaatggcactaataacgtggtcagcctccagactgctgtcccttagagatacctgagagcatgaaaacatttgagagacccagaaaatgaga

SEQ ID NO: 68450 - DNA, 201 bp, Homo sapiens
gacaggcagatgggctccttggtactgcagattcaccacagctacagacactgcagtgatggcactcagggcacgagccagaggggcagcctcagcagggrgcagctcactgagcactagagatcaggcagaggcctgactcagaaggcattcccattacagttgtcagtcctctttgggattagactcccatagagatga

SEQ ID NO: 68451 - DNA, 201 bp, Homo sapiens
actataagatggtgaagcaccgaggagataagggcaatgaggaaaatccccacaggtaggaagaaggaaggactgcctgggaattgttactggatcctcasggttctgtacccctagccaggaaaatcctaaaggtccctagatttctggctgttcctttctgggtcttagtctccaacctctaaccctcagatttgacct

SEQ ID NO: 68452 - DNA, 201 bp, Homo sapiens
cctcacagtcactctgaggccaggggggctcccgtcctgctcagggaaagcaactgagtcatacacgattcccaggactcctggatcttctgaagatggcmccaaatgtccaaatccctggagagaaggacattcatgcgtcagaaggaaagggctctagctgaggctgtctctccttcccatttttttgggggggtgggg

SEQ ID NO: 68453 - DNA, 201 bp, Homo sapiens
gcatctccttcagtcctaattgtgtagcagctgcttcctgggcccgctgttgaaacagctcctgagataagacacagccactagcctccagtgtctgtaaycaggaacctcccagcatcacctaaggagggaatatagcactgatcagtctggccttgcctacaatggagcacagaggagccctctggaaatgccactagg

SEQ ID NO: 68454 - DNA, 201 bp, Homo sapiens
ctcggcatctccttcagtcctaattgtgtagcagctgcttcctgggcccgctgttgaaacagctcctgagataagacacagccactagcctccagtgtctrtaaccaggaacctcccagcatcacctaaggagggaatatagcactgatcagtctggccttgcctacaatggagcacagaggagccctctggaaatgccac

SEQ ID NO: 68455 - DNA, 201 bp, Homo sapiens
gcctggcgcccactctctatacagtcattaacagcaactccctcataggaggctccagccagagtcaggggcaacctgtgagcagtcaggaattgcctagstgactctggaaggaaaggatgaaaggaatgttttagctgggggtctgatgtccttggccctcctcagcccagctgttttcccaacttacctagtttttgc

SEQ ID NO: 68456 - DNA, 201 bp, Homo sapiens
actgctgcctggcgcccactctctatacagtcattaacagcaactccctcataggaggctccagccagagtcaggggcaacctgtgagcagtcaggaattrcctagctgactctggaaggaaaggatgaaaggaatgttttagctgggggtctgatgtccttggccctcctcagcccagctgttttcccaacttacctagt

SEQ ID NO: 68457 - DNA, 201 bp, Homo sapiens
tctgcctggaggctgagcccacagaccggctggcctctgagaacactgacccccctactagtcaggtgggtttcaagggcctgaggcaacatctctagacstccacgaagtgaccactggctccagcgctcagccaaggcctggcgaatgagtgctgagtctggctgtggggtccgccctgcagaggaagcaaagaagaat

SEQ ID NO: 68458 - DNA, 201 bp, Homo sapiens
atgagagttggggatcagctgttaggttctgtgcccaggacactgactgctgcctggcgcccactctctatacagtcattaacagcaactccctcataggrggctccagccagagtcaggggcaacctgtgagcagtcaggaattgcctagctgactctggaaggaaaggatgaaaggaatgttttagctgggggtctgat

SEQ ID NO: 68459 - DNA, 201 bp, Homo sapiens
cttccagcgcccttctgcctggaggctgagcccacagaccggctggcctctgagaacactgacccccctactagtcaggtgggtttcaagggcctgaggcracatctctagacctccacgaagtgaccactggctccagcgctcagccaaggcctggcgaatgagtgctgagtctggctgtggggtccgccctgcagagga

SEQ ID NO: 68460 - DNA, 201 bp, Homo sapiens
cacttaaggccagtccacggggaggcggctccataaacagctccttgatgttagcaacagaccgggcctacgggagctagggccgcccggcaacgtacccrgtgtttgtcaacagtggcactcccccatcgccgaccaaaccagtcgccccagagcctgcacgcagcctcactcaagtatgcctttcctcttttcctccca

SEQ ID NO: 68461 - DNA, 201 bp, Homo sapiens
tgcccccagcagcaggcccagtaatatggaacgatgggtttgctcagcttggaagagactgggaaagcaggacctgatgctgagctcacggctgttgcctrcaaacactccacggcagagactgtccatggctagagacgccaccttaagggtgagactaggactaaggagcgaaaaaataatctacactgactgatttcc

SEQ ID NO: 68462 - DNA, 201 bp, Homo sapiens
actttggcagtacttaatattttcaccctctgaatcaatcccccctcacctgcccccagcagcaggcccagtaatatggaacgatgggtttgctcagcttrgaagagactgggaaagcaggacctgatgctgagctcacggctgttgcctgcaaacactccacggcagagactgtccatggctagagacgccaccttaagg

SEQ ID NO: 68463 - DNA, 201 bp, Homo sapiens
gaatagcaccccttgtccccactccctcactttggcagtacttaatattttcaccctctgaatcaatcccccctcacctgcccccagcagcaggcccagtmatatggaacgatgggtttgctcagcttggaagagactgggaaagcaggacctgatgctgagctcacggctgttgcctgcaaacactccacggcagagact

SEQ ID NO: 68464 - DNA, 201 bp, Homo sapiens
agaccggctggcctctgagaacactgacccccctactagtcaggtgggtttcaagggcctgaggcaacatctctagacctccacgaagtgaccactggctycagcgctcagccaaggcctggcgaatgagtgctgagtctggctgtggggtccgccctgcagaggaagcaaagaagaatcattgaggctggatgcagtggc

SEQ ID NO: 68465 - DNA, 201 bp, Homo sapiens
tgtaagacagaacgcgatggaggaacagaggctcaaaggaagggtcctctgggagaaccacattttctctctttctctctttctttcttctttgagacagratctggctctatcactcaggctggagtagtgcagtggtgcaatcagctcactgcagccttgaactcctgggttcaagtgatcctcccacctcagccctgt

SEQ ID NO: 68466 - DNA, 201 bp, Homo sapiens
acagaggtttggagaaggggggtgaagggcggagtagccccctgcatggagaaaggcatagtgagggggaagctcctgacatacctccccagctccaggcrctggggtcatttccactcatttggcttccttttgctgggaaggctgacagggagatgaagaaatggaaggcaggtcgggcgtggtggctcacgcctgtaa

SEQ ID NO: 68467 - DNA, 201 bp, Homo sapiens
atgctgttgcactccagcctgggcaacaagagagaaactccatcccaaaaaaaaaaaagaaagtgagggtcagtcctgtaagacagaacgcgatggaggarcagaggctcaaaggaagggtcctctgggagaaccacattttctctctttctctctttctttcttctttgagacagaatctggctctatcactcaggctgg

SEQ ID NO: 68468 - DNA, 201 bp, Homo sapiens
ttagcccccttttctccgtgccacctacagacatagtctggttcccctccattatcttccaggctggaaatggaacatttaacagggcaaaactgttgaaygttggggtgcgagaggccctgcgtgatgaagagtgggactgcctgttcttgcacgatgtggacctcttgccagaaaatgaccacaatctgtatgtgtgtg

SEQ ID NO: 68469 - DNA, 201 bp, Homo sapiens
tccgggtccagcaccatccccgaaaccttccccctcggctctgagagcgcccccacctgttagagagggaacttgggtcccaagaagactccaatttggcycagttctctatcaccccctaagcaaaaatacaaataagcacatcattttttcttaataaatttattcacaaaaagtgatattgcagagggtctgggggct

SEQ ID NO: 68470 - DNA, 201 bp, Homo sapiens
tacgcctgagttctgaggtgctctgcttgccacacctctgtaggccaacaagtgcttcaaatccgctactcccacccccagccttttcggtctctcctackctccgtccactctgttctcgcggcacgcgcctaaccctacctctcctacatctggattggcgggacttggaaggccccggatcacgttcaccaataaaac

SEQ ID NO: 68471 - DNA, 201 bp, Homo sapiens
tccattttactctaatatctggggaaacatcatttgactttaaagaagacgctgtctttccctccaccttcaatgtttcattgttttattaactaatcgcyttttatttccaggcctgcgggatacaacgggaatacaaaaatgcgctagagcggtccgcaacgctgtagcctgcgtaaggaacaattgatactaagtggc

SEQ ID NO: 68472 - DNA, 201 bp, Homo sapiens
tcgaacggagcgaatccagcctcccagacgctcactgctctccactaggaccacctggcgacaagagggagagacactgcagcaccgcctgtagccgccgscgagaggtcaggaggggaggggaagaggcatattcagagggccaggatccatctagcttttgatggaaatgggaagagcattaaatgaagctccctctgg

SEQ ID NO: 68473 - DNA, 201 bp, Homo sapiens
cctccacctcctgggttcaagcgattctcctgccttagcctcccgagtagctgagattacaggtgcaagccaccacacctggctaatttttgtatttttcrtagagatggggtttcaccatgttggccaggctggtctcgaactcctgaccttgttatctgcccacctcggcctcccaaaatgctgggattacaggtgtga

SEQ ID NO: 68474 - DNA, 201 bp, Homo sapiens
agaggagccctctggaaatgccactaggcaaagtttcctcctcctcacagtcactctgaggccaggggggctcccgtcctgctcagggaaagcaactgagkcatacacgattcccaggactcctggatcttctgaagatggcaccaaatgtccaaatccctggagagaaggacattcatgcgtcagaaggaaagggctcta

SEQ ID NO: 68475 - DNA, 201 bp, Homo sapiens
gttggggatcagctgttaggttctgtgcccaggacactgactgctgcctggcgcccactctctatacagtcattaacagcaactccctcataggaggctcyagccagagtcaggggcaacctgtgagcagtcaggaattgcctagctgactctggaaggaaaggatgaaaggaatgttttagctgggggtctgatgtcctt

SEQ ID NO: 68476 - DNA, 201 bp, Homo sapiens
gtttggggcctctgggcaagtgtcacctcaggtccaaggcggcgctgggcaaaactgtgcacagtctcatcaggctctttgccccggggcttggtcagctmcctcagcccagcccaaaacagaggtttggagaaggggggtgaagggcggagtagccccctgcatggagaaaggcatagtgagggggaagctcctgacata

SEQ ID NO: 68477 - DNA, 201 bp, Homo sapiens
ccaggagttcgagaccagcctagtagatagaagatgaaaccccatagctactaaaaatacaaaatttagccagcacggtggtgggcacctgtaatcccagytacttgggaggctgaggcagaagaattgcttgaacctgggagacagaggtggcagtgagccaagatcatgccactgcactctagcctgggcatcagagca

SEQ ID NO: 68478 - DNA, 201 bp, Homo sapiens
gcacatcattttttcttaataaatttattcacaaaaagtgatattgcagagggtctgggggctgtacatgggcaggggcttggtgagctttgtacatgggrctgggagacaagggagcctccaggtggaagggtattttttaataaaaaaaataatggagctacaaccaccccctcccccctccccgattaaaaagacaca

SEQ ID NO: 68479 - DNA, 201 bp, Homo sapiens
ggctgaggcagaagaattgcttgaacctgggagacagaggtggcagtgagccaagatcatgccactgcactctagcctgggcatcagagcaagactccatytcaaaaaaaaaaaaaaaaaaaaaaaaaaaaaaaaaattagccaggtgtgcttgtgcacgcctgtagtcctagctactcagggaatggggtgggggctgag

SEQ ID NO: 68480 - DNA, 201 bp, Homo sapiens
cggctgactgcaagctccacctcccgggttttacgccattctcctgcctcagcctcctgagtagctgggactacaggcgtgtaccaccatgcccagctaaytttttgtatttttagtagagatggggttttaccgtgttagccagggtggtctcaatctcctgaccttgtgatctgcctgccttggcctcccaaagtactg

SEQ ID NO: 68481 - DNA, 201 bp, Homo sapiens
ccaggaggcggaggttgcggtgagctgcagatcatgctgttgcactccagcctgggcaacaagagagaaactccatcccaaaaaaaaaaaagaaagtgagsgtcagtcctgtaagacagaacgcgatggaggaacagaggctcaaaggaagggtcctctgggagaaccacattttctctctttctctctttctttcttctt

SEQ ID NO: 68482 - DNA, 201 bp, Homo sapiens
tgtggtcctgctgacccaggaaggtatagcttttgcttctcactggtaggggttggggaaggggaaggtggctattccattacctgaagctggaatggcamtaataacgtggtcagcctccagactgctgtcccttagagatacctgagagcatgaaaacatttgagagacccagaaaatgagaatttgatgagtgaaaag

SEQ ID NO: 68483 - DNA, 201 bp, Homo sapiens
tctttgagacagaatctggctctatcactcaggctggagtagtgcagtggtgcaatcagctcactgcagccttgaactcctgggttcaagtgatcctcccrcctcagccctgtgagtagctggaactacagctgtgagccaccatgcccagctaatttttgtatttttcttggaagggaattttgccatattgcccaggct

SEQ ID NO: 68484 - DNA, 201 bp, Homo sapiens
ggtcctgctgacccaggaaggtatagcttttgcttctcactggtaggggttggggaaggggaaggtggctattccattacctgaagctggaatggcactawtaacgtggtcagcctccagactgctgtcccttagagatacctgagagcatgaaaacatttgagagacccagaaaatgagaatttgatgagtgaaaagaga

SEQ ID NO: 68485 - DNA, 201 bp, Homo sapiens
gtgcaatcagctcactgcagccttgaactcctgggttcaagtgatcctcccacctcagccctgtgagtagctggaactacagctgtgagccaccatgcccrgctaatttttgtatttttcttggaagggaattttgccatattgcccaggctgatcttaaactcctgaactcaactgatccacctaactgggcctcccaaa

SEQ ID NO: 68486 - DNA, 201 bp, Homo sapiens
aggggcttggtgagctttgtacatggggctgggagacaagggagcctccaggtggaagggtattttttaataaaaaaaataatggagctacaaccaccccytcccccctccccgattaaaaagacacaaaaatagacgtctctgaggtaaacggggagcctggggcttaagggtgtttaaagggcttcacaggtgccagag

SEQ ID NO: 68487 - DNA, 201 bp, Homo sapiens
ccctaggtggtagatttgaacagggagctctgcagctggtttaggagggaagaggtttggggcctctgggcaagtgtcacctcaggtccaaggcggcgctrggcaaaactgtgcacagtctcatcaggctctttgccccggggcttggtcagctccctcagcccagcccaaaacagaggtttggagaaggggggtgaaggg

SEQ ID NO: 68488 - DNA, 201 bp, Homo sapiens
ccctccccgattaaaaagacacaaaaatagacgtctctgaggtaaacggggagcctggggcttaagggtgtttaaagggcttcacaggtgccagagcttaraggtgtcacaggcaccggggtggctcctgcatcagttggtagaacagcacgtagccctcgctggatgccacctggttttcactgacaggggagacactag

SEQ ID NO: 68489 - DNA, 201 bp, Homo sapiens
gggcaagtgtcacctcaggtccaaggcggcgctgggcaaaactgtgcacagtctcatcaggctctttgccccggggcttggtcagctccctcagcccagcycaaaacagaggtttggagaaggggggtgaagggcggagtagccccctgcatggagaaaggcatagtgagggggaagctcctgacatacctccccagctcc

SEQ ID NO: 68490 - DNA, 201 bp, Homo sapiens
ctgtctctgcccctgctctccctctccctttctcttcagcagtaaccctcctccccacccccgctagaagaggggaaaggtagaaaaggtagaggacgccwcccccaccctactctccgccgagctccggggctgttcgcttacagcccccaggtggtcacggtccctgcacctgaggagttggcacccaggcacatgaag

SEQ ID NO: 68491 - DNA, 201 bp, Homo sapiens
tctgaggtaaacggggagcctggggcttaagggtgtttaaagggcttcacaggtgccagagcttagaggtgtcacaggcaccggggtggctcctgcatcarttggtagaacagcacgtagccctcgctggatgccacctggttttcactgacaggggagacactaggaaaaaaggagatcgggaaagggttgtggtcattc

SEQ ID NO: 68492 - DNA, 201 bp, Homo sapiens
cgcccttctgcctggaggctgagcccacagaccggctggcctctgagaacactgacccccctactagtcaggtgggtttcaagggcctgaggcaacatctytagacctccacgaagtgaccactggctccagcgctcagccaaggcctggcgaatgagtgctgagtctggctgtggggtccgccctgcagaggaagcaaag

SEQ ID NO: 68493 - DNA, 201 bp, Homo sapiens
gtttaggagggaagaggtttggggcctctgggcaagtgtcacctcaggtccaaggcggcgctgggcaaaactgtgcacagtctcatcaggctctttgcccsggggcttggtcagctccctcagcccagcccaaaacagaggtttggagaaggggggtgaagggcggagtagccccctgcatggagaaaggcatagtgaggg

SEQ ID NO: 68494 - DNA, 201 bp, Homo sapiens
gccagtgtcagaggtattcccaaaccctagtttgattcttttctctttgcccctctgatccctctacttgccattccttcccaacagtgggtcctgtgtcrgtgtcctttagcccagtgccatcactggcagagattgtggagcggaatccccgggtagaaccagggggccggtaccgccctgcaggttgtgagccccgct

SEQ ID NO: 68495 - DNA, 201 bp, Homo sapiens
acagaggagccctctggaaatgccactaggcaaagtttcctcctcctcacagtcactctgaggccaggggggctcccgtcctgctcagggaaagcaactgrgtcatacacgattcccaggactcctggatcttctgaagatggcaccaaatgtccaaatccctggagagaaggacattcatgcgtcagaaggaaagggctc

SEQ ID NO: 68496 - DNA, 201 bp, Homo sapiens
gaggtgggcagatcacctgaggttagcagtttgagaccaccctgaccaacatggagaaaccccgtctctactaaaaatacaaaattagccgggcgtggtarcacatgcctgtaatcccagctacttgggaggctgaggcaggagagttacttgaacccaggaggcggaggttgcggtgagctgcagatcatgctgttgcac

SEQ ID NO: 68497 - DNA, 201 bp, Homo sapiens
aacatggagaaaccccgtctctactaaaaatacaaaattagccgggcgtggtagcacatgcctgtaatcccagctacttgggaggctgaggcaggagagtyacttgaacccaggaggcggaggttgcggtgagctgcagatcatgctgttgcactccagcctgggcaacaagagagaaactccatcccaaaaaaaaaaaag

SEQ ID NO: 68498 - DNA, 201 bp, Homo sapiens
tgcagtgagctcagatcgcaccactgcactctagcttgggtgacaaagcaagactccgactcaaaaaaaaaaaaattctccttgaagactgggtatttggraaaaaaaaaaaggaaaggaaaggaaaaaaaagaaggaagggaagggaagggacgaagggagggagggaggaagaagggaaggaaggaaggaaggaaggaa

SEQ ID NO: 68499 - DNA, 201 bp, Homo sapiens
aggccaggggggctcccgtcctgctcagggaaagcaactgagtcatacacgattcccaggactcctggatcttctgaagatggcaccaaatgtccaaatcsctggagagaaggacattcatgcgtcagaaggaaagggctctagctgaggctgtctctccttcccatttttttgggggggtgggggggacagagtctcact

SEQ ID NO: 68500 - DNA, 201 bp, Homo sapiens
atatggtgaaaccccatctctactaaaaatacaaaaactagccagacgtggtggtaggcacctgtagtcccagctactcgggaggctgaggcaggagaatygcttgaacccgaaaggcggaagttgcagtgagccaagatcgcgccattgcactccatcctgggcgagagcgatactccgtctcaaaaaaaaaaaaaaaaa

SEQ ID NO: 68501 - DNA, 201 bp, Homo sapiens
gagaaggctaggtaaggatcctgcaccttccagcctttgtagagctgtcccagtgataggtaatccaaggcatgcgagatttctgagtgagccctgagaaytaagccccagaaccagactgccagtgtcagaggtattcccaaaccctagtttgattcttttctctttgcccctctgatccctctacttgccattccttcc

SEQ ID NO: 68502 - DNA, 201 bp, Homo sapiens
ctctactaaaaatacaaaaactagccagacgtggtggtaggcacctgtagtcccagctactcgggaggctgaggcaggagaatcgcttgaacccgaaaggyggaagttgcagtgagccaagatcgcgccattgcactccatcctgggcgagagcgatactccgtctcaaaaaaaaaaaaaaaaaaaaaaaaaaagaaaaga

SEQ ID NO: 68503 - DNA, 201 bp, Homo sapiens
agccacttggataaagatggaaacactgacaggttcattacactccaggggttcccctaccttccagcgcccttctgcctggaggctgagcccacagaccsgctggcctctgagaacactgacccccctactagtcaggtgggtttcaagggcctgaggcaacatctctagacctccacgaagtgaccactggctccagcg

SEQ ID NO: 68504 - DNA, 201 bp, Homo sapiens
gctagagacgccaccttaagggtgagactaggactaaggagcgaaaaaataatctacactgactgatttccacagcccctatttggtagggaatgagggtrggatagggtttgggttgggggacattcccactgtgacggatggaaatgaaggccttcactcccaataatgagttttgggaattatgagggggtggggtat

SEQ ID NO: 68505 - DNA, 201 bp, Homo sapiens
agaatctggctctatcactcaggctggagtagtgcagtggtgcaatcagctcactgcagccttgaactcctgggttcaagtgatcctcccacctcagcccygtgagtagctggaactacagctgtgagccaccatgcccagctaatttttgtatttttcttggaagggaattttgccatattgcccaggctgatcttaaac

SEQ ID NO: 68506 - DNA, 201 bp, Homo sapiens
tgacgacattgctaccaggtcagacttcctgccacttcctccctcctgaccccagtctggatccctgtcctctaagaccacctttgaccatagcccttcarcactaacctttagctccctggtcctgcactgagcccattcctttcccttagtctttttaggatacccaggtcaggcttgcatgctactgcccattgtgtc

SEQ ID NO: 68507 - DNA, 201 bp, Homo sapiens
agagcattaaatgaagctccctctggcacaagtggagcactcaccttaggggggcagggggcccggctcaggtggtaactggcggccaagccgctgatgcytccgcccagcacgaccacggtccggcccatgcggaaacctgggggaaagggggcgatatggacaggcagaccggggacaacctgcgctccagaagccccg

SEQ ID NO: 68508 - DNA, 201 bp, Homo sapiens
cctgtcctctaagaccacctttgaccatagcccttcaacactaacctttagctccctggtcctgcactgagcccattcctttcccttagtctttttaggayacccaggtcaggcttgcatgctactgcccattgtgtcatccttcagtctcctggttagtttgttcttgggagaggacataagatcaataggaaatagtat

SEQ ID NO: 68509 - DNA, 201 bp, Homo sapiens
gctactaaaaatacaaaatttagccagcacggtggtgggcacctgtaatcccagctacttgggaggctgaggcagaagaattgcttgaacctgggagacaraggtggcagtgagccaagatcatgccactgcactctagcctgggcatcagagcaagactccatctcaaaaaaaaaaaaaaaaaaaaaaaaaaaaaaaaaa

SEQ ID NO: 68510 - DNA, 201 bp, Homo sapiens
ccctcagcccagcccaaaacagaggtttggagaaggggggtgaagggcggagtagccccctgcatggagaaaggcatagtgagggggaagctcctgacatrcctccccagctccaggcgctggggtcatttccactcatttggcttccttttgctgggaaggctgacagggagatgaagaaatggaaggcaggtcgggcgt

SEQ ID NO: 68511 - DNA, 201 bp, Homo sapiens
attttcatgaatgagagttggggatcagctgttaggttctgtgcccaggacactgactgctgcctggcgcccactctctatacagtcattaacagcaactmcctcataggaggctccagccagagtcaggggcaacctgtgagcagtcaggaattgcctagctgactctggaaggaaaggatgaaaggaatgttttagctg

SEQ ID NO: 68512 - DNA, 201 bp, Homo sapiens
ttttcatgaatgagagttggggatcagctgttaggttctgtgcccaggacactgactgctgcctggcgcccactctctatacagtcattaacagcaactcyctcataggaggctccagccagagtcaggggcaacctgtgagcagtcaggaattgcctagctgactctggaaggaaaggatgaaaggaatgttttagctgg

SEQ ID NO: 68513 - DNA, 201 bp, Homo sapiens
tacccaggaaagaattcaagggtgagccagtggtaaggtggaagaaaacaacttcattaaagaggcagtgtgacagctccgtgacttttcctgcagagtasggctgctccgcaggcagtgtgctgaaagcagctcagggcagttgtgcagtcagatctatacctacttttaattgcacgcagattaaaggacagtttctga

SEQ ID NO: 68514 - DNA, 201 bp, Homo sapiens
ggcaggagccaccgaggccggacacgtgggcgacttattgaccaagtggggaggaagcagccccgcactgctctcccgactgcggaccaccgttgggctcmtgcgcatcctaagccccaccgcctcacctccagtccccacagcgttcgcgctcccagccggggtaagcggaagaaaacaaaggcccggctccatcagggc

SEQ ID NO: 68515 - DNA, 201 bp, Homo sapiens
aatgccagccagttgtgtatgaactccaaaaggaagggggtacaatgagggctatctgatctcctgtcccgttatttgaaatgctttttccctggtgctgkaaagaaatagcacttgtaggctgggcgccgtggctcacgcctgtaatcccagtacctggggaggctgaggcgggcggatcacgaggtcaagagattgaga

SEQ ID NO: 68516 - DNA, 201 bp, Homo sapiens
taaaaaaatacctgaacctttaattaggggaaataaattggaaaaatacatttcccttcacttaacattatcttagtttctcttttttttttttttttttwttgagatggagtcttgctctgttacccaggctggagtgcagtggtggcgggacctcagctagatgcagcctccgcctcctgggttcaagcaattctcctg

SEQ ID NO: 68517 - DNA, 201 bp, Homo sapiens
ggaaccagggctgcgcgcggcgcttgcgggccagcgcaagttccgggtgggcgtgggctcggcgggccgcacttggagcgggcggccggccccgccggccrgggcagtgaggggcttagcacctgggccagcagccgccgtgcttgatttctcaacaggccttagctgcctccccgcggggcagggctcgggacctgcagc

SEQ ID NO: 68518 - DNA, 201 bp, Homo sapiens
gaataattgagtttgcagaaacctactgtgtgccttcaggtaaatggagagtggggtttggtctagcaacgaagcatctagaaggtccctttggccttacyggctctgttttaggtaagtccacgtctgagtaccagtgactgcagctcttccagttgtgctgtcatgcttatatgttagaaatgatcatcaaaggactca

SEQ ID NO: 68519 - DNA, 201 bp, Homo sapiens
tccagcatttccctttcgtcatgttagtctgtgcctgtctacgtgaactatggtgacgtttattgggcctggcactgtgaggtgctggggatgtgaagatyattgtggctcagccgctgctctcgagggcctctgggtgcagtatgcacacctgtgcctcctgtttgctcaggaagacaggctttgagatgagctggggct

SEQ ID NO: 68520 - DNA, 201 bp, Homo sapiens
ttcgtcatgttagtctgtgcctgtctacgtgaactatggtgacgtttattgggcctggcactgtgaggtgctggggatgtgaagatcattgtggctcagcygctgctctcgagggcctctgggtgcagtatgcacacctgtgcctcctgtttgctcaggaagacaggctttgagatgagctggggctgacatccccacctt

SEQ ID NO: 68521 - DNA, 201 bp, Homo sapiens
cgctcccagccggggtaagcggaagaaaacaaaggcccggctccatcagggcaccaatcccgctcgtcggcctctttctcggcctccaatgagcttctagrgtgttatcacgccagtctccttccgcgactgattggccggggtcttcctagtgtgagcggccctggccaatcagcgcccgtcagcccaccccacgaggcc

SEQ ID NO: 68522 - DNA, 201 bp, Homo sapiens
ccacaggtccagccggccggtgagcgcctggggaccgcagaggtgagagtcgcgcccgggagtccgccgcctgcgccaggatggagttcgtgaaatgcctyggccaccccgaagagttctacaacctggtgcgcttccggatcgggggcaagcggaaggtgatgcccaagatggaccaggtgggccgagcctccctgcttg

SEQ ID NO: 68523 - DNA, 201 bp, Homo sapiens
gggaggctgaggcaggagaagcacttgaacccagaaggcagaggtggcagtgagccgagactgtgccactgcactccagcctggcaacaagagtgaaattytgtctcaaaaaaaaaaaaaaaaaaaaaaaaaaaaggcgcttgaacattaatttactaagcaggccatttttacttcctgcagaaagggtacactcgccag

SEQ ID NO: 68524 - DNA, 201 bp, Homo sapiens
ggcccggatctggggcaaggggcgcggcgagcagggccgacgcctgggtgttcccgtccccctttcctcgagccttccccctgtagggcccgggtggacgyggccgtcctggctgacctgtccctgcccccgcaagccgccctgggcatgagcgacttttgcgtggttcccggtggttgcgctccccgtttcgtcccctcc

SEQ ID NO: 68525 - DNA, 201 bp, Homo sapiens
ttattgggaagaggatttcagcggagcccgagtagagtttggtctagggagactctgtcactgggaggacgagcgagccgctcggaagtgcgctgggttcycttagcggccagtgggttctggtgagaagggcaacagcgggaggaggcgccggtgcggagcgggaggccgggggcggggctgcggggctgcggggcgggc

SEQ ID NO: 68526 - DNA, 201 bp, Homo sapiens
cagaacatagcccggccctacgtgtttactttagaaagcccttccaggctctttgccatctagtagagtccctgcgggcccagcctttcagagaagagggsggagggggtgatgtttattaactttttttagtcttggcagctgaacctgcctgtgagcaggtcgtgtatttctcggcttcccttatccaactttgcattt

SEQ ID NO: 68527 - DNA, 201 bp, Homo sapiens
agtgggttatagttaaaatcctaagatttttaaagtccctcaagttcatgtggacatctgcctaggtcctactatcctagaattcgcatgtcttatcacayaaataactgattcttccatatcttataaataaaggtttgatttagcaaagtcacatgttgtgtaatagctcgaagaagccctttttgtccacagttgcca

SEQ ID NO: 68528 - DNA, 201 bp, Homo sapiens
aacagtccttatgttattgaaacaaacctaatctgtagctgagttgggagggagctaagtggacagagagtcctccacccaaacaaaagaatctttgattyttgggcataatgggagcaatatttaaaaaaaaaaaaaaaaaaaaaaaaaggaatgtttggggaagactcttgcggtgcaaaggctgtttcagattgctga

SEQ ID NO: 68529 - DNA, 201 bp, Homo sapiens
catatataattttaagctacttgagttgtaggtccctccagtctgtgattcagtttgagatgggactgtatgggaattaacagtgccttgtcttcttaagsagtgatttgtgtatgtgctgatatagctcagtatgtctttgaaaccagttgtctggggctaggcctgcaatcagcttttggctaagaggtcccaggatgg

SEQ ID NO: 68530 - DNA, 201 bp, Homo sapiens
acagggaaattacctagtacataatgtactgttatctacattttatctagatgaggaaactgaggcacagagaaattaagtactttgcctaggattacccrtgaagttaagtgacagaatcaatgaatctggaaggtctggcttcagatctcttgtgctgagtcactcgcatactttactacctctaaggtttctaatcag

SEQ ID NO: 68531 - DNA, 201 bp, Homo sapiens
aatgatacttgttacataggaagtgcttgatccatgtttgcacaaatgaatctttctcataatgaggtttctctaaacaagctgttctcccaaaaacttamacccagctttatgttgaagcatctcattatacattggaaagatgaaatgtgtagtgagactttgaatcttcttttgaatctagaaacattagcattttta

SEQ ID NO: 68532 - DNA, 201 bp, Homo sapiens
acaggagtgggacaaggttagtctcataaaacagtgtctgtgtgtgatgtattagacagagctggcagtcctcatagtgaagctcagaacaagaaaagttrtccagtattttcagcccctctggttttacaattcatctgtttaggttgaatgtctcatcataaacagtttattccagagttaattccaaaccagcagcta

SEQ ID NO: 68533 - DNA, 201 bp, Homo sapiens
ggttaggagtcttgcctatttttcataggaatggtgtttgtgagacttactcatcacttctgtggaagtaaagacattttatttatttattttaaagccartcagatttagcaggcagagacatttcagacatctaaagtgttgatgtatttcatacctttaactgtgcttaaattaggatctccgaaaagatgctgctac

SEQ ID NO: 68534 - DNA, 201 bp, Homo sapiens
tgaatagaagttttgatcagataaaattgaattaaaaaaaattttttttgagacagggtcttgctgttatccaggctggtgtgtagtggtgtgatcacggytccccgcagcctcaacctcctgggctcaggtgatcctcccacctcagcctaccgagtagctgtaactacagtgcatgacaccataccaggctcatttttg

SEQ ID NO: 68535 - DNA, 201 bp, Homo sapiens
cagacaaggcagccttgaccttctgggctcaagcaatcttccttgccctcagcctcctgagtaactgggaccacaggcacgttgccaccatgcctggctartttattttaatttttattatttttgagacagggtattgctctgtcacccaggctggagtgtagtggcatgatcaaggctcactgcagccttcacctcctg

SEQ ID NO: 68536 - DNA, 201 bp, Homo sapiens
tgtcacccaggctggagtgtagtggcatgatcaaggctcactgcagccttcacctcctgtgctcaagcagtcctctcacctcagcctccccattagctggractataggtccacaccactacaccaggctaatttttgtaattttttggtagagacagggtttcatcgtgttgcctaggctggtcttgagctcctgggctc

SEQ ID NO: 68537 - DNA, 201 bp, Homo sapiens
ccaagtggtggatatggtaacaacccatgtgcactagcttaacaaaaagttcttaggaatggctttgttcggcctggcgcagtggctcatgcctgtaatcmcaacagtttgagaggccaaggtgggcggatcacctgaggccaggagttcgagaccagcctggccaacatagtgaaaccccgtgtttactaaaaaatacaa

SEQ ID NO: 68538 - DNA, 201 bp, Homo sapiens
gacagagtgagactccctctcaaaagaagaggaagggcttggttcttctgctcagccctgaatcagttactgttgctacacagctgagttctctggcctcrcctggattacgtctacacagtacacacagaatggatttcccccaaagaaagaattctgcggcaggaaggggaaagggatggcaggtagacaaaaactcca

SEQ ID NO: 68539 - DNA, 201 bp, Homo sapiens
aatcagttactgttgctacacagctgagttctctggcctcacctggattacgtctacacagtacacacagaatggatttcccccaaagaaagaattctgcrgcaggaaggggaaagggatggcaggtagacaaaaactccaggtgtctgtaataagggacagggtcgatctttaattaaaacatggacagggaacagaaag

SEQ ID NO: 68540 - DNA, 201 bp, Homo sapiens
caggacttgatgaatgattttgaaggggtggatataaggagagaaagggcgttatcaatgacacctggattttgtgattacaaaactgagaggctgttaaygctatccacaggagaagcagatttaatggaagagagatttaaagaatgggcacgttaactaactttgcattgtttaggcaccatcgtgtcctatacgcag

SEQ ID NO: 68541 - DNA, 201 bp, Homo sapiens
ctgtctctcacacacactcaaaaaaaaaaaaaaaaaaaaaagaaacaaacaaaaaaaacggtgggggaggggaacagataaaggagaggccaggaaacacyagaaaaggattcctgaagcagattccacctgagctgtaatggaggcgtggcaggtggctaggcaaggagcaggaagcctattccaggcaggtgaattgct

SEQ ID NO: 68542 - DNA, 201 bp, Homo sapiens
tattttgcccattaattgatgcagtttcttcctagcctcgatggtctttacaatttggcatgtttttgcagtggctggtaccagttgttcctttccatttktactgcttccttcaggagctcttttagggcaggcctggtggtgacaaaatctctgagcatttgcttgtctgtaaaggattttatttctccttcacttgtg

SEQ ID NO: 68543 - DNA, 201 bp, Homo sapiens
acatatagtatgtgggcctccatttgtcctcttatcccaggccttgcagaatttaggaataagcctcaatacagtgttctaacccagtgacttccgcctcratgtacagtagattgaacctgatcctttatactttagtgatcattagttgataccagttcaagtcaggctttctagaaatctcattgtatgttaggggtt

SEQ ID NO: 68544 - DNA, 201 bp, Homo sapiens
ttgggagatgcaaatgctggttcagaggtctggccctctgacactctgatgagcatttctaacaggctctcaggtgacggccgtgctcctggtctgtggaycacttcagtatggctgaagcacaataaaagagggcaaattactgctttctttaaaaagagtggcagccgggcacagtggctcacgcctataatcctagca

SEQ ID NO: 68545 - DNA, 201 bp, Homo sapiens
cccccactgggattagcagtggtggaaatgtgagagagggcaaacaggtgggtctagatgaggtgtgagcagactcgaggggcacaggagttagtcaagcyagtatctgggggatagtgcaggaatagtgaacagctagacaaaaagtcctagggccagagaaagcaaaagcataagagatggaggccagagaggtaatct

SEQ ID NO: 68546 - DNA, 201 bp, Homo sapiens
aaaattacccaggcgtggtggttgggcgcctgtaatcccagctactcgggaggctgaggcaggagaagcacttgaacccagaaggcagaggtggcagtgarccgagactgtgccactgcactccagcctggcaacaagagtgaaattctgtctcaaaaaaaaaaaaaaaaaaaaaaaaaaaaggcgcttgaacattaattt

SEQ ID NO: 68547 - DNA, 201 bp, Homo sapiens
gtggctttagacatttcataaatatttcttaaatgcctcctaaatgctaggatttggcaatacaaggctaaacaaaatacaaagccaaatcctactgtaaygggagtatgtaaagtgtttctgttaatggaaaaagtgctgtgtgaggatgggggttaagtgactggactgtttgtgttctgagctttctaggactgatct

SEQ ID NO: 68548 - DNA, 201 bp, Homo sapiens
cctgatccttcctctggaagcttcgtccaagaaggacacccacctatatgaggtgtctgtcggcccctactgggaggtgtctcctcccagtcaggctacawggggctcagggacccacttgaggaggcagtctgtccgttactggagttcaaatgccgagctgggagaaccactgctctcttcagagctgtcaggcaggga

SEQ ID NO: 68549 - DNA, 201 bp, Homo sapiens
cttgagccactgcgcccggccttttttttttttttttttttttaattattgagacggagccttgcgctgtcaccgaggctggagtgcactggcactgtctyggctcactgcaacctccgcctcccgggttcaagcgattctcctgcctcagcctcccaagtagctgggattacaggcatgtgccaccatgcccagctaatt

SEQ ID NO: 68550 - DNA, 201 bp, Homo sapiens
ctaggtattcgggaggctaaggcacaaggatcccttgagcgcaggagctcaaggttggattgagttgtaatcacaccactgcactccagcctcggtggcasaatgaaactgtctcaagaaaaaaaaaaagtgacagagggaaacaatatttgcaattcatagagcagatacagggttcatattcctaatattaaaaaaaac

SEQ ID NO: 68551 - DNA, 201 bp, Homo sapiens
ggagaccaaggcaggaagatcactgaagccagggtatcgagaccagcctggacaacgtagtgagaccttatctcttaaaacaaaacaaaacaaaacaaaamaaaaaaaacagtaaaaattggccgggcacagtgactcctgcctataatcccagcactttgggaagcccaggtgagtggatcacttgaggtcaggtgtttg

SEQ ID NO: 68552 - DNA, 201 bp, Homo sapiens
cacagtgactcctgcctataatcccagcactttgggaagcccaggtgagtggatcacttgaggtcaggtgtttgagaacagcctggccaacatggcaaaaytccgtctctactaaaattacaaaaattagccaagtgtggtggcatacgctggtagggccagctacttgggaggctgatgtgagactccatttaaaaaaaa

SEQ ID NO: 68553 - DNA, 201 bp, Homo sapiens
aaaattagctgggtatagtggcacacccctatagttctcgctccttgggaggttgaggcaggaggattgcctgagcccaggagttcaaggctgcagtgaaycatgatcacaccactgcattctagcagcctgggagacagagcaaaacccttgtctcaaaacaaacaaacaacaacaaaaaaacaaaaaacacttccctca

SEQ ID NO: 68554 - DNA, 201 bp, Homo sapiens
gtgtgcagccagggttgagaaaccactcttgtcttacccctcttttgcagacacagggctcagagaagggaaggggattgtctggggatgtatagtgaggsagtggctgccttggaagtggagtctcagtctcccggctcctaggccagcccctgaccactgttccattgtctcccagacagaacatcagccacgggcatg

SEQ ID NO: 68555 - DNA, 201 bp, Homo sapiens
gctcctccatgctggggcattgcatcactgctttattcctttttatcgcctagtattattccactgtgtggatagaccacatttatccattcatcagttgraggatatttgggttcttcccattttttttggctatggtgaatagtactgtgtacatttgcatataaggttttgtgtagatgtgtgttttcctttttcttg

SEQ ID NO: 68556 - DNA, 201 bp, Homo sapiens
ctttctttaaaaagagtggcagccgggcacagtggctcacgcctataatcctagcactttgggaggccaaggcaggtggatcacttgaagtcaggagttcmagaccagcctggccaacatggtgaaactctatctctactaaaaatataaacattaggccaggtgtggtggcaggtgcctgtaatcccagctactcgggag

SEQ ID NO: 68557 - DNA, 201 bp, Homo sapiens
tcccagatgtcatcacctacctttcgagactcagaaaccagagtgtgtttaacttctgtgctattccacaggtagggaacggggctcctctgggtggatayggggctaaagggagtggggtaggagtaagggtggattttgctgtgctatattcaaggatatgattccttaaaaagacgatgactccagtttattacgctg

SEQ ID NO: 68558 - DNA, 201 bp, Homo sapiens
tttattacgctgggagtttcatagcacccgcctttgcttccagccaccaaactcagctcagccttgaggttaagcctgctccttttcagaaccttctttcyggatttactattttctacagctatcctaaactagttaggttcttttcctcacagttaagtcaaggtctttggcttagatttatggggagtgctgggtaaa

SEQ ID NO: 68559 - DNA, 201 bp, Homo sapiens
gatgtagccaggacttggtctccttggaagacaggtctgatgtttggccaatccagtccttcagaccctgtctgaaacttgtatcttacgtgaacttaaaraataaaatgcatttctaccccgatctcgcccccaggactggcacgacaggcccacggcagattagatcttttcccagtactgatcggtgcgtggaattcc

SEQ ID NO: 68560 - DNA, 201 bp, Homo sapiens
ggaataaaaagtaaggtgcttttaaagtgtgacaagggtcaaccaatatagtcagactcatccttaaaagaccttaagtcactcatccctggccactcctrctgtgggcccactagcacagtcctcaacaccacaaggcttctggagccgtggggcacacctccacgggcaagccccctgcccggtcacccttcccatcac

SEQ ID NO: 68561 - DNA, 201 bp, Homo sapiens
tttccacgtaagtggaaaggtaaaggtatgtacaatagggtggctcctggctgaacctggagctgcagacaggttttctagaaggcataatcctgaagttsagacttgggggcctaggtaggagccagttgaagggacgtgggaggcgcattccagagagaaggagtggtatgagactggaacagaggtgtgcagcagcat

SEQ ID NO: 68562 - DNA, 201 bp, Homo sapiens
acacctaagtcagactgagggagctggattaggggctctctaacaaatagcaccatcacataacatgtctgtttcttcctctgcattgtaagctccttggstgtggaaccttatcttactcatctttgttttttcccatgtctcctgccacattgtagatgttcagccaatgtttgttgcatttaaagaacagataaagaa

SEQ ID NO: 68563 - DNA, 201 bp, Homo sapiens
atttggtcggctgtctgaaccccacctctggagtcgaatctcgccttctatctcattttgagttccttggactgcctgcagcagcggttgtttaagccatrgttctgttatatagtgtctggctgttatccattcgtatgttcagcttccaagtggacacctaagtcagactgagggagctggattaggggctctctaaca

SEQ ID NO: 68564 - DNA, 201 bp, Homo sapiens
cgccgccgtgggctcctgcgcggcccaagcctccccgacgagcgccaccccctgttccacggcgcccagtcccgtcgaccgcccaagagctgaggagtgcsggcggatggcacgggagtggcaggcagctccacctgcggccctgcgcgggatccactgggtgaagccagctgggctcctgagtctggtggggacttggag

SEQ ID NO: 68565 - DNA, 201 bp, Homo sapiens
ccgccgccgtgggctcctgcgcggcccaagcctccccgacgagcgccaccccctgttccacggcgcccagtcccgtcgaccgcccaagagctgaggagtgygggcggatggcacgggagtggcaggcagctccacctgcggccctgcgcgggatccactgggtgaagccagctgggctcctgagtctggtggggacttgga

SEQ ID NO: 68566 - DNA, 201 bp, Homo sapiens
acctgggccagcagccgccgtgcttgatttctcaacaggccttagctgcctccccgcggggcagggctcgggacctgcagcccgccatgcctgagcctccsccgcgccgccgccgtgggctcctgcgcggcccaagcctccccgacgagcgccaccccctgttccacggcgcccagtcccgtcgaccgcccaagagctgag

SEQ ID NO: 68567 - DNA, 201 bp, Homo sapiens
tcaagaggtaacagattcagggtattttgggggaaaataactttagacattctctgaaaaatcctttaactcttgtggttgcgggtgacagaaaaacaagycaggcctcccccaggcagcataaggggatgtggaaaataggatagattgacatgagtttgcttcaggtagactggctgactcccaggattcacaccacgt

SEQ ID NO: 68568 - DNA, 201 bp, Homo sapiens
atatttgtattttaaaatcaaaatgcattcttacccattctcttttgaacctgcttttttgtagctaatgatctctagtgtgtccatttcagtaaaaattscattattaaagtgctttaaaaatcgtctcttacagtactgccactatgttgctgggctggtcggaattggcctttcccgtcttttctcagcctcagagtt

SEQ ID NO: 68569 - DNA, 201 bp, Homo sapiens
tatatttgtattttaaaatcaaaatgcattcttacccattctcttttgaacctgcttttttgtagctaatgatctctagtgtgtccatttcagtaaaaatkccattattaaagtgctttaaaaatcgtctcttacagtactgccactatgttgctgggctggtcggaattggcctttcccgtcttttctcagcctcagagt

SEQ ID NO: 68570 - DNA, 201 bp, Homo sapiens
tgccaccaatatgccagctgtcaaagccatcatatatcagtatatggaagaggtgggtttttatttaactacttggataatttgtagctacttttatgatktagtaatgtcactgtttaaccaggtttggatattagatgatcctaacaattcactatcctgtggcctaaagagacaggaattgatatcctttataaggaa

SEQ ID NO: 68571 - DNA, 201 bp, Homo sapiens
atttcctaaattttctttggaaaatttcatttcaaataccaaaaccatcctataaaaagaaaacttaccttcttaggtcaaatctctaatatttgactagrttcaaaaagtttatttctggccaggcacagtagcttactcctgaaatcccagcactttgggagaccaaggtgggaggatcacttgaggccaggaattcaa

SEQ ID NO: 68572 - DNA, 201 bp, Homo sapiens
ttatgaaaacatacaagaccctcatcatttttcctttgcctgagctccctccccagaggttacctctgttcatggttttgtgcatccgtctagtccccctrttacgcgtttacaggaatatggtttgcaacagtgttttcatctaaatagaattatacaaaatagcgatttctgatttctcttgcatattgcacattcttc

SEQ ID NO: 68573 - DNA, 201 bp, Homo sapiens
cataatttgaacccaggtctgtctgacatcagaatccatgatgttaaccccaattctaaggggttcaactaccctttctaaatggaatcctgctatattargcactatttattcattttatataaactagaaacattttatgtagtaagtagttgagagtgttttggttttgcagtttgatcactagttttagaaaccagt

SEQ ID NO: 68574 - DNA, 201 bp, Homo sapiens
ctaaaaatacaacatttagccaggtgtggtggtgcacacttgtcatcccagctattccggagcctgagacatgagcatcgcttgaactcgggaggtggagkttgtagtgagctgagatggcaccactgcactccagcctgggcaacagggtgaaggccctttctcaaacccctcaagtatttggcttcaactttatgccgg

SEQ ID NO: 68575 - DNA, 201 bp, Homo sapiens
catgagcatcgcttgaactcgggaggtggaggttgtagtgagctgagatggcaccactgcactccagcctgggcaacagggtgaaggccctttctcaaacycctcaagtatttggcttcaactttatgccgggcatgtagatgaaaagtcggctatgacctgtccttgacaagcagatgtaactccttgattgaggctagt

SEQ ID NO: 68576 - DNA, 201 bp, Homo sapiens
gtttttaagacctgaataattgagtttgcagaaacctactgtgtgccttcaggtaaatggagagtggggtttggtctagcaacgaagcatctagaaggtcyctttggccttaccggctctgttttaggtaagtccacgtctgagtaccagtgactgcagctcttccagttgtgctgtcatgcttatatgttagaaatgatc

SEQ ID NO: 68577 - DNA, 201 bp, Homo sapiens
ggacttaatttgaaaatcatttgccaggccacatagttatcaattttctttctagcagctattctgttgtatttttaaaacattttttagatgactttttraagtctatttagcagtaaccttaagaggtgcaaattagtaaaataaatctcttgtaatttagccttcatcaaataataggtaccaatgtattaaaaatat

SEQ ID NO: 68578 - DNA, 201 bp, Homo sapiens
acgaagcatctagaaggtccctttggccttaccggctctgttttaggtaagtccacgtctgagtaccagtgactgcagctcttccagttgtgctgtcatgyttatatgttagaaatgatcatcaaaggactcaaaagttttgccactaattgtattaccggggactgtcacaaccaagatttctcttaatttattcacctt

SEQ ID NO: 68579 - DNA, 201 bp, Homo sapiens
aaacggacaaatcagctctctgtaaaacagaccaatcggctttctgtaaaatggaccaatcagcagggtgtgggtggggccagataagagcataaaagcgsgctgccttaaaaaaaacggtggcaacacgctgggtttgctttacaacgcctgggaagctttgttgtttgcaataaattttaatacttgtctgtttcggtc

SEQ ID NO: 68580 - DNA, 201 bp, Homo sapiens
aaaaaaaaaaaaaaaaaaaaaaaaaaaatacaaaagttagttgggcatggtggcaggtgcctgtaatcccagctacttgggaggctgaggcaggagaatcrcatgaacctgggaagtggaggctgcagtgagccaagattgcaccactgcactctagcctgggtgacagagcgagacaccatcttaaaaaaaaaaaaaaat

SEQ ID NO: 68581 - DNA, 201 bp, Homo sapiens
cattctcctgccttagccttctgagtagctgggactacaggcacccgccaccaggccagctaatttttttgtatttttagtagagacggggtttcaccgtsttagccaggatggtcttgatctcctgatctcgtgatccgcccgtctcagcttcccaaagtgctgggattacaggcatgagccatcgtgcccggctgaatg

SEQ ID NO: 68582 - DNA, 201 bp, Homo sapiens
ttgcttgtacagttgctctgagaaggtaagtcttaaattttcaaaagtgaaatgtcaccgagcatggtggcttatgcctctaatctcagcactttgggagrctgaggcaggcggatcacttgaggtcaggagttcgaaaccagcctgacttatgtgatgaaaccctgtctctactaaaaaaaaaaaaaaaaaaaaaaaaaa

SEQ ID NO: 68583 - DNA, 201 bp, Homo sapiens
tagttatcaattttctttctagcagctattctgttgtatttttaaaacattttttagatgactttttgaagtctatttagcagtaaccttaagaggtgcawattagtaaaataaatctcttgtaatttagccttcatcaaataataggtaccaatgtattaaaaatatgtggtttttttttttttggcagccctttgaacc

SEQ ID NO: 68584 - DNA, 201 bp, Homo sapiens
actataactgaaattaaaggaggcggcagtgaagaggaaataattatcttctatctaaatgatatacatatgatattttgagatttttataactgcagtgsaacacaattctgggtagagtagaaaaaggaatggtttaaagacatataaaagattcttgttgacaatttatttttggtagcaaatctcaaatgattacct

SEQ ID NO: 68585 - DNA, 201 bp, Homo sapiens
taaattttcaaaagtgaaatgtcaccgagcatggtggcttatgcctctaatctcagcactttgggaggctgaggcaggcggatcacttgaggtcaggagtkcgaaaccagcctgacttatgtgatgaaaccctgtctctactaaaaaaaaaaaaaaaaaaaaaaaaaaaaaaatacaaaagttagttgggcatggtggcag

SEQ ID NO: 68586 - DNA, 201 bp, Homo sapiens
gtgaaaaacgggggatttaacatagattttcacagtggctttagacatttcataaatatttcttaaatgcctcctaaatgctaggatttggcaatacaagrctaaacaaaatacaaagccaaatcctactgtaacgggagtatgtaaagtgtttctgttaatggaaaaagtgctgtgtgaggatgggggttaagtgactgg

SEQ ID NO: 68587 - DNA, 201 bp, Homo sapiens
tctcggcttcccttatccaactttgcatttctatttctagcatattgggttgattcttttgaagctgcctctgtgcacattacacccatgaacttagaccmgttgcctttatgtatgatcgtatttatactgagaagttactgtgttttttgactttcttttctatttgctacatattagttcggtctaaacgtttggtct

SEQ ID NO: 68588 - DNA, 201 bp, Homo sapiens
agaggaaataattatcttctatctaaatgatatacatatgatattttgagatttttataactgcagtgcaacacaattctgggtagagtagaaaaaggaawggtttaaagacatataaaagattcttgttgacaatttatttttggtagcaaatctcaaatgattacctgctattaagggctgccatatcagagttttgca

SEQ ID NO: 68589 - DNA, 201 bp, Homo sapiens
gttttctaaatgttgttctccaagcaattgtatgtttggattgcagaagaatttgtaagatgaacttttttttaatgtgcattattaaaaatgttgagtgragcaattgtcacctttattaaggaggattgctttgtgcccaccacctagtgtaaaataaaatcgagcaatacagtcttaaatgttgtggccttttttgat

SEQ ID NO: 68590 - DNA, 201 bp, Homo sapiens
tccggacgcagaatcttcccaactgtcagctgatttcccgaagccactactcccccatctacctgtcgtttgtcatgcttttggctgccctgagctggcartacctgaccactctctcccaggtaacagaagactatgttcagactggagaacactgatcccaaatttgtccatagctgaagtccaccataaagtggattt

SEQ ID NO: 68591 - DNA, 201 bp, Homo sapiens
tgtatttcggcctttgccccagtagatcagacaatgacattctagtcttgatgttactaagttttagcagacactagcaagtggtttgtatttaaccacasccatgaagcagacagactgaggcacagattttagtggctttgtggcaataaatagggcatggtgtgccttaggaaaagaatgtttataaagggaactata

SEQ ID NO: 68592 - DNA, 201 bp, Homo sapiens
taataaaaattgtgaaagcttactggcctaacattttattttataatattgagtatgaattatatgtagccagagatgtcaataaggcttactgtcagtasgtaatatggttagtttgtagggaaaagagcgtatgagcacatgcttgtgtatttcggcctttgccccagtagatcagacaatgacattctagtcttgatg

SEQ ID NO: 68593 - DNA, 201 bp, Homo sapiens
taaaatcgagcaatacagtcttaaatgttgtggccttttttgatcataagagttggtactgtttaaggccaaaagtaatagtttttataaatcttttagtytcaactgagcttttacaataaaaaggatttgtattgcattgagtttataaacttttggtttgtgaaatccatatttgatctgttttcttccaatcaaatg

SEQ ID NO: 68594 - DNA, 201 bp, Homo sapiens
ggactcaaaagttttgccactaattgtattaccggggactgtcacaaccaagatttctcttaatttattcaccttacttatctcctggaagggcatattgragtgctcttggagttctctaaaagggtttttgttggttgtgtatattcacttgggtgccagcgattgattccaaataagtaaatcttttttcccaaaagg

SEQ ID NO: 68595 - DNA, 201 bp, Homo sapiens
ttgtaagttggattcctaggtgttgtattctctttgtagctattgtgaatgggagttcactcatgatttggctccttgtttgtctgttattggtgtatagsaatgcttgagattttttgcacattgattttgtatcctgagactttgctgaagttgcttatcagcttaaggagatttagggctgagacgatggggttttct

SEQ ID NO: 68596 - DNA, 201 bp, Homo sapiens
gccttggaagtggagtctcagtctcccggctcctaggccagcccctgaccactgttccattgtctcccagacagaacatcagccacgggcatgtgatgcaygagcgtgagccacaccatcttgcacacacaggagcagagccctgctcttctcattcacttactttatctgtaaaatagcatcatttctaccacacggtgg

SEQ ID NO: 68597 - DNA, 201 bp, Homo sapiens
ttgggcttggcaggtgatcaaattcgaggtcatgatgaccttcaggagagcactgtgtgcagagtgccagcagtgggaagggaccgggtgggagggaggaygtggaatgtgagggtggtctcccctgcaggaagtttggccttggaggggatgaaaatgaagggcagggaggagtcgcgagcgaacaagcaggagggtgtt

SEQ ID NO: 68598 - DNA, 201 bp, Homo sapiens
gtctataggcagtgacaaaggatctgagatcccatcagagtagacttcaagttggagaaaccttttattggcacaggcattccttgttaacttgacagggkgaagctgtaatttttcaaaaacagtaaaagctggtttctcctaaactattttccttgtggtagtagagatcagtgggtcagaaacaactcctgaccactt

SEQ ID NO: 68599 - DNA, 201 bp, Homo sapiens
gtgttctgtgtagttattgcttagtctgcagaaaataatgacctagatgagatgtctgacttgctttcacttattaaacatgttcaccatgggatgatgtstgtaacgtcagatattgttaaactagactaggatttaataaaaattgtgaaagcttactggcctaacattttattttataatattgagtatgaattatat

SEQ ID NO: 68600 - DNA, 201 bp, Homo sapiens
agctattctgttgtatttttaaaacattttttagatgactttttgaagtctatttagcagtaaccttaagaggtgcaaattagtaaaataaatctcttgtmatttagccttcatcaaataataggtaccaatgtattaaaaatatgtggtttttttttttttggcagccctttgaaccagagtaagttcagagaaactccc

SEQ ID NO: 68601 - DNA, 201 bp, Homo sapiens
ctatttagcagtaaccttaagaggtgcaaattagtaaaataaatctcttgtaatttagccttcatcaaataataggtaccaatgtattaaaaatatgtggtttttttttttttggcagccctttgaaccagagtaagttcagagaaactcccaaaatttgtattttagacacgtcatgcttgattggtaacttccctcctt

SEQ ID NO: 68602 - DNA, 201 bp, Homo sapiens
tttgttttcatacatcttccttggagatgtctgaatataatactccatctatgaatattttaaatgttgaaataaaagtaagaaatgtgaaaaaaaaaaawgaaggctagggaggagagcaaaggatgaatataacgtgaaaatgtatgtatagttagttcaggggagaaaaccaggagagagagagagaaagctcacacc

SEQ ID NO: 68603 - DNA, 201 bp, Homo sapiens
ctggtgcagtggctcacgcctgtaatcccagcactttgggaggctgaggcaggaggattgcttgaccccgggagttcgagaccagcctgggcaacatagcragaccccatctctacaaaaaatacaaaaattagccaggcatggtgatgcatacctgtagtcccagctactagggaggttgaggtggaaggatcacttgag

SEQ ID NO: 68604 - DNA, 201 bp, Homo sapiens
caaaaggaagggggtacaatgagggctatctgatctcctgtcccgttatttgaaatgctttttccctggtgctgtaaagaaatagcacttgtaggctgggmgccgtggctcacgcctgtaatcccagtacctggggaggctgaggcgggcggatcacgaggtcaagagattgagaccatcctaaccaacatggtgaaaccc

SEQ ID NO: 68605 - DNA, 201 bp, Homo sapiens
aacaaaggcccggctccatcagggcaccaatcccgctcgtcggcctctttctcggcctccaatgagcttctagggtgttatcacgccagtctccttccgckactgattggccggggtcttcctagtgtgagcggccctggccaatcagcgcccgtcagcccaccccacgaggccgcagctagccccgctggcggccgaggc

SEQ ID NO: 68606 - DNA, 201 bp, Homo sapiens
ctccttccgcgactgattggccggggtcttcctagtgtgagcggccctggccaatcagcgcccgtcagcccaccccacgaggccgcagctagccccgctgscggccgaggccggttgaagtgggcggagcggcgggcggggcgtcgccgtactaggcctgccccctgtccggccagcccctcgaagcacctactccacagg

SEQ ID NO: 68607 - DNA, 201 bp, Homo sapiens
ttatgtgatgaaaccctgtctctactaaaaaaaaaaaaaaaaaaaaaaaaaaaaaaatacaaaagttagttgggcatggtggcaggtgcctgtaatcccasctacttgggaggctgaggcaggagaatcgcatgaacctgggaagtggaggctgcagtgagccaagattgcaccactgcactctagcctgggtgacagagc

SEQ ID NO: 68608 - DNA, 201 bp, Homo sapiens
gaggttgtagtgagctgagatggcaccactgcactccagcctgggcaacagggtgaaggccctttctcaaacccctcaagtatttggcttcaactttatgycgggcatgtagatgaaaagtcggctatgacctgtccttgacaagcagatgtaactccttgattgaggctagtaggtttttaagacctgaataattgagtt

SEQ ID NO: 68609 - DNA, 201 bp, Homo sapiens
caggcggatcacttgaggtcaggagttcgaaaccagcctgacttatgtgatgaaaccctgtctctactaaaaaaaaaaaaaaaaaaaaaaaaaaaaaaatmcaaaagttagttgggcatggtggcaggtgcctgtaatcccagctacttgggaggctgaggcaggagaatcgcatgaacctgggaagtggaggctgcagtg

SEQ ID NO: 68610 - DNA, 201 bp, Homo sapiens
cttgaacctgggagccagaggttgcagtgaaccaagatcgcgccactgcactccagcctcacgacagagtgagactccatttaaaaaaaaaaaaaaaatgwagaagaaatagcactcgaaggctgggcgcagtggcttgcctgtaatcctagcactttgggaggccgaggagggtggatcatgaggtcaggagttcaagac

SEQ ID NO: 68611 - DNA, 201 bp, Homo sapiens
taaagtcataggagccacagaattaacccaggaatgaataagtgtgtagtttggtgctgatgttatcatcctttatttgtacattgcttgtacagttgctytgagaaggtaagtcttaaattttcaaaagtgaaatgtcaccgagcatggtggcttatgcctctaatctcagcactttgggaggctgaggcaggcggatca

SEQ ID NO: 68612 - DNA, 201 bp, Homo sapiens
tcccaaaaggatgtaagatggcttatggttataagtacaacaggctaacaaagtacaagtagatgagaaagtaaaatgaagaaataaagtcataggagccmcagaattaacccaggaatgaataagtgtgtagtttggtgctgatgttatcatcctttatttgtacattgcttgtacagttgctctgagaaggtaagtctt

SEQ ID NO: 68613 - DNA, 201 bp, Homo sapiens
attcacttgggtgccagcgattgattccaaataagtaaatcttttttcccaaaaggatgtaagatggcttatggttataagtacaacaggctaacaaagtmcaagtagatgagaaagtaaaatgaagaaataaagtcataggagccacagaattaacccaggaatgaataagtgtgtagtttggtgctgatgttatcatcc

SEQ ID NO: 68614 - DNA, 201 bp, Homo sapiens
cccacctcagccttcaaagtgctgggattacaggtgtgagccactgcacccaaccagtttctctctgcaaactagggaaaaaatttacgcttagcagataytgagggctgattatttctatcacagaagcatttggctatagaatttcagggtttagtaaacttgatttacactgaatttttaggtgcatatcagtaaatc

SEQ ID NO: 68615 - DNA, 201 bp, Homo sapiens
ctttgagccccaggtgcctagctgctcaaggatggtccccagccagcagctgccaggaatcacctgggagcccattaagacatccagcccccacccaaacstatcgaatcagaatctgcctttttttcccaaatgatgtttttgctttaatggaagtttagatgttcatagacaagagttttaaatgatgatcaagctgat

SEQ ID NO: 68616 - DNA, 201 bp, Homo sapiens
aagatcaacctgctattttgggatagaaataaatgctcagccaaacggccagaaacccccattcccctctctgccaaagtgaattccttggcagggagaakcttgttcgtgtctctgcacacttcctgtgccctcctgtggttaagtcagagaatcatccggctctttgagccccaggtgcctagctgctcaaggatggtc

SEQ ID NO: 68617 - DNA, 201 bp, Homo sapiens
tgtgacggccgagttgaggagctgcaacaggcgatgacttgtaaagctgaaaatattttttggcccttgaataagaggttggctgacttctgacttagggyatcagttgttctgttatcccagtaaaactcaaggcattaggggagaaatgttaatattaatacttaagttgatttgatttagggaaatctttgaagattt

SEQ ID NO: 68618 - DNA, 201 bp, Homo sapiens
ttctgtggctgcttttgcaatgtgacggccgagttgaggagctgcaacaggcgatgacttgtaaagctgaaaatattttttggcccttgaataagaggttkgctgacttctgacttagggcatcagttgttctgttatcccagtaaaactcaaggcattaggggagaaatgttaatattaatacttaagttgatttgattt

SEQ ID NO: 68619 - DNA, 201 bp, Homo sapiens
agggaatcctagagaaagtcttgtgtttaaggagcaagacaggaaggagaaaccagtcagtgagatgggtcaaatgtaagtggagaaaggaacgtccaagsagaagcgggctgtcgctatggtgaatcatgcagagatgaaggcgggacgatggagcagtggccccttgggcttggcaggtgatcaaattcgaggtcatga

SEQ ID NO: 68620 - DNA, 201 bp, Homo sapiens
tggccttccgaagtgcagggattataggcgtgcgccactgcacccggccctgttggataaatgattccagtctctcccaaaaagaactgttgtaagactgkggggtgaggggagggaagggacaaataggaacccgccgtattttccactccctgtgggcctaaaactgctctaaaaaatagtccatgaaaaaatacatag

SEQ ID NO: 68621 - DNA, 201 bp, Homo sapiens
ttctgtaagtattagctatttggtctattttgttggagtaaagtgggttatagttaaaatcctaagatttttaaagtccctcaagttcatgtggacatctrcctaggtcctactatcctagaattcgcatgtcttatcacacaaataactgattcttccatatcttataaataaaggtttgatttagcaaagtcacatgtt

SEQ ID NO: 68622 - DNA, 201 bp, Homo sapiens
gctaaggcaggagactcacttgaacctgggagccagaggttgcagtgaaccaagatcgcgccactgcactccagcctcacgacagagtgagactccatttaaaaaaaaaaaaaaaatgaagaagaaatagcactcgaaggctgggcgcagtggcttgcctgtaatcctagcactttgggaggccgaggagggtggatcatg

SEQ ID NO: 68623 - DNA, 201 bp, Homo sapiens
tgccgactgtatgatgcagcctacctgtaacactgctggcctcttgactacccggagcctggtagcatgggactgctgctcacgatgggcagcagcctggyatgggggcggtgtctgttggcagctagggcgagcctctgccacttcacctgtgatcctgggcaagttccttatctgctttgtgtctccgtctcctcgttt

SEQ ID NO: 68624 - DNA, 201 bp, Homo sapiens
agactccatttaaaaaaaaaaaaaaaatgaagaagaaatagcactcgaaggctgggcgcagtggcttgcctgtaatcctagcactttgggaggccgaggakggtggatcatgaggtcaggagttcaagaccagtctggccaacatggtgaaaccctgtctctactaaaaatcgaaaaattacccaggcgtggtggttgggc

SEQ ID NO: 68625 - DNA, 201 bp, Homo sapiens
actaagcaggccatttttacttcctgcagaaagggtacactcgccagcagttttgccatgggagtataccaaacaaaggagacagggtcatttataacctsactcgtccaccccactgcttgtgtctagtttccattggctggaacggtgcctcacgttctgtatttgtcccgattggctagcaacttagaagtttttaaa

SEQ ID NO: 68626 - DNA, 201 bp, Homo sapiens
agtagagacgcagtttcagcatgttggccaggctggtcttgaactccagacctcaggtgatccgcccgccttggcctcccaaagtgctgggattacaggcrtgagccaccgcgctcggctagacctgacaggttttaaaaggattactggttgctgtgttaaaacagactgcaggatggcttaggtagccagtaggttttt

SEQ ID NO: 68627 - DNA, 201 bp, Homo sapiens
aaaaaatacctgaacctttaattaggggaaataaattggaaaaatacatttcccttcacttaacattatcttagtttctcttttttttttttttttttttwgagatggagtcttgctctgttacccaggctggagtgcagtggtggcgggacctcagctagatgcagcctccgcctcctgggttcaagcaattctcctgcc

SEQ ID NO: 68628 - DNA, 201 bp, Homo sapiens
tgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggc

SEQ ID NO: 68629 - DNA, 201 bp, Homo sapiens
aatattttttatggcaataaaatgactttttcaggattatgtgatttaaaagattgacccttttggcaaaatacgtattcatgataggaaatatatacaawatagttcacttaaacctcccaccagagcccagggttcactgttaccattctgaagtgactggaatttcctagaagtggatatgccatatttttttaacca

SEQ ID NO: 68630 - DNA, 201 bp, Homo sapiens
cttcagtagctagactataggtgggcgccaccacagctggctttttaaaaaattttttatgaacacgaggtctcactatgttgcccaggctgccctcaaaytcctgggctcaagtgattctcccaccttggccttccgaagtgcagggattataggcgtgcgccactgcacccggccctgttggataaatgattccagtct

SEQ ID NO: 68631 - DNA, 201 bp, Homo sapiens
ccccctgcccggtcacccttcccatcacaggatctggcgcgatgctgtgggaactgttgcaggcgttggctctgaagctgctcagagtctgccctcacagyaaaagggaactcctgactgcctggcacttaggaggagctcacagcctggccgtaggtccagggtttaaggctgtgcggtgggtagaacagagaaagccga

SEQ ID NO: 68632 - DNA, 201 bp, Homo sapiens
caggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaag

SEQ ID NO: 68633 - DNA, 201 bp, Homo sapiens
tctagctcagggattgtaaccgcaccaatcagcaccctgtcaaaacggacaaatcagctctctgtaaaacagaccaatcggctttctgtaaaatggaccartcagcagggtgtgggtggggccagataagagcataaaagcgggctgccttaaaaaaaacggtggcaacacgctgggtttgctttacaacgcctgggaagc

SEQ ID NO: 68634 - DNA, 201 bp, Homo sapiens
taattcatagtttgagggcgagggtgggcagtctacagttggctgagccctgtttttgtgaataaatgttatcagaacacagccacacccatttgcttctwtgtcttctgtggctgcttttgcaatgtgacggccgagttgaggagctgcaacaggcgatgacttgtaaagctgaaaatattttttggcccttgaataaga

SEQ ID NO: 68635 - DNA, 201 bp, Homo sapiens
aagctgtgtgatttcatcattgcactctagcctgggtgatagagtgagactttgtctcaaaaaaaaaaaaaaaaaaaaaagtcttagagaccagaagtctytgtaatctctaataatctctaggccctagagcagtggtttgtaaatggaggtgatttgctcccctccccccagaggacattggacaatgtctggagacat

SEQ ID NO: 68636 - DNA, 201 bp, Homo sapiens
ccgctggcggccgaggccggttgaagtgggcggagcggcgggcggggcgtcgccgtactaggcctgccccctgtccggccagcccctcgaagcacctactscacaggtccagccggccggtgagcgcctggggaccgcagaggtgagagtcgcgcccgggagtccgccgcctgcgccaggatggagttcgtgaaatgcctt

SEQ ID NO: 68637 - DNA, 201 bp, Homo sapiens
gtctctaggtgatggccattgccactttggctgcctgttataataaccagcaggtgttcaaaggggcagtgaagattcggaaagggcaagcagtgaccctsatgatggatgccaccaatatgccagctgtcaaagccatcatatatcagtatatggaagaggtgggtttttatttaactacttggataatttgtagctact

SEQ ID NO: 68638 - DNA, 201 bp, Homo sapiens
aatgttggatttacttgtgtttgctttttccaaataaaatggaacttttgtggctacattatagaattgttttagactgcttaattctgtgtgttgttgaraaagggaggagtggggaaggtaaaaatcttgacatactttcttcgtgggtattttttcttgagcgattccatcttagttgattagcagttagcaattgcc

SEQ ID NO: 68639 - DNA, 201 bp, Homo sapiens
gcttgaatgtacctgggaaactacctggggtcttgggagatgcaaatgctggttcagaggtctggccctctgacactctgatgagcatttctaacaggctytcaggtgacggccgtgctcctggtctgtggaccacttcagtatggctgaagcacaataaaagagggcaaattactgctttctttaaaaagagtggcagcc

SEQ ID NO: 68640 - DNA, 201 bp, Homo sapiens
aggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagt

SEQ ID NO: 68641 - DNA, 201 bp, Homo sapiens
ggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtc

SEQ ID NO: 68642 - DNA, 201 bp, Homo sapiens
tggagccagctgaaggaacagatttctgtcattgatgatgcagtaagaaaactgtaaaatccgagtcatacaaacaaaacctgtacttttctagttgtttkaatctgtctttttacattggcttttgttttctaaatgttgttctccaagcaattgtatgtttggattgcagaagaatttgtaagatgaacttttttttaa

SEQ ID NO: 68643 - DNA, 201 bp, Homo sapiens
taaaaagtactaatatttaggtatcctgaaattatttgcagttcattttttatggaaattaatccagtgaatcacgcaaaagttttttttttaaatggtgyttttccagatcaactctagggtaaacattcacataatcacaaatatgcaattctgtaattgtgaaatgcctgtatgttttgttttcatacatcttccttg

SEQ ID NO: 68644 - DNA, 201 bp, Homo sapiens
ctgggactacaggcacccgccaccaggccagctaatttttttgtatttttagtagagacggggtttcaccgtcttagccaggatggtcttgatctcctgayctcgtgatccgcccgtctcagcttcccaaagtgctgggattacaggcatgagccatcgtgcccggctgaatgtgcagagttcttaaaaccgtgtcaagaa

SEQ ID NO: 68645 - DNA, 201 bp, Homo sapiens
aaaataaatctcttgtaatttagccttcatcaaataataggtaccaatgtattaaaaatatgtggtttttttttttttggcagccctttgaaccagagtargttcagagaaactcccaaaatttgtattttagacacgtcatgcttgattggtaacttccctccttttttggggaacatgtttgtgtcctattaacttaat

SEQ ID NO: 68646 - DNA, 201 bp, Homo sapiens
atgtagccagagatgtcaataaggcttactgtcagtaggtaatatggttagtttgtagggaaaagagcgtatgagcacatgcttgtgtatttcggcctttrccccagtagatcagacaatgacattctagtcttgatgttactaagttttagcagacactagcaagtggtttgtatttaaccacacccatgaagcagacag

SEQ ID NO: 68647 - DNA, 201 bp, Homo sapiens
gatttaataaaaattgtgaaagcttactggcctaacattttattttataatattgagtatgaattatatgtagccagagatgtcaataaggcttactgtcrgtaggtaatatggttagtttgtagggaaaagagcgtatgagcacatgcttgtgtatttcggcctttgccccagtagatcagacaatgacattctagtctt

SEQ ID NO: 68648 - DNA, 201 bp, Homo sapiens
acctagaaatactttacctttgagcacaggaaattaatccccttctggttgttctccccctggcattggttttaaatatataatgattatgtttgttgtakgaaaaatagaaaaacaactacaatagaaaattcttcccatatattattttgaaatacatatttccgatccgataatccattgctctagcatggaaaatgt

SEQ ID NO: 68649 - DNA, 201 bp, Homo sapiens
gttgcctttaccaagtattgcagatactactgcaaataagtgaagaaagtaacagcatttaactgatttgggaacttggtttgatcttgttctaatgaccmacttcgaatggtggttgaaagtaaaatctgtatcgccgtcttatgtttccatttacctagaaatactttacctttgagcacaggaaattaatccccttct

SEQ ID NO: 68650 - DNA, 201 bp, Homo sapiens
caggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaa

SEQ ID NO: 68651 - DNA, 201 bp, Homo sapiens
aggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaac

SEQ ID NO: 68652 - DNA, 201 bp, Homo sapiens
ggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaacc

SEQ ID NO: 68653 - DNA, 201 bp, Homo sapiens
gaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaacca

SEQ ID NO: 68654 - DNA, 201 bp, Homo sapiens
taaccaatgcactgcaccacatcccagatgtcatcacctacctttcgagactcagaaaccagagtgtgtttaacttctgtgctattccacaggtagggaasggggctcctctgggtggatacggggctaaagggagtggggtaggagtaagggtggattttgctgtgctatattcaaggatatgattccttaaaaagacga

SEQ ID NO: 68655 - DNA, 201 bp, Homo sapiens
attgcctgagcccaggagttcaaggctgcagtgaaccatgatcacaccactgcattctagcagcctgggagacagagcaaaacccttgtctcaaaacaaasaaacaacaacaaaaaaacaaaaaacacttccctcagctcagacatggccttttaagtttcctaggtgactcgtgtgcagccagggttgagaaaccactct

SEQ ID NO: 68656 - DNA, 201 bp, Homo sapiens
cattttaactatttttaagtctattattcagtggcattaagtacattaatgatgttatataaccatcaacactatgtttccagaactttcgctagcttcasagaatcctctaaataatatcattaaaaatcatcaagccgaatcccactgttagaattaaaggttttatttcactttcaagttatcaggatccagggaggt

SEQ ID NO: 68657 - DNA, 201 bp, Homo sapiens
ctgtgctgcttgtggctcatggcagagcattcagtgccacggtttaggtgaagtcgctgcatatgtgactgtcatgagatcctacttagtatgatcctggytagaatgataattaaaagtatttaatttgaagcaccatttgaatgttcgtaatagtagaaaatgatgtgaattttctttctgttcggctcctatttttct

SEQ ID NO: 68658 - DNA, 201 bp, Homo sapiens
tggatagaccacatttatccattcatcagttggaggatatttgggttcttcccattttttttggctatggtgaatagtactgtgtacatttgcatataagkttttgtgtagatgtgtgttttcctttttcttgggtctatgctgagaagtggaattgctggttcatacagcagctcgaaccttgtgaggagctgccagacg

SEQ ID NO: 68659 - DNA, 201 bp, Homo sapiens
ctgggtatagtggcacacccctatagttctcgctccttgggaggttgaggcaggaggattgcctgagcccaggagttcaaggctgcagtgaaccatgatcrcaccactgcattctagcagcctgggagacagagcaaaacccttgtctcaaaacaaacaaacaacaacaaaaaaacaaaaaacacttccctcagctcagac

SEQ ID NO: 68660 - DNA, 201 bp, Homo sapiens
gcagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtct

SEQ ID NO: 68661 - DNA, 201 bp, Homo sapiens
cagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtcta

SEQ ID NO: 68662 - DNA, 201 bp, Homo sapiens
agctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctat

SEQ ID NO: 68663 - DNA, 201 bp, Homo sapiens
aagtgtgtagtttggtgctgatgttatcatcctttatttgtacattgcttgtacagttgctctgagaaggtaagtcttaaattttcaaaagtgaaatgtcmccgagcatggtggcttatgcctctaatctcagcactttgggaggctgaggcaggcggatcacttgaggtcaggagttcgaaaccagcctgacttatgtga

SEQ ID NO: 68664 - DNA, 201 bp, Homo sapiens
gctggtaccagttgttcctttccatttttactgcttccttcaggagctcttttagggcaggcctggtggtgacaaaatctctgagcatttgcttgtctgtraaggattttatttctccttcacttgtgaaacttagtttggctggttatgagattctgggttgaaaattctttaagaatgctgaatattggcccccactct

SEQ ID NO: 68665 - DNA, 201 bp, Homo sapiens
gatctgagaacatagaaatctactgtgttgtgaaacagaattacctggaagcggaaaaagccctcctggctcaattcacatgtcacggcttatggtcgtayccggggaacatatgaaactgggcactgagtgcggagtcaggaaagccctgtccatcctctgggtttctggggaaaacgtggaccccttcattgtcacttt

SEQ ID NO: 68666 - DNA, 201 bp, Homo sapiens
cttattaaacatgttcaccatgggatgatgtctgtaacgtcagatattgttaaactagactaggatttaataaaaattgtgaaagcttactggcctaacaktttattttataatattgagtatgaattatatgtagccagagatgtcaataaggcttactgtcagtaggtaatatggttagtttgtagggaaaagagcgta

SEQ ID NO: 68667 - DNA, 201 bp, Homo sapiens
ttaaaagtatagccttaatagtgagagaaactctatagcttcataatataaattgggtaactaatgagataaaatggttggcagatctgctcactagaatytaagctcttcaagggtctgagtttttttttttctttttcttttattatactttaagttctagggtacatgtgcacaacgtgcaggtttgttacataggta

SEQ ID NO: 68668 - DNA, 201 bp, Homo sapiens
tcccactcccactcccactcctgctcctcgacgtctcccaccgccgtgtgtgttgtctgcccgcaggactcgctcagcagcagcctgaaaacttgctacargtatctcaatcagaccagtcgcagtttcgcagctgttatccaggcgctggatggggaaatgcggtgagtgatggaggcagcgcctctggcttggaggaaa

SEQ ID NO: 68669 - DNA, 201 bp, Homo sapiens
gaaaaattcacatttaaactactctgggggctgggcaaggtggctcacgcctgtaatctcaacactgggagaccaaggcaggaagatcactgaagccaggrtatcgagaccagcctggacaacgtagtgagaccttatctcttaaaacaaaacaaaacaaaacaaaacaaaaaaaacagtaaaaattggccgggcacagtg

SEQ ID NO: 68670 - DNA, 201 bp, Homo sapiens
tgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggc

SEQ ID NO: 68671 - DNA, 201 bp, Homo sapiens
agatgctgagtcttactcctaagaaaaattcacatttaaactactctgggggctgggcaaggtggctcacgcctgtaatctcaacactgggagaccaaggyaggaagatcactgaagccagggtatcgagaccagcctggacaacgtagtgagaccttatctcttaaaacaaaacaaaacaaaacaaaacaaaaaaaacag

SEQ ID NO: 68672 - DNA, 201 bp, Homo sapiens
tcagatagtgttctaggtgctggaggtacaacagtgaacaagctaggtgaagaccttgattttataaaacttactttttagtggaagagagacaatttaaraaagcgaatgtacagtttttcacgtggagaaaagcactgcagaggaagatactagcagggcaagggatctgagtgcagtcagacctcatttgggtccaga

SEQ ID NO: 68673 - DNA, 201 bp, Homo sapiens
caggagaatcccttgaacccaggaggcggaggctgcagtgagccaagatcatgccactgcactccagcctgggtgacagagagagactcccatctcaaaawttttttttttaaatgcagaggttggactgcctacctatactctaatttctattctggagtgattctctggagagtctaggtaaagactgaaaaggcattg

SEQ ID NO: 68674 - DNA, 201 bp, Homo sapiens
gatacagggttcatattcctaatattaaaaaaaacttctaaaagttaagaaaaaggccaactgccccacagaaaaatgggcaaggagataagaacaagatwgttcacaggaagagacacacagatgattattaaaaatctgaaaagatgctgagtcttactcctaagaaaaattcacatttaaactactctgggggctggg

SEQ ID NO: 68675 - DNA, 201 bp, Homo sapiens
gagcaatacagtcttaaatgttgtggccttttttgatcataagagttggtactgtttaaggccaaaagtaatagtttttataaatcttttagtttcaactsagcttttacaataaaaaggatttgtattgcattgagtttataaacttttggtttgtgaaatccatatttgatctgttttcttccaatcaaatgtttattt

SEQ ID NO: 68676 - DNA, 201 bp, Homo sapiens
gtttcaccgtgttgccaaggctgatctcaaaactcctgacctcaggtgatctgcccgcctcagcctcccaaagtgctgggattacaggcttgagccactgygcccggccttttttttttttttttttttttaattattgagacggagccttgcgctgtcaccgaggctggagtgcactggcactgtcttggctcactgcaa

SEQ ID NO: 68677 - DNA, 201 bp, Homo sapiens
tgttctccaagcaattgtatgtttggattgcagaagaatttgtaagatgaacttttttttaatgtgcattattaaaaatgttgagtggagcaattgtcacstttattaaggaggattgctttgtgcccaccacctagtgtaaaataaaatcgagcaatacagtcttaaatgttgtggccttttttgatcataagagttggt

SEQ ID NO: 68678 - DNA, 201 bp, Homo sapiens
tttgtatttttagtagaggtgaggtttcagcatgttggccaggctggtcttgaactcctgaccttgtcatcctcccaccttggcctcccaaagtgctgggmttacaggcgtgagccaccacggccggctgttatgctcatcatggcacttaagagatgcttaacaaacctttcctacaatgttcctcagattttcagagct

SEQ ID NO: 68679 - DNA, 201 bp, Homo sapiens
gtcgcgagcgaacaagcaggagggtgttcgactgctagagctgagctaagcgatgcctaaatcaaaggaacttgtttcttcaagctcttctggcagtgatyctgacagtgaggttgacaaaaagttaaagaggaaaaagcaagttgctccagaaaaacctgtaaagaagcaaaagacaggtgaaacttcgagagctctgtc

SEQ ID NO: 68680 - DNA, 201 bp, Homo sapiens
gtgaggtttcagcatgttggccaggctggtcttgaactcctgaccttgtcatcctcccaccttggcctcccaaagtgctgggattacaggcgtgagccacsacggccggctgttatgctcatcatggcacttaagagatgcttaacaaacctttcctacaatgttcctcagattttcagagcttatttgatctagcatctg

SEQ ID NO: 68681 - DNA, 201 bp, Homo sapiens
ctgtcatcccagctactcggaaggctgaagcaggagaatcgcttgaatctaggaggctgcaggttgcagtgagctgagaaggcgccactgcactccagccygggagacggaatctcactctgtcagtcacaacaacaacaaaaaaatagagcacagctatgttttgagttcttaagcaagggcaagcttaccaggcactta

SEQ ID NO: 68682 - DNA, 201 bp, Homo sapiens
  misc_feature (1)...(201): n = A,T,C or G, or insertion/deletion polymorphism (see Tables 1-2)
gctggtcggaattggcctttcccgtcttttctcagcctcagagtttgaagaccccttagttggtgaagatacagaacgtgccaactctatgggcctgtttntgcagaaaacaaacatcatccgtgactatctggaagaccagcaaggaggaagagagttctggcctcaagaggtaacagattcagggtattttgggggaaa

SEQ ID NO: 68683 - DNA, 201 bp, Homo sapiens
aggcagtgacaaaggatctgagatcccatcagagtagacttcaagttggagaaaccttttattggcacaggcattccttgttaacttgacagggtgaagctgtaatttttcaaaaacagtaaaagctggtttctcctaaactattttccttgtggtagtagagatcagtgggtcagaaacaactcctgaccacttggtttc

SEQ ID NO: 68684 - DNA, 201 bp, Homo sapiens
agtagccttttattatagtagcagtacatgtgtattgtagaaatttggaaaatacaagtgaaaaataaaaacatcaaattcccgtcagccagagactgctrtgaaatgttttgagcacatccttcttgaatgttttttaaatcctggtatgtatatttgtattttaaaatcaaaatgcattcttacccattctcttttgaa

SEQ ID NO: 68685 - DNA, 201 bp, Homo sapiens
ggcagtgacaaaggatctgagatcccatcagagtagacttcaagttggagaaaccttttattggcacaggcattccttgttaacttgacagggtgaagctgtaatttttcaaaaacagtaaaagctggtttctcctaaactattttccttgtggtagtagagatcagtgggtcagaaacaactcctgaccacttggtttcc

SEQ ID NO: 68686 - DNA, 201 bp, Homo sapiens
aatacaaatgagaagaaaatagctgaagaataattcgagtttatacagtacaattcaagagaagaaagaaaatttatgacgactagctgggtgagaattaraactgtaaccctgggaaggtcctggtgatttgactctcacaggacacctgatgaccagaggatgggtttcctttgatgggaaatctgtggcgattcattg

SEQ ID NO: 68687 - DNA, 201 bp, Homo sapiens
ctgttttggtaccagtaccatgctgttttggttactgtagccttgtagtatagtttgaagtcaggtagcgtgatgcctccagctttgttcttttggcttargattgtcttggctatgcaggctcttttttgcttccatgtgaaatttaaagtagttttttccaattctgtgaagaaagtcattggtagcttgatggggata

SEQ ID NO: 68688 - DNA, 201 bp, Homo sapiens
tgagcatttagtgctataaatttccctctacacactgctttaaatgtgtcccagagattctggtatgttgtgtctttgttctcattggtttcaaagaacawctttatttctgctttcatttcgttatgtacccagtagtcattcaggagcaggttgttcagtttccatgtagatgtgtggttttgagtgagtttattaatc

SEQ ID NO: 68689 - DNA, 201 bp, Homo sapiens
tgtggtgttctctgtatttcctgaatttgaatgttgacctgccttgctaggttggggaagttctcctggataatatactgaagagtgttttgtaacttggktccattctgtctatcactttcaggtacaacaatcatagcattggtcttttcacatagtcgcatatttattgaagcctttgttcatttcttttcattcttt

SEQ ID NO: 68690 - DNA, 201 bp, Homo sapiens
atgttgacctgccttgctaggttggggaagttctcctggataatatactgaagagtgttttgtaacttggttccattctgtctatcactttcaggtacaamaatcatagcattggtcttttcacatagtcgcatatttattgaagcctttgttcatttcttttcattcttttttctctaatcttgtcttcttgctttattt

SEQ ID NO: 68691 - DNA, 201 bp, Homo sapiens
gttgacctgccttgctaggttggggaagttctcctggataatatactgaagagtgttttgtaacttggttccattctgtctatcactttcaggtacaacartcatagcattggtcttttcacatagtcgcatatttattgaagcctttgttcatttcttttcattcttttttctctaatcttgtcttcttgctttatttca

SEQ ID NO: 68692 - DNA, 201 bp, Homo sapiens
ggcaagccccctgcccggtcacccttcccatcacaggatctggcgcgatgctgtgggaactgttgcaggcgttggctctgaagctgctcagagtctgcccycacagcaaaagggaactcctgactgcctggcacttaggaggagctcacagcctggccgtaggtccagggtttaaggctgtgcggtgggtagaacagagaa

SEQ ID NO: 68693 - DNA, 201 bp, Homo sapiens
caatatagtcagactcatccttaaaagaccttaagtcactcatccctggccactcctgctgtgggcccactagcacagtcctcaacaccacaaggcttctrgagccgtggggcacacctccacgggcaagccccctgcccggtcacccttcccatcacaggatctggcgcgatgctgtgggaactgttgcaggcgttggct

SEQ ID NO: 68694 - DNA, 201 bp, Homo sapiens
agcgacttttgcgtggttcccggtggttgcgctccccgtttcgtcccctccgtgagcatcggcgcttaccggtattttaacccgagggttacacatctgasgcaatgtgggtgggttacgcgggagaggacgagtgagttttttggtaagcggaatgaactatgcagataacatcacatgaaggccgtttctggaatgaag

SEQ ID NO: 68695 - DNA, 201 bp, Homo sapiens
ggtagaggagaacaaaggaaggaggaagtaacttgtggaatggtgacaaaggttgaaacaccttcaaataaggaagaggaacaggctatgacctaatgctytcttggaccactataagcatgccagggcaaatatttaggctaaattgtgagagctaagaacatgaagtacattgatttctttatcatagctagcagatat

SEQ ID NO: 68696 - DNA, 201 bp, Homo sapiens
acccgacctttctctctggcagcccttaacattttttccttcatttcaacgttggtgaatctgacaattacgtatcttgggattgcgcttctcgaggaatrtctttgtggtgttctctgtatttcctgaatttgaatgttgacctgccttgctaggttggggaagttctcctggataatatactgaagagtgttttgtaac

SEQ ID NO: 68697 - DNA, 201 bp, Homo sapiens
attattttgctacagaataacttctattatttgatatggcagatgtcactttttatatttagatatagcattcatttatttaacaaatatttgacgaccasttgtatatcagatagtgttctaggtgctggaggtacaacagtgaacaagctaggtgaagaccttgattttataaaacttactttttagtggaagagagac

SEQ ID NO: 68698 - DNA, 201 bp, Homo sapiens
ccaaggtcttgggcctcttaatttttcaaacctcaaaacttgacagcagttatctttggaactgctgatttgtgcttcctaagttaacagcatacaatgaytgctagaaatcaatttctgcatttaaggtgaagttagccgggtactatggtttacctgtaatctcagcactttgggaggctgaggtgggaggatcatttg

SEQ ID NO: 68699 - DNA, 201 bp, Homo sapiens
ttctatcacagaagcatttggctatagaatttcagggtttagtaaacttgatttacactgaatttttaggtgcatatcagtaaatctacgggcatatgccrcctgcaagttgtgtggcatcacccaaaagccgagagtaatggaaagagcaggctgttagtaatcaggcagatctggctcctgtccaatctaaatcctgtt

SEQ ID NO: 68700 - DNA, 201 bp, Homo sapiens
ttactatattaaaattcagatttatttggtttttccttaactattgggattaaatcctggttgtaattcatagtttgagggcgagggtgggcagtctacakttggctgagccctgtttttgtgaataaatgttatcagaacacagccacacccatttgcttctatgtcttctgtggctgcttttgcaatgtgacggccgag

SEQ ID NO: 68701 - DNA, 201 bp, Homo sapiens
gctgatgttatcatcctttatttgtacattgcttgtacagttgctctgagaaggtaagtcttaaattttcaaaagtgaaatgtcaccgagcatggtggctkatgcctctaatctcagcactttgggaggctgaggcaggcggatcacttgaggtcaggagttcgaaaccagcctgacttatgtgatgaaaccctgtctcta

SEQ ID NO: 68702 - DNA, 201 bp, Homo sapiens
aggcattccttgttaacttgacagggtgaagctgtaatttttcaaaaacagtaaaagctggtttctcctaaactattttccttgtggtagtagagatcagkgggtcagaaacaactcctgaccacttggtttccttttgagccgcgtcataaggaggcaatctgtaaaactagcacaggtctcccgctgttccactggctc

SEQ ID NO: 68703 - DNA, 201 bp, Homo sapiens
aatatagtcagactcatccttaaaagaccttaagtcactcatccctggccactcctgctgtgggcccactagcacagtcctcaacaccacaaggcttctgragccgtggggcacacctccacgggcaagccccctgcccggtcacccttcccatcacaggatctggcgcgatgctgtgggaactgttgcaggcgttggctc

SEQ ID NO: 68704 - DNA, 201 bp, Homo sapiens
gcctcttttatttcattgagcagtggtttgtagttctctttgaagaggtccttcatatcccttgtaagttggattcctaggtgttgtattctctttgtagstattgtgaatgggagttcactcatgatttggctccttgtttgtctgttattggtgtataggaatgcttgagattttttgcacattgattttgtatcctga

SEQ ID NO: 68705 - DNA, 201 bp, Homo sapiens
atcccagctgttcgggaagctgaggcagaaagattgcttgggtccagtagtttgagtctaacgtgggcaaatatatgagactccatctcaaaaaaaaaaawaaaaaataaaaataaaaaaatgtttactagtttttttcagtagccttttattatagtagcagtacatgtgtattgtagaaatttggaaaatacaagtgaa

SEQ ID NO: 68706 - DNA, 201 bp, Homo sapiens
tcactcctgaagccagtaagacaacgaacccactgggagaaacaaacaactccagacgcgccgacttaagagctgtaatactcgctgtgacggtctgcagsttcactcctgagccagcgagaccacgaacccaccagaaggaagaaactccgaacacatctgaacatcagaaggaacagactccggacacgccgcctttaa

SEQ ID NO: 68707 - DNA, 201 bp, Homo sapiens
agcctggacaacgtagtgagaccttatctcttaaaacaaaacaaaacaaaacaaaacaaaaaaaacagtaaaaattggccgggcacagtgactcctgcctrtaatcccagcactttgggaagcccaggtgagtggatcacttgaggtcaggtgtttgagaacagcctggccaacatggcaaaactccgtctctactaaaat

SEQ ID NO: 68708 - DNA, 201 bp, Homo sapiens
caaagggctcccaacaccatctctcctctgatttctgtgacaaatgtggaaagctacttgcttggaggtactgggggaactgatgggggaactttcatccygttaggaactccgctttccattcctgcgtctctgtcttgctccctggagatggatggatcacggagggggccacagtcagctggggcagcaggtactccc

SEQ ID NO: 68709 - DNA, 201 bp, Homo sapiens
gaggcagtgtgacagctccgtgacttttcctgcagagtagggctgctccgcaggcagtgtgctgaaagcagctcagggcagttgtgcagtcagatctatayctacttttaattgcacgcagattaaaggacagtttctgaagacatctgtaggaaaagggtagtaacttctgggttgttgggtcattgccatggaaagggg

SEQ ID NO: 68710 - DNA, 201 bp, Homo sapiens
cgaaaaaataaaacttctattaaagaatcatgctgagcacaagatcagagaggttgtgacattgcaaactcgatagatgcagggggcctgggagactggcrttctccaaagggctcccaacaccatctctcctctgatttctgtgacaaatgtggaaagctacttgcttggaggtactgggggaactgatgggggaacttt

SEQ ID NO: 68711 - DNA, 201 bp, Homo sapiens
gaaaccttttattggcacaggcattccttgttaacttgacagggtgaagctgtaatttttcaaaaacagtaaaagctggtttctcctaaactattttcctwgtggtagtagagatcagtgggtcagaaacaactcctgaccacttggtttccttttgagccgcgtcataaggaggcaatctgtaaaactagcacaggtctc

SEQ ID NO: 68712 - DNA, 201 bp, Homo sapiens
aacactcacggggtaggtttgcagcttcactcctgaagccagtaagacaacgaacccactgggagaaacaaacaactccagacgcgccgacttaagagctrtaatactcgctgtgacggtctgcagcttcactcctgagccagcgagaccacgaacccaccagaaggaagaaactccgaacacatctgaacatcagaagga

SEQ ID NO: 68713 - DNA, 201 bp, Homo sapiens
agagggcaaattactgctttctttaaaaagagtggcagccgggcacagtggctcacgcctataatcctagcactttgggaggccaaggcaggtggatcacktgaagtcaggagttcaagaccagcctggccaacatggtgaaactctatctctactaaaaatataaacattaggccaggtgtggtggcaggtgcctgtaat

SEQ ID NO: 68714 - DNA, 201 bp, Homo sapiens
taagagcataaaagcgggctgccttaaaaaaaacggtggcaacacgctgggtttgctttacaacgcctgggaagctttgttgtttgcaataaattttaatwcttgtctgtttcggtctgcactgcctttatgagctgtaacactcacggggtaggtttgcagcttcactcctgaagccagtaagacaacgaacccactggg

SEQ ID NO: 68715 - DNA, 201 bp, Homo sapiens
ctccagtgcagcagagcttgtgatgtgctctcactgaggtgctcagtgcagcaaggaggcctgtggaccctcgagttgagaattggtgtactagggcattyggtactttctagaagccattaatgctacaggtactcataaagtctactcttctgcagcccatcgtggatggtggcttaatcattgaatttgagttgtttc

SEQ ID NO: 68716 - DNA, 201 bp, Homo sapiens
agggtgtgggtggggccagataagagcataaaagcgggctgccttaaaaaaaacggtggcaacacgctgggtttgctttacaacgcctgggaagctttgtygtttgcaataaattttaatacttgtctgtttcggtctgcactgcctttatgagctgtaacactcacggggtaggtttgcagcttcactcctgaagccagt

SEQ ID NO: 68717 - DNA, 201 bp, Homo sapiens
ctgagaggtcgaggctacagtaagctgtgtgatttcatcattgcactctagcctgggtgatagagtgagactttgtctcaaaaaaaaaaaaaaaaaaaaargtcttagagaccagaagtctctgtaatctctaataatctctaggccctagagcagtggtttgtaaatggaggtgatttgctcccctccccccagaggaca

SEQ ID NO: 68718 - DNA, 201 bp, Homo sapiens
gctgaaaatattttttggcccttgaataagaggttggctgacttctgacttagggcatcagttgttctgttatcccagtaaaactcaaggcattaggggaraaatgttaatattaatacttaagttgatttgatttagggaaatctttgaagatttctaagtcttaagcagtagaacctgttaatggttttagtttcagca

SEQ ID NO: 68719 - DNA, 201 bp, Homo sapiens
atcagagtagacttcaagttggagaaaccttttattggcacaggcattccttgttaacttgacagggtgaagctgtaatttttcaaaaacagtaaaagctsgtttctcctaaactattttccttgtggtagtagagatcagtgggtcagaaacaactcctgaccacttggtttccttttgagccgcgtcataaggaggcaa

SEQ ID NO: 68720 - DNA, 201 bp, Homo sapiens
gtttcaggttggttccaaaaggaggtagggcctggtgcagtggctcacgcctgtaatcccagcactttgggaggctgaggcaggaggattgcttgaccccrggagttcgagaccagcctgggcaacatagcgagaccccatctctacaaaaaatacaaaaattagccaggcatggtgatgcatacctgtagtcccagctac

SEQ ID NO: 68721 - DNA, 201 bp, Homo sapiens
agggctcgggacctgcagcccgccatgcctgagcctcccccgcgccgccgccgtgggctcctgcgcggcccaagcctccccgacgagcgccaccccctgtyccacggcgcccagtcccgtcgaccgcccaagagctgaggagtgcgggcggatggcacgggagtggcaggcagctccacctgcggccctgcgcgggatcca

SEQ ID NO: 68722 - DNA, 201 bp, Homo sapiens
atggaccaatcagcagggtgtgggtggggccagataagagcataaaagcgggctgccttaaaaaaaacggtggcaacacgctgggtttgctttacaacgcytgggaagctttgttgtttgcaataaattttaatacttgtctgtttcggtctgcactgcctttatgagctgtaacactcacggggtaggtttgcagcttca

SEQ ID NO: 68723 - DNA, 201 bp, Homo sapiens
tgggtttgctttacaacgcctgggaagctttgttgtttgcaataaattttaatacttgtctgtttcggtctgcactgcctttatgagctgtaacactcacrgggtaggtttgcagcttcactcctgaagccagtaagacaacgaacccactgggagaaacaaacaactccagacgcgccgacttaagagctgtaatactcg

SEQ ID NO: 68724 - DNA, 201 bp, Homo sapiens
aagtggatttactttttttctttaaggatggatgttgtgttctctttatttttttcctactactttaatccctaaaagaacgctgtgtggctgggaccttwaggaaagtgaaatgcaggtgagaagaacctaaacatgaaaggaaagggtgcctcatcccagcaacctgtccttgtgggtgatgatcactgtgctgcttgt

SEQ ID NO: 68725 - DNA, 201 bp, Homo sapiens
acacaaacaaataaggttcttgattcggagcttgctgtagtaagggagttttgtacttagtggacactccgaggcaggcaggggagtgggaagctttacgrtggaaaaggggaaggctgcagcagtgctctgattggaggcttctggcctggggaagttggaagcagctgatagaggtaggtgtcttcagtgattggtttg

SEQ ID NO: 68726 - DNA, 201 bp, Homo sapiens
acaaggcagatcatctccaccatccggacgcagaatcttcccaactgtcagctgatttcccgaagccactactcccccatctacctgtcgtttgtcatgcytttggctgccctgagctggcagtacctgaccactctctcccaggtaacagaagactatgttcagactggagaacactgatcccaaatttgtccatagctg

SEQ ID NO: 68727 - DNA, 201 bp, Homo sapiens
ggccttagcccatgagggttcctggctttacccaggaaagaattcaagggtgagccagtggtaaggtggaagaaaacaacttcattaaagaggcagtgtgmcagctccgtgacttttcctgcagagtagggctgctccgcaggcagtgtgctgaaagcagctcagggcagttgtgcagtcagatctatacctacttttaat

SEQ ID NO: 68728 - DNA, 201 bp, Homo sapiens
caatggtaaactgacatggcaaactggtgggcgtgtcttaaggacggctgcttcggcccctccctgttttagctagtcctcaatttggtcggctgtctgamccccacctctggagtcgaatctcgccttctatctcattttgagttccttggactgcctgcagcagcggttgtttaagccatagttctgttatatagtgtc

SEQ ID NO: 68729 - DNA, 201 bp, Homo sapiens
aggagtggtatgagactggaacagaggtgtgcagcagcatcgcatgggcgaaacaacagtagacagttgttcttttgtttttgtttgttttttgagacagsgtcttgttctgtcatccaggctggagtgcagtggcatgatctcggatcactgcaacctccacctcccaggctcaagtgatcttcccaccccagtccccaa

SEQ ID NO: 68730 - DNA, 201 bp, Homo sapiens
aaggcttgatttcctttaaatcaatccattgattcgaagacatttcattggaggaatttaaaatggaaggattataatcaagtgtgtgtttttattttttwtttttttgagacggagtctcactttgttgcccaggctgcagtgtggtgtggtgatctcggctcgtgggttcaagcgattctccagcctcagcctcccgag

SEQ ID NO: 68731 - DNA, 201 bp, Homo sapiens
ctggctgaacctggagctgcagacaggttttctagaaggcataatcctgaagttgagacttgggggcctaggtaggagccagttgaagggacgtgggaggygcattccagagagaaggagtggtatgagactggaacagaggtgtgcagcagcatcgcatgggcgaaacaacagtagacagttgttcttttgtttttgttt

SEQ ID NO: 68732 - DNA, 201 bp, Homo sapiens
aggcttgatttcctttaaatcaatccattgattcgaagacatttcattggaggaatttaaaatggaaggattataatcaagtgtgtgtttttattttttawttttttgagacggagtctcactttgttgcccaggctgcagtgtggtgtggtgatctcggctcgtgggttcaagcgattctccagcctcagcctcccgagt

SEQ ID NO: 68733 - DNA, 201 bp, Homo sapiens
taacagttgagactaagtgttgtggttggtgccgttggaactccatggaacatgttcctcatggaagaggtggggaagggggaatgtgggcaggtaacaayccacactcccatgcttctctcccagtgagtgagatctaattcaccctggcagtaggttctcagtgggtttcaggttggttccaaaaggaggtagggcctg

SEQ ID NO: 68734 - DNA, 201 bp, Homo sapiens
gaaacaaagacttgggtgaaaaatgaaataagtatattctgacttggctattgagggtaaaaagaaagaattaagtattaagtgttccttgtaggagataygttagtagaataccataaaagtttgaaaattttaaaaagtactaatatttaggtatcctgaaattatttgcagttcattttttatggaaattaatccagt

SEQ ID NO: 68735 - DNA, 201 bp, Homo sapiens
gtcgaggctacagtaagctgtgtgatttcatcattgcactctagcctgggtgatagagtgagactttgtctcaaaaaaaaaaaaaaaaaaaaaagtcttasagaccagaagtctctgtaatctctaataatctctaggccctagagcagtggtttgtaaatggaggtgatttgctcccctccccccagaggacattggaca

SEQ ID NO: 68736 - DNA, 201 bp, Homo sapiens
acctccacctcccaggctcaagtgatcttcccaccccagtccccaagtagctgggggaccacaggtgcatgccacgatgcccggctaatttttgtacattytgtagaaacagggttttactgtgttgtccaggctggtcttaaacgcctgagcttaagcagtctacatgcctcagcctcctgaagtgctgggattccaaac

SEQ ID NO: 68737 - DNA, 201 bp, Homo sapiens
tttcttccaatcaaatgtttatttggaaagtcagtgaaactgtcaaaatgttacctcaataagatatttataattgtatgagaactacaatcaccaaatcractgtcttcagtattagcagatctagtttgataaacaaatggcttgtgtgaaaaccgagcaggtgtttgtcattacccatagtgttctgtgtagttattg

SEQ ID NO: 68738 - DNA, 201 bp, Homo sapiens
gcatgccacgatgcccggctaatttttgtacattttgtagaaacagggttttactgtgttgtccaggctggtcttaaacgcctgagcttaagcagtctacrtgcctcagcctcctgaagtgctgggattccaaacatgagccactgtgcctggcccggcaactgttactagactatagagagggaggtgggcaagggctgg

SEQ ID NO: 68739 - DNA, 201 bp, Homo sapiens
taaacgcctgagcttaagcagtctacatgcctcagcctcctgaagtgctgggattccaaacatgagccactgtgcctggcccggcaactgttactagactrtagagagggaggtgggcaagggctggtgacactagacaggtgcagtaggtctggaccatgggtggccttgcgctacacattacagagctcaggctttttt

SEQ ID NO: 68740 - DNA, 201 bp, Homo sapiens
tctgagcctccctttcctcattggtaaaatgggtataaaatacctgccagtggagggttgttgtaagtagccatggaaaatgtaaagcacatagcacttaycattttttcctgtgtctttaacagatttatcatagaatccccgactcagacccatcttctagcaaaacaaggcagatcatctccaccatccggacgcaga

SEQ ID NO: 68741 - DNA, 201 bp, Homo sapiens
taggaaagtgaaatgcaggtgagaagaacctaaacatgaaaggaaagggtgcctcatcccagcaacctgtccttgtgggtgatgatcactgtgctgcttgyggctcatggcagagcattcagtgccacggtttaggtgaagtcgctgcatatgtgactgtcatgagatcctacttagtatgatcctggctagaatgataat

SEQ ID NO: 68742 - DNA, 201 bp, Homo sapiens
gtcgctgcatatgtgactgtcatgagatcctacttagtatgatcctggctagaatgataattaaaagtatttaatttgaagcaccatttgaatgttcgtamtagtagaaaatgatgtgaattttctttctgttcggctcctatttttctcatcattttgttttctttaattgggttgaatggagtagatagaaatatttat

SEQ ID NO: 68743 - DNA, 201 bp, Homo sapiens
ttcgctctcattccattctgaagctctttgaaagcttgttttccttctaagtatcttctctactaaggttgccagatataataggggatgctgggcatggyggctcacacctgtggtctcagctactcggagggtgttggggctgaggcaggaggatcccttgagctcaagaggttgaggcagaggttgtggtgagccaag

SEQ ID NO: 68744 - DNA, 201 bp, Homo sapiens
aaccacgctcagctaattttggtatttttagtagagacggggtttcaccatgttagccaggctggtctcaaagtcctgacctcaagtgatccgcctgcatyggtcttcccaagtgctgggattacaggtgtgagccactgcacccagcccagtgtgtgttttagacgaataactctacctgccatatgggaaaggacaggg

SEQ ID NO: 68745 - DNA, 201 bp, Homo sapiens
gtgggaccacttcctgagctgtgtggtttgggtgatctcagattttttctatctataaagctatgtgcttttttctactcactgagttgtagaaaggtatycgctctcattccattctgaagctctttgaaagcttgttttccttctaagtatcttctctactaaggttgccagatataataggggatgctgggcatggcg

SEQ ID NO: 68746 - DNA, 201 bp, Homo sapiens
ttggtaactctggcaacactaccctctactccccacttctaatataattttatagcatctctggcatacagtctatttggatccgacctaatggtgcaatrttttgttttcctcagaggagcctctgacccatgtgaatctaggaccataaacaattagaatgcttgggagcaagagctttatatctgcatatgggaactt

SEQ ID NO: 68747 - DNA, 201 bp, Homo sapiens
gttaaaaatctgtgtgttgaaatctaagatttaattctgccaaagttcacgttaagacagaacaacctgctggaaagagatttggtctgagtggggcctgyggaaatcttctttcctgacttggtcattacctgtgggaccacttcctgagctgtgtggtttgggtgatctcagattttttctatctataaagctatgtgc

SEQ ID NO: 68748 - DNA, 201 bp, Homo sapiens
aaatattcattgagccagtatgtgctgggcactattccagatggttgaggggacattagtgagcaaaacaaaggtgtgtcgtcactgagcttagatttctmgtgttgacttaaaaaatatgatttatcaatttagaaagggagaagagcctttatttcttctaaagggttacagcatgcttccagcttagaccacagacgg

SEQ ID NO: 68749 - DNA, 201 bp, Homo sapiens
gtggagctgcaggtgttttactattgcttatctcaaggccagcgtttagctgctggagaaaaagaagagccctgtggcagttagagcttagttgattcttyaagtgtaggggtgcctgacttcaccattgcctgcatggccttaggtcctgtttataattgggtatcttattgccacagagtctgttccgttagtgttatg

SEQ ID NO: 68750 - DNA, 201 bp, Homo sapiens
ggtgtcctttttgttgatattgatcctattcctttgtttgttagttttccttctaacagaggcccgtcagctgcaggtctgttggagttgctggaggtccmctctagaccctgtttacctgggtatcaccagtggaggctgcagaacagcaaatatcgcggcctgatccttcctctggaagcttcgtccaagaaggacacc

SEQ ID NO: 68751 - DNA, 201 bp, Homo sapiens
tcatggaagaggtggggaagggggaatgtgggcaggtaacaacccacactcccatgcttctctcccagtgagtgagatctaattcaccctggcagtaggtyctcagtgggtttcaggttggttccaaaaggaggtagggcctggtgcagtggctcacgcctgtaatcccagcactttgggaggctgaggcaggaggattgc

SEQ ID NO: 68752 - DNA, 201 bp, Homo sapiens
tggatctcaagtaaacactagagagggggcagctgaagctccaggagtgtgtggggctccctggggctggatggcggtggcgggcaggcgagctgggctgygctcgggtgtgttacagtaaagacgcccagcttggcgctggcccggccttttcacggttttaggctctacagagagcggctgcagagctcacccggctgg

SEQ ID NO: 68753 - DNA, 201 bp, Homo sapiens
atcccatttgtctagtttggcttttgttgccattgcttttggtgttttagtcatgaagtctttgcccatgcctatgtcctgaatggtattgactgcatttycttctagggtttttacggttttaggccttatatttaagccttcagtccatcttgagttaatttttgtataagatgtaaggaagggatccagtttcagctt

SEQ ID NO: 68754 - DNA, 201 bp, Homo sapiens
caccgaggccggacacgtgggcgacttattgaccaagtggggaggaagcagccccgcactgctctcccgactgcggaccaccgttgggctcctgcgcatcmtaagccccaccgcctcacctccagtccccacagcgttcgcgctcccagccggggtaagcggaagaaaacaaaggcccggctccatcagggcaccaatccc

SEQ ID NO: 68755 - DNA, 201 bp, Homo sapiens
ttaaagtagttttttccaattctgtgaagaaagtcattggtagcttgatggggatagcattgaatctgtaaattaccttgggcagtatagccattttcacsatactgattcttcctatccatgagcatggaatgttcttccatttgtttatggcctcttttatttcattgagcagtggtttgtagttctctttgaagaggt

SEQ ID NO: 68756 - DNA, 201 bp, Homo sapiens
atttttcacgtgctatctttaatacaggtacatccttcagtctatttgtagaacattcagttttcttcatcttttctttgccggtgctacattatttgaawtattttgctacagaataacttctattatttgatatggcagatgtcactttttatatttagatatagcattcatttatttaacaaatatttgacgaccagt

SEQ ID NO: 68757 - DNA, 201 bp, Homo sapiens
tcatgatttggctccttgtttgtctgttattggtgtataggaatgcttgagattttttgcacattgattttgtatcctgagactttgctgaagttgcttakcagcttaaggagatttagggctgagacgatggggttttctaaatatacaatcatgtcatttgcaaacaggcaattttacttcctcttttcctaattgaat

SEQ ID NO: 68758 - DNA, 201 bp, Homo sapiens
tttttttaaccactcctattggatatttgttttttatttttttgagatggggtcccactctgcagtgtacaatatcatagttcactgtaacgtgtatctcytgggctcaagcgatcctcccacctcagcctcctgagtagctagtcttcagtagctagactataggtgggcgccaccacagctggctttttaaaaaatttt

SEQ ID NO: 68759 - DNA, 201 bp, Homo sapiens
attttttattacgtctttttgattcttctgtcttttcttcttgctagcggtctatcaattttgttgatcttttcaaaaaaccagctcctggattcattaatttttttttttgaagggttttttgtgtgtctatctctttcagttctgctctgatcttagttatttcttgccttttactagcttttcaatttgtttgctctt

SEQ ID NO: 68760 - DNA, 201 bp, Homo sapiens
tgtttagtctgcagtacaattataactgtttttgtatattgggttatttttttcagaagtaggccagtagctctaacaggagcctctttagcctgaattcrtccaagtagtgcagtgttgcactagttgtccctcgggacatgctccccaatacgtaactcacttccaggttgcaactggacacttactggtagtcagaaa

SEQ ID NO: 68761 - DNA, 201 bp, Homo sapiens
ttcactgtaacgtgtatctcttgggctcaagcgatcctcccacctcagcctcctgagtagctagtcttcagtagctagactataggtgggcgccaccacasctggctttttaaaaaattttttatgaacacgaggtctcactatgttgcccaggctgccctcaaattcctgggctcaagtgattctcccaccttggccttc

SEQ ID NO: 68762 - DNA, 201 bp, Homo sapiens
cttttcttcttgctagcggtctatcaattttgttgatcttttcaaaaaaccagctcctggattcattaatttttttttttgaagggttttttgtgtgtctrtctctttcagttctgctctgatcttagttatttcttgccttttactagcttttcaatttgtttgctcttgcttttctagttcttttaattgtgatgttaa

SEQ ID NO: 68763 - DNA, 201 bp, Homo sapiens
tggatcacggagggggccacagtcagctggggcagcaggtactccctacggcactagtctacagggggaaggacgctctgtgctggcagcggtggctcacrtggcctgtctgcactgtaaccacaggctgggatgtagccaggacttggtctccttggaagacaggtctgatgtttggccaatccagtccttcagaccctg

SEQ ID NO: 68764 - DNA, 201 bp, Homo sapiens
gtacatttgcatataaggttttgtgtagatgtgtgttttcctttttcttgggtctatgctgagaagtggaattgctggttcatacagcagctcgaaccttktgaggagctgccagacgcttttccaaggtcgctccaccattttacattcccgtcagcagtgtgagagtcccagtttcaccagcacttgttgttatctctt

SEQ ID NO: 68765 - DNA, 201 bp, Homo sapiens
tctcttgggctcaagcgatcctcccacctcagcctcctgagtagctagtcttcagtagctagactataggtgggcgccaccacagctggctttttaaaaamttttttatgaacacgaggtctcactatgttgcccaggctgccctcaaattcctgggctcaagtgattctcccaccttggccttccgaagtgcagggatta

SEQ ID NO: 68766 - DNA, 201 bp, Homo sapiens
ttgcttttctagttcttttaattgtgatgttaaggtgttgtttttagatctttcctgctttctcttgtgagcatttagtgctataaatttccctctacacwctgctttaaatgtgtcccagagattctggtatgttgtgtctttgttctcattggtttcaaagaacatctttatttctgctttcatttcgttatgtaccca

SEQ ID NO: 68767 - DNA, 201 bp, Homo sapiens
ggcgttctccaaagggctcccaacaccatctctcctctgatttctgtgacaaatgtggaaagctacttgcttggaggtactgggggaactgatgggggaastttcatcctgttaggaactccgctttccattcctgcgtctctgtcttgctccctggagatggatggatcacggagggggccacagtcagctggggcagca

SEQ ID NO: 68768 - DNA, 201 bp, Homo sapiens
taacgtgaaaatgtatgtatagttagttcaggggagaaaaccaggagagagagagagaaagctcacaccagagctgtcgcttaaagatgactggactaggrtgggaagagaaagaataacaagtccctagaaaatttgctaaaagtgaggcctttggggtacagaagagtgggcaggtttgtaacggctgtaagggaaacg

SEQ ID NO: 68769 - DNA, 201 bp, Homo sapiens
ggcctggcgcagtggctcatgcctgtaatcccaacagtttgagaggccaaggtgggcggatcacctgaggccaggagttcgagaccagcctggccaacatmgtgaaaccccgtgtttactaaaaaatacaaaaattagccgggcgtggtggcaagggcttgtaatcccagctacctgggaggctgaggcaggagaatcgct

SEQ ID NO: 68770 - DNA, 201 bp, Homo sapiens
ctcccaggattcacaccacgtaatcagtatattcaagccttgctgtccttgatttctttcagacggtctttctccaagtggtggatatggtaacaacccaygtgcactagcttaacaaaaagttcttaggaatggctttgttcggcctggcgcagtggctcatgcctgtaatcccaacagtttgagaggccaaggtgggcg

SEQ ID NO: 68771 - DNA, 201 bp, Homo sapiens
acattctctgaaaaatcctttaactcttgtggttgcgggtgacagaaaaacaagtcaggcctcccccaggcagcataaggggatgtggaaaataggataghttgacatgagtttgcttcaggtagactggctgactcccaggattcacaccacgtaatcagtatattcaagccttgctgtccttgatttctttcagacggt

SEQ ID NO: 68772 - DNA, 201 bp, Homo sapiens
acaggaattgatatcctttataaggaaaaaagtctattcacaggagccgagcagattgctcactgctgtgtagtaccctggtgagaggagataaatggagsaaggctgtaggttggagcccctcagtagaatcatagattttgagctgcaagatgatgcaggaggccaaccaagcttcttgttgctggtgaggaatgtgag

SEQ ID NO: 68773 - DNA, 201 bp, Homo sapiens
cccagtcacaaacactgcaaggcaggtgtttctaacaaagccttaagctgatgtcgacatgccccacaattccttgtcactcaccagcacatccccgctgsctccatgctagaagcaggcaaggagctgcaggtgcgtatacgatggaggtgagggagacagtgcgcatggaatgaatcaactcagtttgggagcagggag

SEQ ID NO: 68774 - DNA, 201 bp, Homo sapiens
cttaagctgatgtcgacatgccccacaattccttgtcactcaccagcacatccccgctggctccatgctagaagcaggcaaggagctgcaggtgcgtataygatggaggtgagggagacagtgcgcatggaatgaatcaactcagtttgggagcagggagaactttattgaggttatgaatatattctacttgaaactgga

SEQ ID NO: 68775 - DNA, 201 bp, Homo sapiens
ggagacagtgcgcatggaatgaatcaactcagtttgggagcagggagaactttattgaggttatgaatatattctacttgaaactggaaggataagtggtyatgaatttgtggcttatggtaacctttgttaagcatctttctttttctttttttttttggtgagacacagattcactcttgtcccccaggctggagtgca

SEQ ID NO: 68776 - DNA, 201 bp, Homo sapiens
aagaactgctataacatgtttctaaaccagggctatgcaaagcactagagttcctgaccagcaatgcaaaccagtggcatacaaattcaaaatactgtatmcaggccctgactccagcccaaaccaaggctggagggcatccagggggatgtggttccccacggggtagcatcttggttatgtgagatcaccaagacacca

SEQ ID NO: 68777 - DNA, 201 bp, Homo sapiens
ctagaagccattaatgctacaggtactcataaagtctactcttctgcagcccatcgtggatggtggcttaatcattgaatttgagttgtttcgagctgcarcgttggatttgcattgttgtaagcacactttcttgctgtgaccactgacaccaaaattagtttgggcccagggagacttcagttaattggttcatttgag

SEQ ID NO: 68778 - DNA, 201 bp, Homo sapiens
ctgttaatggaaaaagtgctgtgtgaggatgggggttaagtgactggactgtttgtgttctgagctttctaggactgatctgattacgctgtaaacactcygccagatactgtgtaggcccagcccttgtgcttgagggggccactgtgaggtggcgaaacagacaagagattattagaatacagaaagttcaggttggga

SEQ ID NO: 68779 - DNA, 201 bp, Homo sapiens
aggccctgactccagcccaaaccaaggctggagggcatccagggggatgtggttccccacggggtagcatcttggttatgtgagatcaccaagacaccaarcctgttttatgagctgaatcctcagcttgttgctggatttgtggctgataaaaagtacaggcagggcccagtggctcacacctgtaatcccaacactttg

SEQ ID NO: 68780 - DNA, 201 bp, Homo sapiens
agatagaaatatttatggtttaggtaacagttagatgtttcctaagaatgcaaactgccttttccacacaaaggctgggaataaaattctgggtattctcstattctcatttaaaggagtttagctttcagagagaaacagcaggattgcttttgaccttttagaagattggtctccagtaaaggtggacatttttgagat

SEQ ID NO: 68781 - DNA, 201 bp, Homo sapiens
gaggatgggggttaagtgactggactgtttgtgttctgagctttctaggactgatctgattacgctgtaaacactccgccagatactgtgtaggcccagcycttgtgcttgagggggccactgtgaggtggcgaaacagacaagagattattagaatacagaaagttcaggttgggaggaaccactgaacatggtagaagt

SEQ ID NO: 68782 - DNA, 201 bp, Homo sapiens
cccacggggtagcatcttggttatgtgagatcaccaagacaccaaacctgttttatgagctgaatcctcagcttgttgctggatttgtggctgataaaaartacaggcagggcccagtggctcacacctgtaatcccaacactttgggaggctgaggcaggcagaccacctgaggccgggagtttgaaactagcctggcca

SEQ ID NO: 68783 - DNA, 201 bp, Homo sapiens
tggcctgtctgcactgtaaccacaggctgggatgtagccaggacttggtctccttggaagacaggtctgatgtttggccaatccagtccttcagaccctgyctgaaacttgtatcttacgtgaacttaaagaataaaatgcatttctaccccgatctcgcccccaggactggcacgacaggcccacggcagattagatctt

SEQ ID NO: 68784 - DNA, 201 bp, Homo sapiens
ggacctttaggaaagtgaaatgcaggtgagaagaacctaaacatgaaaggaaagggtgcctcatcccagcaacctgtccttgtgggtgatgatcactgtgmtgcttgtggctcatggcagagcattcagtgccacggtttaggtgaagtcgctgcatatgtgactgtcatgagatcctacttagtatgatcctggctagaa

SEQ ID NO: 68785 - DNA, 201 bp, Homo sapiens
gcaagccccaaattgggccttagcccatgagggttcctggctttacccaggaaagaattcaagggtgagccagtggtaaggtggaagaaaacaacttcatkaaagaggcagtgtgacagctccgtgacttttcctgcagagtagggctgctccgcaggcagtgtgctgaaagcagctcagggcagttgtgcagtcagatct

SEQ ID NO: 68786 - DNA, 201 bp, Homo sapiens
tgagatcaccaagacaccaaacctgttttatgagctgaatcctcagcttgttgctggatttgtggctgataaaaagtacaggcagggcccagtggctcacrcctgtaatcccaacactttgggaggctgaggcaggcagaccacctgaggccgggagtttgaaactagcctggccaacatggtgaaatcctgtatgtactt

SEQ ID NO: 68787 - DNA, 201 bp, Homo sapiens
ttcagggctcctccatgctggggcattgcatcactgctttattcctttttatcgcctagtattattccactgtgtggatagaccacatttatccattcatyagttggaggatatttgggttcttcccattttttttggctatggtgaatagtactgtgtacatttgcatataaggttttgtgtagatgtgtgttttccttt

SEQ ID NO: 68788 - DNA, 201 bp, Homo sapiens
tgttcataattgctaacgtggttgtccggtagcctccatacatgtggagaaaggttaaataagcattctgagggcagcataatgtgagggttaaaaactcyggtagccaagactctgaagccaggctgcctgggttggaatctcaaatctcccacttactaaactgttggttacttacaaagactctctgtgcctcagttt

SEQ ID NO: 68789 - DNA, 201 bp, Homo sapiens
ggagggggccacagtcagctggggcagcaggtactccctacggcactagtctacagggggaaggacgctctgtgctggcagcggtggctcacatggcctgyctgcactgtaaccacaggctgggatgtagccaggacttggtctccttggaagacaggtctgatgtttggccaatccagtccttcagaccctgtctgaaac

SEQ ID NO: 68790 - DNA, 201 bp, Homo sapiens
ctcagctaattttggtatttttagtagagacggggtttcaccatgttagccaggctggtctcaaagtcctgacctcaagtgatccgcctgcatcggtcttyccaagtgctgggattacaggtgtgagccactgcacccagcccagtgtgtgttttagacgaataactctacctgccatatgggaaaggacaggggaagtca

SEQ ID NO: 68791 - DNA, 201 bp, Homo sapiens
gctggatttgtggctgataaaaagtacaggcagggcccagtggctcacacctgtaatcccaacactttgggaggctgaggcaggcagaccacctgaggccrggagtttgaaactagcctggccaacatggtgaaatcctgtatgtacttaaaaatacaaaaattacccaggcatattggtgagtgcctgtcatcccagcta

SEQ ID NO: 68792 - DNA, 201 bp, Homo sapiens
gagatgggtttagaaagtggccaggcacaagttattttaaaataaaaaatctttggctgtttgttccaatatattaatagttttcccttttttacagcaaygcagtgtgcatattttatctggttctccgagctctggacacactggaagatgacatgaccatcagtgtggaaaagaaggtcccgctgttacacaactttc

SEQ ID NO: 68793 - DNA, 201 bp, Homo sapiens
ttctccaaagggctcccaacaccatctctcctctgatttctgtgacaaatgtggaaagctacttgcttggaggtactgggggaactgatgggggaactttyatcctgttaggaactccgctttccattcctgcgtctctgtcttgctccctggagatggatggatcacggagggggccacagtcagctggggcagcaggta

SEQ ID NO: 68794 - DNA, 201 bp, Homo sapiens
ccaggggcccgggcgcaggcaccgccccgcggggctgctgcttgcctcctgccgcctggccctgcaaggactggcctcggggagagggcggcaggctgtgragccgcctgccccagtcccactcccactcccactcccactcccactcccactcctgctcctcgacgtctcccaccgccgtgtgtgttgtctgcccgcagg

SEQ ID NO: 68795 - DNA, 201 bp, Homo sapiens
aatttgccagtctgcgtcttttaactggggcatttagcccacttatatttaaggttaatattgttatgtttgaatttgatctgtcattatgatgtttgctggttattttgcccattaattgatgcagtttcttcctagcctcgatggtctttacaatttggcatgtttttgcagtggctggtaccagttgttcctttccat

SEQ ID NO: 68796 - DNA, 201 bp, Homo sapiens
tgcctgtgagcaggtcgtgtatttctcggcttcccttatccaactttgcatttctatttctagcatattgggttgattcttttgaagctgcctctgtgcasattacacccatgaacttagaccagttgcctttatgtatgatcgtatttatactgagaagttactgtgttttttgactttcttttctatttgctacatatt

SEQ ID NO: 68797 - DNA, 201 bp, Homo sapiens
cccgggcgcaggcaccgccccgcggggctgctgcttgcctcctgccgcctggccctgcaaggactggcctcggggagagggcggcaggctgtggagccgcytgccccagtcccactcccactcccactcccactcccactcccactcctgctcctcgacgtctcccaccgccgtgtgtgttgtctgcccgcaggactcgct

SEQ ID NO: 68798 - DNA, 201 bp, Homo sapiens
tttgccagtctgcgtcttttaactggggcatttagcccacttatatttaaggttaatattgttatgtttgaatttgatctgtcattatgatgtttgctggwtattttgcccattaattgatgcagtttcttcctagcctcgatggtctttacaatttggcatgtttttgcagtggctggtaccagttgttcctttccattt

SEQ ID NO: 68799 - DNA, 201 bp, Homo sapiens
taactttgcattgtttaggcaccatcgtgtcctatacgcagctcaattcaataaatactcattgagcacccaataaatattcattgagccagtatgtgctrggcactattccagatggttgaggggacattagtgagcaaaacaaaggtgtgtcgtcactgagcttagatttctagtgttgacttaaaaaatatgatttat

SEQ ID NO: 68800 - DNA, 201 bp, Homo sapiens
tatccagaacatagcccggccctacgtgtttactttagaaagcccttccaggctctttgccatctagtagagtccctgcgggcccagcctttcagagaagvggggggagggggtgatgtttattaactttttttagtcttggcagctgaacctgcctgtgagcaggtcgtgtatttctcggcttcccttatccaactttgc

SEQ ID NO: 68801 - DNA, 201 bp, Homo sapiens
attgaagcttgtttatgctttgtgaaattcttgtactttggttttcagctccatcaggtcatttaagctcttctctacactggttattctagttagccatwtgtccaaccttttctcaaggttttaagtttccttgcgatgggtcagaacgtgctgctttagcttggagaagtttgttattaccaaccttctgaagcctac

SEQ ID NO: 68802 - DNA, 201 bp, Homo sapiens
tcaatttagaaagggagaagagcctttatttcttctaaagggttacagcatgcttccagcttagaccacagacgggcactttgaaggaaaaggcgtttgasgtaggagctttatgctgactgggttggctaaacgtacatatttaacagattacaagaggagctacgaatatttatgatggcggacctgacacattgaaca

SEQ ID NO: 68803 - DNA, 201 bp, Homo sapiens
accagtcgcagtttcgcagctgttatccaggcgctggatggggaaatgcggtgagtgatggaggcagcgcctctggcttggaggaaagcttgtccgggacytttgagtgtgttggaagctaccttttgatatagcgctcagcgttgcagcctcgttgctgtggcttatccagaacatagcccggccctacgtgtttacttt

SEQ ID NO: 68804 - DNA, 201 bp, Homo sapiens
gaatcatgctgagcacaagatcagagaggttgtgacattgcaaactcgatagatgcagggggcctgggagactggcgttctccaaagggctcccaacaccrtctctcctctgatttctgtgacaaatgtggaaagctacttgcttggaggtactgggggaactgatgggggaactttcatcctgttaggaactccgctttc

SEQ ID NO: 68805 - DNA, 201 bp, Homo sapiens
gttttcagctccatcaggtcatttaagctcttctctacactggttattctagttagccatttgtccaaccttttctcaaggttttaagtttccttgcgatsggtcagaacgtgctgctttagcttggagaagtttgttattaccaaccttctgaagcctacttctgtcaactcgttaaactcattgtccatccagttttgt

SEQ ID NO: 68806 - DNA, 201 bp, Homo sapiens
ttcttcaagtgtaggggtgcctgacttcaccattgcctgcatggccttaggtcctgtttataattgggtatcttattgccacagagtctgttccgttagtsttatgatctctgttttaatgttaatgccagccagttgtgtatgaactccaaaaggaagggggtacaatgagggctatctgatctcctgtcccgttatttg

SEQ ID NO: 68807 - DNA, 201 bp, Homo sapiens
cagatactgaagttgggggattctggtcaaatcaatttagcaggattcttggtaaaactgggcgatgcaaagacagatgcgttgagtacaaagtccaggcyttattgggaagaggatttcagcggagcccgagtagagtttggtctagggagactctgtcactgggaggacgagcgagccgctcggaagtgcgctgggttc

SEQ ID NO: 68808 - DNA, 201 bp, Homo sapiens
aggtcatttaagctcttctctacactggttattctagttagccatttgtccaaccttttctcaaggttttaagtttccttgcgatgggtcagaacgtgctsctttagcttggagaagtttgttattaccaaccttctgaagcctacttctgtcaactcgttaaactcattgtccatccagttttgttcctttgctggtgag

SEQ ID NO: 68809 - DNA, 201 bp, Homo sapiens
ggatggagggggatgtggaacctaatcggctgtctagggtgatcagatactgaagttgggggattctggtcaaatcaatttagcaggattcttggtaaaaytgggcgatgcaaagacagatgcgttgagtacaaagtccaggccttattgggaagaggatttcagcggagcccgagtagagtttggtctagggagactctg

SEQ ID NO: 68810 - DNA, 201 bp, Homo sapiens
aaactagcacaggtctcccgctgttccactggctcacccacatgattagcagagtgcacgaaaaaataaaacttctattaaagaatcatgctgagcacaasatcagagaggttgtgacattgcaaactcgatagatgcagggggcctgggagactggcgttctccaaagggctcccaacaccatctctcctctgatttctg

SEQ ID NO: 68811 - DNA, 201 bp, Homo sapiens
aactcgttaaactcattgtccatccagttttgttcctttgctggtgaggagttacgttcctttggaggagaagaggcgttctgtttttggaattttcagcytttctgctgtggtgtctccccatctttgtggttttatctacctttggtctttgattttggtgacgtacagatgggttttggtgtgggtgtcctttttgtt

SEQ ID NO: 68812 - DNA, 201 bp, Homo sapiens
cgtgattctctgcagggacaaagagagacagcagctacaagtctataggcagtgacaaaggatctgagatcccatcagagtagacttcaagttggagaaamcttttattggcacaggcattccttgttaacttgacagggtgaagctgtaatttttcaaaaacagtaaaagctggtttctcctaaactattttccttgtgg

SEQ ID NO: 68813 - DNA, 201 bp, Homo sapiens
attgtccatccagttttgttcctttgctggtgaggagttacgttcctttggaggagaagaggcgttctgtttttggaattttcagcttttctgctgtggtktctccccatctttgtggttttatctacctttggtctttgattttggtgacgtacagatgggttttggtgtgggtgtcctttttgttgatattgatcctat

SEQ ID NO: 68814 - DNA, 201 bp, Homo sapiens
gaactgctccactgcgaatacaaagaaaagtaggaattgatggcgggggagccggatgtcagtggatggaaaattattacgaggaaacacaggggtgtgcrttcttgctgaaggcaggccagagttatcagacatcacctgagggatggagggggatgtggaacctaatcggctgtctagggtgatcagatactgaagttg

SEQ ID NO: 68815 - DNA, 201 bp, Homo sapiens
tcaggttctgcttttaggaggaaggctaagacaagcagtaaagcaacatgggcaggcagaaggatgacttctaatagaattatctcatcactatatatttyactttatggatgcttgtattgaaaagtcttggctgggtggagtggctcacgcctgtaatcccagccctttgggaggccgaggtgggtggatcacttgagg

SEQ ID NO: 68816 - DNA, 201 bp, Homo sapiens
ggagaagaggcgttctgtttttggaattttcagcttttctgctgtggtgtctccccatctttgtggttttatctacctttggtctttgattttggtgacgyacagatgggttttggtgtgggtgtcctttttgttgatattgatcctattcctttgtttgttagttttccttctaacagaggcccgtcagctgcaggtctg

SEQ ID NO: 68817 - DNA, 201 bp, Homo sapiens
tacatagtacaaacagcaactctttctgatatgcttgcatttaaaatcaggctttttctcccttttggaaaaacacagtccttgtttgctttagggaagartaaaggtcagtgcgctgcattgcattaatttcgaagggaaagatgagaagacatcttgaaaggaatggctggctttctagagaatagtagaggcttaata

SEQ ID NO: 68818 - DNA, 201 bp, Homo sapiens
ttcctctctactccagtgcagcagagcttgtgatgtgctctcactgaggtgctcagtgcagcaaggaggcctgtggaccctcgagttgagaattggtgtaytagggcattcggtactttctagaagccattaatgctacaggtactcataaagtctactcttctgcagcccatcgtggatggtggcttaatcattgaattt

SEQ ID NO: 68819 - DNA, 201 bp, Homo sapiens
tggggctcagggacccacttgaggaggcagtctgtccgttactggagttcaaatgccgagctgggagaaccactgctctcttcagagctgtcaggcagggmtgtttaaatctgcagaagccgtctgctgccttttgtttagatatgccctgcccccagagatgcaatctagagaggcagtaggccttgctgagctgcggtg

SEQ ID NO: 68820 - DNA, 201 bp, Homo sapiens
cccaccttggccttccgaagtgcagggattataggcgtgcgccactgcacccggccctgttggataaatgattccagtctctcccaaaaagaactgttgtragactgtggggtgaggggagggaagggacaaataggaacccgccgtattttccactccctgtgggcctaaaactgctctaaaaaatagtccatgaaaaaa

SEQ ID NO: 68821 - DNA, 201 bp, Homo sapiens
tgtggtggtgggtgctttaattccagctactcaggaagctgaggcaggagaatcacttgaacccaagaggcagaggttgcagtgagttgagattgtgccastgcactccagcccaggggacaaagtgagacttgatctcaaaaaaaaaaaaaaaaaaaagttattgtaaagctagacacggtggtatttgcctacaatccc

SEQ ID NO: 68822 - DNA, 201 bp, Homo sapiens
gaaagggtgcctcatcccagcaacctgtccttgtgggtgatgatcactgtgctgcttgtggctcatggcagagcattcagtgccacggtttaggtgaagtygctgcatatgtgactgtcatgagatcctacttagtatgatcctggctagaatgataattaaaagtatttaatttgaagcaccatttgaatgttcgtaata

SEQ ID NO: 68823 - DNA, 201 bp, Homo sapiens
aatttttttttttaaatgcagaggttggactgcctacctatactctaatttctattctggagtgattctctggagagtctaggtaaagactgaaaaggcaytgttacgtccacctgtcatctcacttggacaagaatccaggagaaactattgaactgaggtgacaaagttatgatcaatgtggtgatctgaggtgtatta

SEQ ID NO: 68824 - DNA, 201 bp, Homo sapiens
ttttatctggttctccgagctctggacacactggaagatgacatgaccatcagtgtggaaaagaaggtcccgctgttacacaactttcactctttcctttmccaaccagactggcggttcatggagagcaaggagaaggatcgccaggtgctggaggacttcccaacggtgagtggggttacgcatcttgtctacggactg

SEQ ID NO: 68825 - DNA, 201 bp, Homo sapiens
catattttatctggttctccgagctctggacacactggaagatgacatgaccatcagtgtggaaaagaaggtcccgctgttacacaactttcactctttcytttaccaaccagactggcggttcatggagagcaaggagaaggatcgccaggtgctggaggacttcccaacggtgagtggggttacgcatcttgtctacgg

SEQ ID NO: 68826 - DNA, 201 bp, Homo sapiens
ttggagaaaccttttattggcacaggcattccttgttaacttgacagggtgaagctgtaatttttcaaaaacagtaaaagctggtttctcctaaactattytccttgtggtagtagagatcagtgggtcagaaacaactcctgaccacttggtttccttttgagccgcgtcataaggaggcaatctgtaaaactagcacag

SEQ ID NO: 68827 - DNA, 201 bp, Homo sapiens
gtaaaagctggtttctcctaaactattttccttgtggtagtagagatcagtgggtcagaaacaactcctgaccacttggtttccttttgagccgcgtcatwaggaggcaatctgtaaaactagcacaggtctcccgctgttccactggctcacccacatgattagcagagtgcacgaaaaaataaaacttctattaaagaa

SEQ ID NO: 68828 - DNA, 201 bp, Homo sapiens
ctgatttctgtgacaaatgtggaaagctacttgcttggaggtactgggggaactgatgggggaactttcatcctgttaggaactccgctttccattcctgsgtctctgtcttgctccctggagatggatggatcacggagggggccacagtcagctggggcagcaggtactccctacggcactagtctacagggggaagga

SEQ ID NO: 68829 - DNA, 201 bp, Homo sapiens
aaaaattagctggccgtggtggtacatgcctgtagttccagctactcgggaggctaaggcaggagactcacttgaacctgggagccagaggttgcagtgarccaagatcgcgccactgcactccagcctcacgacagagtgagactccatttaaaaaaaaaaaaaaaatgaagaagaaatagcactcgaaggctgggcgca

SEQ ID NO: 68830 - DNA, 201 bp, Homo sapiens
aactttcatcctgttaggaactccgctttccattcctgcgtctctgtcttgctccctggagatggatggatcacggagggggccacagtcagctggggcarcaggtactccctacggcactagtctacagggggaaggacgctctgtgctggcagcggtggctcacatggcctgtctgcactgtaaccacaggctgggatg

SEQ ID NO: 68831 - DNA, 201 bp, Homo sapiens
gaggctaaggcaggagactcacttgaacctgggagccagaggttgcagtgaaccaagatcgcgccactgcactccagcctcacgacagagtgagactccayttaaaaaaaaaaaaaaaatgaagaagaaatagcactcgaaggctgggcgcagtggcttgcctgtaatcctagcactttgggaggccgaggagggtggatc

SEQ ID NO: 68832 - DNA, 201 bp, Homo sapiens
cttggaagacaggtctgatgtttggccaatccagtccttcagaccctgtctgaaacttgtatcttacgtgaacttaaagaataaaatgcatttctaccccsatctcgcccccaggactggcacgacaggcccacggcagattagatcttttcccagtactgatcggtgcgtggaattccagccaccacttctgattcgatt

SEQ ID NO: 68833 - DNA, 201 bp, Homo sapiens
ggctaaggcaggagactcacttgaacctgggagccagaggttgcagtgaaccaagatcgcgccactgcactccagcctcacgacagagtgagactccattwaaaaaaaaaaaaaaaatgaagaagaaatagcactcgaaggctgggcgcagtggcttgcctgtaatcctagcactttgggaggccgaggagggtggatcat

SEQ ID NO: 68834 - DNA, 201 bp, Homo sapiens
aaaaagtaaggtgcttttaaagtgtgacaagggtcaaccaatatagtcagactcatccttaaaagaccttaagtcactcatccctggccactcctgctgtkggcccactagcacagtcctcaacaccacaaggcttctggagccgtggggcacacctccacgggcaagccccctgcccggtcacccttcccatcacaggat

SEQ ID NO: 68835 - DNA, 201 bp, Homo sapiens
actgcactccagcctgggagacggaatctcactctgtcagtcacaacaacaacaaaaaaatagagcacagctatgttttgagttcttaagcaagggcaagyttaccaggcacttacagagaaggttgacgaggatgacagggaactaattgggggagggatgccatggttgaaaacatggctggggcagcgagaagttaag

SEQ ID NO: 68836 - DNA, 201 bp, Homo sapiens
gatgctgtgggaactgttgcaggcgttggctctgaagctgctcagagtctgccctcacagcaaaagggaactcctgactgcctggcacttaggaggagctsacagcctggccgtaggtccagggtttaaggctgtgcggtgggtagaacagagaaagccgagatggccacggggtgtggctcacaattcactgttcttggc

SEQ ID NO: 68837 - DNA, 201 bp, Homo sapiens
tacaatgttcctcagattttcagagcttatttgatctagcatctggttcctaaattctgagtcacatcagaagccaaacttgaatgcttttggaaagagcyagcctcataccacttcagttgggaaggggagtactgaggtgtaccttggcaggacagtggaatgattgctggttcttctagtttgctctataccaagaac

SEQ ID NO: 68838 - DNA, 201 bp, Homo sapiens
cactccagcctggcaacaagagtgaaattctgtctcaaaaaaaaaaaaaaaaaaaaaaaaaaaaggcgcttgaacattaatttactaagcaggccattttyacttcctgcagaaagggtacactcgccagcagttttgccatgggagtataccaaacaaaggagacagggtcatttataacctgactcgtccaccccactg

SEQ ID NO: 68839 - DNA, 201 bp, Homo sapiens
tagggttgtatatgcattttattgcctattttctaaaacactaaaaatgctaaattctgccccaggtcttgccacagatgtttcagtggactatgggcctktgagaccttaaagggttgattgagtaaggatcacaggtgatgtccgcattgtgcttggcatggagttaagtgcttgataaatggtggttatcaatctgat

SEQ ID NO: 68840 - DNA, 201 bp, Homo sapiens
accacagttacttcatctgtaaaatagggatgtatgtatggtaacgattttttaaccacaacttcccaactctaagatggtctgaaaagaattttttgagwgtttggctcagaatcacttggcagcaaaacctgacttgaagttgaggcttcattcatcccacttagtatattcaaatgttttgctaaagaaataattatg

SEQ ID NO: 68841 - DNA, 201 bp, Homo sapiens
gaaccacagttacttcatctgtaaaatagggatgtatgtatggtaacgattttttaaccacaacttcccaactctaagatggtctgaaaagaattttttgwgtgtttggctcagaatcacttggcagcaaaacctgacttgaagttgaggcttcattcatcccacttagtatattcaaatgttttgctaaagaaataatta

SEQ ID NO: 68842 - DNA, 201 bp, Homo sapiens
tgaaccacagttacttcatctgtaaaatagggatgtatgtatggtaacgattttttaaccacaacttcccaactctaagatggtctgaaaagaattttttsagtgtttggctcagaatcacttggcagcaaaacctgacttgaagttgaggcttcattcatcccacttagtatattcaaatgttttgctaaagaaataatt

SEQ ID NO: 68843 - DNA, 201 bp, Homo sapiens
tgcggagcgggaggccgggggcggggctgcggggctgcggggcgggcccgttgtgggtcggcccagcgcgtattcgagtagagggcgagcccgtcccgccyctcgtcgggcgcttcccagatctgcttgagtctatggaggaaaaactccgcggggtccgcgattcccatggccgcagccgcctgcggcaccaaggccatg

SEQ ID NO: 68844 - DNA, 201 bp, Homo sapiens
aacctaaacatgaaaggaaagggtgcctcatcccagcaacctgtccttgtgggtgatgatcactgtgctgcttgtggctcatggcagagcattcagtgccmcggtttaggtgaagtcgctgcatatgtgactgtcatgagatcctacttagtatgatcctggctagaatgataattaaaagtatttaatttgaagcaccat

SEQ ID NO: 68845 - DNA, 201 bp, Homo sapiens
tagtagaggtgaggtttcagcatgttggccaggctggtcttgaactcctgaccttgtcatcctcccaccttggcctcccaaagtgctgggattacaggcgygagccaccacggccggctgttatgctcatcatggcacttaagagatgcttaacaaacctttcctacaatgttcctcagattttcagagcttatttgatct

SEQ ID NO: 68846 - DNA, 201 bp, Homo sapiens
tagttggtattgtcctagttcctgttaccagaatattccatctttcatcgttgccttctctcatagttttatgtatcaaaaagtttattgtaaagctaggscgggcacggtgtcttgggctggtaatcccagcactttgggaggccaaggctggcagatcagttgaggtcaggagttcgagaccagcgtggccaacatggt

SEQ ID NO: 68847 - DNA, 201 bp, Homo sapiens
taaatcctgttatttagactaatatcttaagtctgttattaagtccgatttctgacgctattaagttaggtgaacaaccttggtaacttaacctctgaacyacagttacttcatctgtaaaatagggatgtatgtatggtaacgattttttaaccacaacttcccaactctaagatggtctgaaaagaattttttgagtgt

SEQ ID NO: 68848 - DNA, 201 bp, Homo sapiens
gcttgtctgtaaaggattttatttctccttcacttgtgaaacttagtttggctggttatgagattctgggttgaaaattctttaagaatgctgaatattgrcccccactctcttctggcttgtagggtttctgctgagagatctgctgttagtctgatgggcttccctttgtgggtaacccgacctttctctctggcagcc

SEQ ID NO: 68849 - DNA, 201 bp, Homo sapiens
cactccatcgtccaggctagaatgctgtggcctgaacatgactcactccagttttgacttccttggctgaagccatcctcccacctcggcttcctgatccygagtagctgggactccaggcacgtgtcaccaatgcatggctaatttttaaatttttttgtagacacaatgtctcgctgcattgcccaggctggtcttgaa

SEQ ID NO: 68850 - DNA, 201 bp, Homo sapiens
cagggtaagtattctgtaagtattagctatttggtctattttgttggagtaaagtgggttatagttaaaatcctaagatttttaaagtccctcaagttcaygtggacatctgcctaggtcctactatcctagaattcgcatgtcttatcacacaaataactgattcttccatatcttataaataaaggtttgatttagcaa

SEQ ID NO: 68851 - DNA, 201 bp, Homo sapiens
acagagagagactcccatctcaaaatttttttttttaaatgcagaggttggactgcctacctatactctaatttctattctggagtgattctctggagagkctaggtaaagactgaaaaggcattgttacgtccacctgtcatctcacttggacaagaatccaggagaaactattgaactgaggtgacaaagttatgatca

SEQ ID NO: 68852 - DNA, 201 bp, Homo sapiens
tttttggtatttttagtagagacggggtttcaccatgttggtgaggctggttttgaactcttgacctcaagtgatctgctcgccttggtctcccaaagtgytaggattacaggcgtgagccactgcacccggcctttttttttttttttttgaggggggggtctcactccatcgtccaggctagaatgctgtggcctgaac

SEQ ID NO: 68853 - DNA, 201 bp, Homo sapiens
cggctgattttttggtatttttagtagagacggggtttcaccatgttggtgaggctggttttgaactcttgacctcaagtgatctgctcgccttggtctcycaaagtgctaggattacaggcgtgagccactgcacccggcctttttttttttttttttgaggggggggtctcactccatcgtccaggctagaatgctgtg

SEQ ID NO: 68854 - DNA, 201 bp, Homo sapiens
atttctccttcacttgtgaaacttagtttggctggttatgagattctgggttgaaaattctttaagaatgctgaatattggcccccactctcttctggctwgtagggtttctgctgagagatctgctgttagtctgatgggcttccctttgtgggtaacccgacctttctctctggcagcccttaacattttttccttcat

SEQ ID NO: 68855 - DNA, 201 bp, Homo sapiens
cctgcctcagcctgctgagtagctgggattacaggcacctgccactacgcccggctgattttttggtatttttagtagagacggggtttcaccatgttggygaggctggttttgaactcttgacctcaagtgatctgctcgccttggtctcccaaagtgctaggattacaggcgtgagccactgcacccggcctttttttt

SEQ ID NO: 68856 - DNA, 201 bp, Homo sapiens
caggctggagtgcagtggtggcgggacctcagctagatgcagcctccgcctcctgggttcaagcaattctcctgcctcagcctgctgagtagctgggattrcaggcacctgccactacgcccggctgattttttggtatttttagtagagacggggtttcaccatgttggtgaggctggttttgaactcttgacctcaagt

SEQ ID NO: 68857 - DNA, 201 bp, Homo sapiens
gagatcttgactcactgcaacctccgccccctaggttcaagcaattcttctgtctcaccctcctgagtagctgggattacaggcgcctgccaccgtacccrgctagtttttgtatttttagtagacacagggtttcaccaccttggccaggctggtcttgaactcctgacctcgtgatccaccctcctcggcctcccaaag

SEQ ID NO: 68858 - DNA, 201 bp, Homo sapiens
ggggatcagctgtctgtgccctgctgcattctggaataaaactctgagggactaagaattctaaattcaaacctgaatcaaccaggttgttacaaagatawgtttgtcagtgcaggaggatacaatatattttacttaagttactagctcgattgatcatttttaaatttttagctacatatagtatgtgggcctccattt

SEQ ID NO: 68859 - DNA, 201 bp, Homo sapiens
tttttagctacatatagtatgtgggcctccatttgtcctcttatcccaggccttgcagaatttaggaataagcctcaatacagtgttctaacccagtgacytccgcctcgatgtacagtagattgaacctgatcctttatactttagtgatcattagttgataccagttcaagtcaggctttctagaaatctcattgtatg

SEQ ID NO: 68860 - DNA, 201 bp, Homo sapiens
tcaagtcaggctttctagaaatctcattgtatgttaggggttcgattagagtacagtcatgcatcacttaatgaatggccacaggatacattctgagaaaygcattgatagatgatttcatcattctgtgaacatcatagagtgtacttacacataccaagatggcatagctactacagacgtaggctctgtggtacaggc

SEQ ID NO: 68861 - DNA, 201 bp, Homo sapiens
taatagcaataatagtgttcacttattgagcattttactatgagttacttactaaatatatttcatcgttaatttactctttgtgttatttgatctataayatcgtttaacagggaaattacctagtacataatgtactgttatctacattttatctagatgaggaaactgaggcacagagaaattaagtactttgcctag

SEQ ID NO: 68862 - DNA, 201 bp, Homo sapiens
gtatgttgaacagccttgcatcccagggatgaagccgacttgatcgtggtggataagctttttgatgtgctgctggattcaatttgccattattttatagmggattttcgcatcaacgttcatcagggatattggcctaaaattctctttttttattgtttgtctgccaggctttggtatcaggatgatgctggcctcata

SEQ ID NO: 68863 - DNA, 201 bp, Homo sapiens
aattcatctgtttaggttgaatgtctcatcataaacagtttattccagagttaattccaaaccagcagctatgtaggatatcagccaggctaggagtaggrtactggagagaagtgcttatctagacaaagggatgtaattgaccatgaagattaaaactacacatcaaaacataaggtagggttaggagtcttgcctatt

SEQ ID NO: 68864 - DNA, 201 bp, Homo sapiens
tagcttatttgcatagaggtgttgatagtattctccagtggtagtttgtatttctgtgggattggtggtgatatcccctttatcattttttattacgtctwtttgattcttctgtcttttcttcttgctagcggtctatcaattttgttgatcttttcaaaaaaccagctcctggattcattaatttttttttttgaaggg

SEQ ID NO: 68865 - DNA, 201 bp, Homo sapiens
gaactaattgggggagggatgccatggttgaaaacatggctggggcagcgagaagttaagatgaagtcccaagagtcgcaagaacatgcagttccaggacrtgattctctgcagggacaaagagagacagcagctacaagtctataggcagtgacaaaggatctgagatcccatcagagtagacttcaagttggagaaacc

SEQ ID NO: 68866 - DNA, 201 bp, Homo sapiens
cttttcacatagtcgcatatttattgaagcctttgttcatttcttttcattcttttttctctaatcttgtcttcttgctttatttcattaatttgatcttygatcactgatatcctttcttctgcttgatcgaatcggctattgaagcttgtttatgctttgtgaaattcttgtactttggttttcagctccatcaggtca

SEQ ID NO: 68867 - DNA, 201 bp, Homo sapiens
cccatggccgcagccgcctgcggcaccaaggccatggccctcttcaagcgcaccttggtgctgagtcccgccgcggcgcccaggggcccgggcgcaggcascgccccgcggggctgctgcttgcctcctgccgcctggccctgcaaggactggcctcggggagagggcggcaggctgtggagccgcctgccccagtcccac

SEQ ID NO: 68868 - DNA, 201 bp, Homo sapiens
gcctagtattattccactgtgtggatagaccacatttatccattcatcagttggaggatatttgggttcttcccattttttttggctatggtgaatagtastgtgtacatttgcatataaggttttgtgtagatgtgtgttttcctttttcttgggtctatgctgagaagtggaattgctggttcatacagcagctcgaac

SEQ ID NO: 68869 - DNA, 201 bp, Homo sapiens
agggcaagcttaccaggcacttacagagaaggttgacgaggatgacagggaactaattgggggagggatgccatggttgaaaacatggctggggcagcgaraagttaagatgaagtcccaagagtcgcaagaacatgcagttccaggacgtgattctctgcagggacaaagagagacagcagctacaagtctataggcagt

SEQ ID NO: 68870 - DNA, 201 bp, Homo sapiens
ccaaaactttgggaggctgaggcaggcagatcacttgaggtaaggagttcgagaccagcctggccaatatggcaaaaccctgtctctactaaaaatacaayatttagccaggtgtggtggtgcacacttgtcatcccagctattccggagcctgagacatgagcatcgcttgaactcgggaggtggaggttgtagtgagct

SEQ ID NO: 68871 - DNA, 201 bp, Homo sapiens
ttaaaggttttatttcactttcaagttatcaggatccagggaggtgtaatacacttagaggatagactcagctcatttcccagctatgcctttcagcagcwttcttaccagagtaggaatataatgttagtcattatttagaggcctggccatcttgagaaggtttactgtttagtctgcagtacaattataactgttttt

SEQ ID NO: 68872 - DNA, 201 bp, Homo sapiens
aaccctgggaaggtcctggtgatttgactctcacaggacacctgatgaccagaggatgggtttcctttgatgggaaatctgtggcgattcattgatgggcytctgaattctgctgaagcagaggaagtagtaataccccatttataatggaagtgcattctcacttaaaaacaactaatattattctagctggacctagcc

SEQ ID NO: 68873 - DNA, 201 bp, Homo sapiens
tttttcttttattatactttaagttctagggtacatgtgcacaacgtgcaggtttgttacataggtatacatgtgccatgttggtttgctacacccatcarctcgtcatttacattaggtatttctcgtaatgctatccctcccttggccccccaccccacaacaggccccggtatgtgatgttcccctccttgtgtccat

SEQ ID NO: 68874 - DNA, 201 bp, Homo sapiens
cacccatcaactcgtcatttacattaggtatttctcgtaatgctatccctcccttggccccccaccccacaacaggccccggtatgtgatgttcccctccytgtgtccatgtgttctcattgttcaactcccacttaggagtgagaacatgtagtgtttggttttctgtcgttgtgatactttgctcagaatgatgatttc

SEQ ID NO: 68875 - DNA, 201 bp, Homo sapiens
ttgagaaaccactcttgtcttacccctcttttgcagacacagggctcagagaagggaaggggattgtctggggatgtatagtgaggcagtggctgccttgraagtggagtctcagtctcccggctcctaggccagcccctgaccactgttccattgtctcccagacagaacatcagccacgggcatgtgatgcatgagcgt

SEQ ID NO: 68876 - DNA, 201 bp, Homo sapiens
tctctttttttttttttttttttttgagatggagtcttgctctgttacccaggctggagtgcagtggtggcgggacctcagctagatgcagcctccgcctsctgggttcaagcaattctcctgcctcagcctgctgagtagctgggattacaggcacctgccactacgcccggctgattttttggtatttttagtagagac

SEQ ID NO: 68877 - DNA, 201 bp, Homo sapiens
gatctcctgatctcgtgatccgcccgtctcagcttcccaaagtgctgggattacaggcatgagccatcgtgcccggctgaatgtgcagagttcttaaaacmgtgtcaagaacataaaatagttatttgttctttcatataatgatgattttgagggcctgcggatcttgacatgttatcagattggtcaaaaaaagattaa

SEQ ID NO: 68878 - DNA, 201 bp, Homo sapiens
agaaaatggtagcattggtttcctgttgggagggaaagtgggtggtcatggtaagtgggtagagaaagacttcacagtatactgtttttgtacattttgartttttttaaaagcgagacttgagctattctagctctgataatatggtgcagtatttgttatgttagttgtagtctttctgggcagtttttacatccccat

SEQ ID NO: 68879 - DNA, 201 bp, Homo sapiens
gaatgaactatgcagataacatcacatgaaggccgtttctggaatgaagtctgactcctccagtttcaccacctcttccggagctctccccgccttgctgycttccatcgcttcatcctcggtgcttcctgagttttaaaatcgcctatctacgcttccaagttccaatgagttatctaacgtctatggattagctaggtg

SEQ ID NO: 68880 - DNA, 201 bp, Homo sapiens
agggaaatcccctgaccccttgcacttcctggatgaggtgacgtcctgccctgctttggctcaccctccatgggctgcacccactgtccaaccagtgccartgagatgaaccaggtacctcagttggaaatgcagaaatcacccatcttctgcatcgatcttgctgggagctgtagaccagagctgttcctactgggacat

SEQ ID NO: 68881 - DNA, 201 bp, Homo sapiens
cgtttttattctatgccagaaggcttgatttcctttaaatcaatccattgattcgaagacatttcattggaggaatttaaaatggaaggattataatcaastgtgtgtttttattttttatttttttgagacggagtctcactttgttgcccaggctgcagtgtggtgtggtgatctcggctcgtgggttcaagcgattct

SEQ ID NO: 68882 - DNA, 201 bp, Homo sapiens
ccagtgagatgaaccaggtacctcagttggaaatgcagaaatcacccatcttctgcatcgatcttgctgggagctgtagaccagagctgttcctactgggrcatcttggaagcaactctgggtctgagtttctgtttgttgccctgatgtatatccccagtgcctagaatgatacttgttacataggaagtgcttgatcca

SEQ ID NO: 68883 - DNA, 201 bp, Homo sapiens
atgaccttcatccctgccttaggaggatctctggagcagctttgctcatagtgtctctgactgcagtgacttacggaaaaaactaataattgggaaaatamtagtacctaacagttgagactaagtgttgtggttggtgccgttggaactccatggaacatgttcctcatggaagaggtggggaagggggaatgtgggcag

SEQ ID NO: 68884 - DNA, 201 bp, Homo sapiens
taatggaggcgtggcaggtggctaggcaaggagcaggaagcctattccaggcaggtgaattgcttgggccaaggccggatgtgaagtactgtagcctgttygggggacaataagtgctgctaggactggatcagggtgtgaaagtagtacaagaatgggtggacaggaggctgaaatcccaacaaaggatgtagatgccaa

SEQ ID NO: 68885 - DNA, 201 bp, Homo sapiens; identical to SEQ ID NO: 3318

SEQ ID NO: 68886 - DNA, 201 bp, Homo sapiens; identical to SEQ ID NO: 23705

SEQ ID NO: 68887 - DNA, 201 bp, Homo sapiens
acctaacaaaataaaggataggcatgaaaaatccacagccaccatcatacaaaatggggaaacactgaaagcttttcctctaagaactggaacaaaacaartatgcccaccttcaccacttttattcagcatagtgctggaagtcttggccagagaaatcaggcaagagaaagaaataaagggcaaggatgtcaaattttc

SEQ ID NO: 68888 - DNA, 201 bp, Homo sapiens
gaccacacattgggctacaaagcaagtctcaacaagtttaaaagtactgaaatcacatcaagtatactttctgacggcaaggaaataaagctagaaatcartaacagaaataactttcaaaactgtacaaatacatcaaaattaacaacatgctcttgaacaaccaatggattaataaaaaattaggaagtacatttaaaa

SEQ ID NO: 68889 - DNA, 201 bp, Homo sapiens; identical to SEQ ID NO: 23597

SEQ ID NO: 68890 - DNA, 201 bp, Homo sapiens
tagcacatggaaaaatctcctggagagaccacacattgggctacaaagcaagtctcaacaagtttaaaagtactgaaatcacatcaagtatactttctgayggcaaggaaataaagctagaaatcaataacagaaataactttcaaaactgtacaaatacatcaaaattaacaacatgctcttgaacaaccaatggattaa

SEQ ID NO: 68891 - DNA, 201 bp, Homo sapiens
aacaactagcaaacaatgaataaaatgacagaagaaggttcttacctataataactttgaatgtaaacagattaaatcccccacttaaaatatatagactrgctgaatggattttttaaatgacccaactatgtgcttcccataagaaactcactttacctatcaaaaaacatatagactgaaagtgaagggatggaaaaa

SEQ ID NO: 68892 - DNA, 201 bp, Homo sapiens
agtgaaaagaggatcattaccatcatgacaacatgcaaaagtataaaatccactggcaaagcagatacacataagagaaaagaatcaaaccttattactayagaaaactaccaaaaccacaatcgtaaacaataagagaggaagagaggaataaaagatatacaaaacaactagcaaacaatgaataaaatgacagaagaa

SEQ ID NO: 68893 - DNA, 201 bp, Homo sapiens
ctatgtgcttcccataagaaactcactttacctatcaaaaaacatatagactgaaagtgaagggatggaaaaagacattctacccaagtgggaaccaaaakcaaataggagtagctatgtttatatcagataaaaataaaacagacaagggataaattcagcaagagcatataacaatagtaaatatatatgcacccaaaa

SEQ ID NO: 68894 - DNA, 201 bp, Homo sapiens
acctttctgatattttcattgtgatttcactgaatctatagatttagttgggaagaactgacatcctgacaatattgagctttttgtcttacaagaaatgytcaagggagtcctgcatctggaagtgaaaagaggatcattaccatcatgacaacatgcaaaagtataaaatccactggcaaagcagatacacataagaga

SEQ ID NO: 68895 - DNA, 201 bp, Homo sapiens
attgataccacagaaatacaaagaatcattggagtctattacaatcaaccatgagtcaacaaattggaaagcctagtaaaaatgtataatttctcaggcayatacaacctatcaagattgaaccaaaaagaaatagagagtctaaacagactaattacaagtaatgaaatataaccagtaataaaaactctctcatcaaag

SEQ ID NO: 68896 - DNA, 201 bp, Homo sapiens; identical to SEQ ID NO: 23714

SEQ ID NO: 68897 - DNA, 201 bp, Homo sapiens; identical to SEQ ID NO: 23608

SEQ ID NO: 68898 - DNA, 201 bp, Homo sapiens; identical to SEQ ID NO: 23610

SEQ ID NO: 68899 - DNA, 201 bp, Homo sapiens; identical to SEQ ID NO: 23611

SEQ ID NO: 68900 - DNA, 201 bp, Homo sapiens; identical to SEQ ID NO: 23613

SEQ ID NO: 68901 - DNA, 201 bp, Homo sapiens
attttgtaaaatcaatgtcttacctttttattacaatagatcatgttttgtattcaataaagcaagaagcccttttatctgttgtttttcagggaagggaktaacatttaattctgtttgtttacatttgttttcattgttatccaatgctcattttatgttgctttataagtaagcttaggtataacagaataagtatct

SEQ ID NO: 68902 - DNA, 201 bp, Homo sapiens; identical to SEQ ID NO: 23731

SEQ ID NO: 68903 - DNA, 201 bp, Homo sapiens; identical to SEQ ID NO: 3320

SEQ ID NO: 68904 - DNA, 201 bp, Homo sapiens; identical to SEQ ID NO: 3323

SEQ ID NO: 68905 - DNA, 201 bp, Homo sapiens
ttaaaagatcatgtgtgttttgtaatagcaaaatttgattttaattttttatttggaattggtgtatttatcatggggacttccagtttttcttcactttkcaaatggatattggctatagttttatgttttaatgggaatgaatttcaagtcaattaataatcagaaaatttttagttttacttttttcttttacaatat

SEQ ID NO: 68906 - DNA, 201 bp, Homo sapiens
aatctgtattagtcagtggtctttagagcaacagactagtaggatagatgtacatataaaggggggtttattaaggaatattgactcacacaatctcaagktgaggtcccacagtaggctgtctgcaaggtgaggagcaaggaaactagtccaagtctcaaagatgaggaatttggagtttgatgttcaagggcagaaagc

SEQ ID NO: 68907 - DNA, 201 bp, Homo sapiens
actagacccctctctttcatcctattcaaaaatcaaatcaagatagatgtattagttagggttctctagagggacagaattagtaggatagatgtatgaaycccacttctggtaccaaaatctgtattagtcagggttctctagagggacagaactaataggatagatgtatgaaccccactcctggtgccaaaatctgta

SEQ ID NO: 68908 - DNA, 201 bp, Homo sapiens
tatcacagaagaccccaaatagccaaagctgtcctgagaaaaaagaacttagatggagatattacactgccaacttcaaattatactacaatgctatagcsaaaaccatatagtactggtataaaaagagatgcatagaccaatggaacagaacagagaacccagaaataaatccatgaatttagagccaactaatttttg

SEQ ID NO: 68909 - DNA, 201 bp, Homo sapiens
ttcgtgtggtatcacagaagaccccaaatagccaaagctgtcctgagaaaaaagaacttagatggagatattacactgccaacttcaaattatactacaawgctatagccaaaaccatatagtactggtataaaaagagatgcatagaccaatggaacagaacagagaacccagaaataaatccatgaatttagagccaac

SEQ ID NO: 68910 - DNA, 201 bp, Homo sapiens; identical to SEQ ID NO: 23639

SEQ ID NO: 68911 - DNA, 201 bp, Homo sapiens; identical to SEQ ID NO: 23640

SEQ ID NO: 68912 - DNA, 201 bp, Homo sapiens; identical to SEQ ID NO: 23641

SEQ ID NO: 68913 - DNA, 201 bp, Homo sapiens; identical to SEQ ID NO: 23642

SEQ ID NO: 68914 - DNA, 201 bp, Homo sapiens; identical to SEQ ID NO: 23643

SEQ ID NO: 68915 - DNA, 201 bp, Homo sapiens
ataaaacaaagagttttgtttgtaaaaaaataaacaaaattaacaaatgtttagctaaacaaagtaagaaaaaagaaagactcaaataaatgaaatcagamatgaaaaaggagacatgacaattgataccacagaaatacaaagaatcattggagtctattacaatcaaccatgagtcaacaaattggaaagcctagtaaa

SEQ ID NO: 68916 - DNA, 201 bp, Homo sapiens; identical to SEQ ID NO: 23644

SEQ ID NO: 68917 - DNA, 201 bp, Homo sapiens; identical to SEQ ID NO: 23645

SEQ ID NO: 68918 - DNA, 201 bp, Homo sapiens
taaaatacaaaagatcaataaaacaaagagttttgtttgtaaaaaaataaacaaaattaacaaatgtttagctaaacaaagtaagaaaaaagaaagactcmaataaatgaaatcagacatgaaaaaggagacatgacaattgataccacagaaatacaaagaatcattggagtctattacaatcaaccatgagtcaacaaa

SEQ ID NO: 68919 - DNA, 201 bp, Homo sapiens; identical to SEQ ID NO: 23646

SEQ ID NO: 68920 - DNA, 201 bp, Homo sapiens; identical to SEQ ID NO: 23647

SEQ ID NO: 68921 - DNA, 201 bp, Homo sapiens; identical to SEQ ID NO: 23648

SEQ ID NO: 68922 - DNA, 201 bp, Homo sapiens; identical to SEQ ID NO: 23649

SEQ ID NO: 68923 - DNA, 201 bp, Homo sapiens; identical to SEQ ID NO: 23652

SEQ ID NO: 68924 - DNA, 201 bp, Homo sapiens; identical to SEQ ID NO: 23653

SEQ ID NO: 68925 - DNA, 201 bp, Homo sapiens; identical to SEQ ID NO: 23769

SEQ ID NO: 68926 - DNA, 201 bp, Homo sapiens; identical to SEQ ID NO: 23768

SEQ ID NO: 68927 - DNA, 201 bp, Homo sapiens; identical to SEQ ID NO: 23654

SEQ ID NO: 68928 - DNA, 201 bp, Homo sapiens; identical to SEQ ID NO: 23772

SEQ ID NO: 68929 - DNA, 201 bp, Homo sapiens; identical to SEQ ID NO: 23771

SEQ ID NO: 68930 - DNA, 201 bp, Homo sapiens; identical to SEQ ID NO: 23655

SEQ ID NO: 68931 - DNA, 201 bp, Homo sapiens; identical to SEQ ID NO: 23656

SEQ ID NO: 68932 - DNA, 201 bp, Homo sapiens; identical to SEQ ID NO: 23657

SEQ ID NO: 68933 - DNA, 201 bp, Homo sapiens; identical to SEQ ID NO: 23658

SEQ ID NO: 68934 - DNA, 201 bp, Homo sapiens; identical to SEQ ID NO: 23659

SEQ ID NO: 68935 - DNA, 201 bp, Homo sapiens
atcagacatgaaaaaggagacatgacaattgataccacagaaatacaaagaatcattggagtctattacaatcaaccatgagtcaacaaattggaaagccwagtaaaaatgtataatttctcaggcatatacaacctatcaagattgaaccaaaaagaaatagagagtctaaacagactaattacaagtaatgaaatataa

SEQ ID NO: 68936 - DNA, 201 bp, Homo sapiens; identical to SEQ ID NO: 23664

SEQ ID NO: 68937 - DNA, 201 bp, Homo sapiens; identical to SEQ ID NO: 23665

SEQ ID NO: 68938 - DNA, 201 bp, Homo sapiens; identical to SEQ ID NO: 23667

SEQ ID NO: 68939 - DNA, 201 bp, Homo sapiens; identical to SEQ ID NO: 23668

SEQ ID NO: 68940 - DNA, 201 bp, Homo sapiens; identical to SEQ ID NO: 23778

SEQ ID NO: 68941 - DNA, 201 bp, Homo sapiens; identical to SEQ ID NO: 23670

SEQ ID NO: 68942 - DNA, 201 bp, Homo sapiens; identical to SEQ ID NO: 23672

SEQ ID NO: 68943 - DNA, 201 bp, Homo sapiens; identical to SEQ ID NO: 23673

SEQ ID NO: 68944 - DNA, 201 bp, Homo sapiens; identical to SEQ ID NO: 23674

SEQ ID NO: 68945 - DNA, 201 bp, Homo sapiens; identical to SEQ ID NO: 23675

SEQ ID NO: 68946 - DNA, 201 bp, Homo sapiens; identical to SEQ ID NO: 23676

SEQ ID NO: 68947 - DNA, 201 bp, Homo sapiens; identical to SEQ ID NO: 23677

SEQ ID NO: 68948 - DNA, 201 bp, Homo sapiens; identical to SEQ ID NO: 23678

SEQ ID NO: 68949 - DNA, 201 bp, Homo sapiens; identical to SEQ ID NO: 23679

SEQ ID NO: 68950 - DNA, 201 bp, Homo sapiens
aggggggtttattaaggaatattgactcacacaatctcaaggtgaggtcccacagtaggctgtctgcaaggtgaggagcaaggaaactagtccaagtctcraagatgaggaatttggagtttgatgttcaagggcagaaagcaaccagcgagggagaaagatgtaggctgggacgataagccagtctagtctcttcacgtt

SEQ ID NO: 68951 - DNA, 201 bp, Homo sapiens; identical to SEQ ID NO: 23792

SEQ ID NO: 68952 - DNA, 201 bp, Homo sapiens; identical to SEQ ID NO: 23793

SEQ ID NO: 68953 - DNA, 201 bp, Homo sapiens; identical to SEQ ID NO: 23794

SEQ ID NO: 68954 - DNA, 201 bp, Homo sapiens; identical to SEQ ID NO: 23796

SEQ ID NO: 68955 - DNA, 201 bp, Homo sapiens; identical to SEQ ID NO: 23795

SEQ ID NO: 68956 - DNA, 201 bp, Homo sapiens; identical to SEQ ID NO: 23797

SEQ ID NO: 68957 - DNA, 201 bp, Homo sapiens; identical to SEQ ID NO: 23799

SEQ ID NO: 68958 - DNA, 201 bp, Homo sapiens; identical to SEQ ID NO: 23798

SEQ ID NO: 68959 - DNA, 201 bp, Homo sapiens; identical to SEQ ID NO: 23801

SEQ ID NO: 68960 - DNA, 201 bp, Homo sapiens; identical to SEQ ID NO: 23800

SEQ ID NO: 68961 - DNA, 201 bp, Homo sapiens; identical to SEQ ID NO: 23804

SEQ ID NO: 68962 - DNA, 201 bp, Homo sapiens; identical to SEQ ID NO: 23803

SEQ ID NO: 68963 - DNA, 201 bp, Homo sapiens; identical to SEQ ID NO: 23806

SEQ ID NO: 68964 - DNA, 201 bp, Homo sapiens; identical to SEQ ID NO: 23816

SEQ ID NO: 68965 - DNA, 201 bp, Homo sapiens; identical to SEQ ID NO: 23822

SEQ ID NO: 68966 - DNA, 201 bp, Homo sapiens
tagtaaatatatatgcacccaaaactggagcacctagctacagaaaacaattattattagatctaaagggagagatagactcccatacaataatagttgtrgacttcaataacccaatctcaatactggacagatcatctagacaggaagtcaacaaagatacattgtatttaaatttcactttagaccaaatagacttaa

SEQ ID NO: 68967 - DNA, 201 bp, Homo sapiens; identical to SEQ ID NO: 23823

SEQ ID NO: 68968 - DNA, 201 bp, Homo sapiens
atagtaaatatatatgcacccaaaactggagcacctagctacagaaaacaattattattagatctaaagggagagatagactcccatacaataatagttgyggacttcaataacccaatctcaatactggacagatcatctagacaggaagtcaacaaagatacattgtatttaaatttcactttagaccaaatagactta

SEQ ID NO: 68969 - DNA, 201 bp, Homo sapiens; identical to SEQ ID NO: 3338

SEQ ID NO: 68970 - DNA, 201 bp, Homo sapiens
cctggagcatctttttgccttctctctctctctcttttttttttttatatgaagtctcgctctgtcaccaggctggagtgctgtggcgcgatctaggcttrctgcaacctccaactccctggttcaagtgattttcctgcctcagcctcccgagtagctgggattacaggtacatgccaccacgcccagctaattttttgt

SEQ ID NO: 68971 - DNA, 201 bp, Homo sapiens
tttgagcctggagcatctttttgccttctctctctctctcttttttttttttatatgaagtctcgctctgtcaccaggctggagtgctgtggcgcgatctrggcttactgcaacctccaactccctggttcaagtgattttcctgcctcagcctcccgagtagctgggattacaggtacatgccaccacgcccagctaatt

SEQ ID NO: 68972 - DNA, 201 bp, Homo sapiens
ggtgtcgggctggggggacgatcagatctttcccatcccacgaggccatgtttcagactatcccatggggagaaatcttggacagtacctgactttccagrgcagaggtccctgcggctttctgcagtgcattgtgcccctggttactcgagaatggagaatggcgatgacttttaccaagcacactgcctgcaaacattt

SEQ ID NO: 68973 - DNA, 201 bp, Homo sapiens
tcaccatattgcccaggctagtcttgaactcctgggctcaagcgatcctcctatcttgacctcccaaagtgctgggattacaggcatgactcactgtgccyggcccattttattttttttcatgtaacaaacaatgctgcaatgaatcactttgagcctggagcatctttttgccttctctctctctctcttttttttttt

SEQ ID NO: 68974 - DNA, 201 bp, Homo sapiens
ggcatggtcccatgcgcctgtaatcccagctacttgggaggctgaggcaggagaatcgcttgaacccgggaggtggaggttgcagtgagccgagatcgcaycactgcactccagcctgggcaacaagagcaaaactccgtttcaaataaataaataaataaataaataaataaataaataaataaaagtttcccatctcat

SEQ ID NO: 68975 - DNA, 201 bp, Homo sapiens
ccgagacattcagttcccaggggcaggcaggagacagaggccttcctcttagctcaactgcaagaggccttcctcttttactaatcctcctcagcacagayccttcacgggtgtcgggctggggggacgatcagatctttcccatcccacgaggccatgtttcagactatcccatggggagaaatcttggacagtacctga

SEQ ID NO: 68976 - DNA, 201 bp, Homo sapiens
atcggggcagtggtggtcagcgggtgcctgcttcttggacttgccatcgctggccctgtgctggcctggagactctggcgatgccgagtggccagaagccsggagctgaacaaaccctgggctgctcaggatgggcccaagcccggtttaggcttgcagccacggtacggcagccggagcgcccccaagccccaagtggcc

SEQ ID NO: 68977 - DNA, 201 bp, Homo sapiens
gcaccctggcatggacgctgctgttgccgctgctgctgcgggagtcagacagcctagaaccgtcgtgcaccgtgtcctccgcggatgtggactggaacgcrgagttcagtgccacgtgcctgaatttcagtggcctcagcctgagcctgcctcacaaccagtctctgcgggccagcaacgtgattctccttgacctgtctg

SEQ ID NO: 68978 - DNA, 201 bp, Homo sapiens
ccaggaagctctgccgccccctccctgtccctcatgccgctcctcagctccctcagctcctagagggggaagaggagagacccccaacaaggggacaggasggtcactgtgccaatcctgtcatcaccctcctgtggatgtacaggcagtgctcaataaatgcttcgaggctgatgaggctgctggctcagggtgcgtggg

SEQ ID NO: 68979 - DNA, 201 bp, Homo sapiens
ccactgcactccagcctgggcaacagaggaagactccctctcaaaaaaaaaaaaaaaaaaaaaaaaaagggcatttctccccttgaatctcctgaatctcmgtatggctggctcctcctcttccttccagcctgcctaaaataggaagcaccctattttatttccttgtgtatcattcatattccctacttagaatcttag

SEQ ID NO: 68980 - DNA, 201 bp, Homo sapiens
aagacggtcatctgcaaactaggaagtgaatctgctggtgccttgatcttggacttcccagcttccggaactgttgttcataagctaccccagtttacggyatatttgttatagcagcctgaacaaacatttggagacatctgctctctacccagggctgctcccaccacagggcctttgcacatgctgttcccactcctg

SEQ ID NO: 68981 - DNA, 201 bp, Homo sapiens
gtgatctcggctcaactgcaaactctacctcccaggctcaagtgattctcctgcctcagcctcccaagtagctgggattacaggcatgcgccaccacaccyggctaattttgtgtatttagtagagatggagtttctccacgttggtcaggctagtctcaaactctggacctcaggtgatccgcccacctcagcctcccaa

SEQ ID NO: 68982 - DNA, 201 bp, Homo sapiens
caagcacactgcctgcaaacattttattagcaaagcacatcctgcacagccctagatcccttaaaccttgattccatacaacacatatttctgtgagctcraggttggggctaaagttacagattaacagcatctcagggcaaagcaattgttcagggtatgggtcaaaatgaagttttttatgtcttccttttctacata

SEQ ID NO: 68983 - DNA, 201 bp, Homo sapiens
ggtcggtgttcgaatcttcccagctctggttggcccgcagcctggttagcaggtcctcgtagcgtttccgcaactctcggaatctggagtcttcggagtgyaactctgagggtcccgggaaacttgcgcggctcgcctcggccagagacagggcgcccccatgcggcagccacgagagcaccagcaacaccaggagcatct

SEQ ID NO: 68984 - DNA, 201 bp, Homo sapiens
gctgaacaaaccctgggctgctcaggatgggcccaagcccggtttaggcttgcagccacggtacggcagccggagcgcccccaagccccaagtggccgtgmcatcctgcccctccactcccgactatgagaacatgtttgtgggccagccagcagccgagcaccagtgggatgaacaagggtaagtaagccactgagacac

SEQ ID NO: 68985 - DNA, 201 bp, Homo sapiens
gtggcttatgtcagtaatctcagcactttgggaggccgaggtgggtggattgtttgagcccaggagttcgagacaagtctgggcaagatggcaatacctcrtctctaaaaaaaagaattctgcgccgggcacggtggctctcgcctgtaatcccagcactttgggaggccgaggcacgtggatcatctgacgtcaagagtt

SEQ ID NO: 68986 - DNA, 201 bp, Homo sapiens
aaacaaaggaagcagaggagaacgggctagatggagccaggaagggcaaccttgatgtgtcatgcctctctgccatgcctgtttcctcaccaggaaaaaarggactgagactctcactggagaggtggtcaaatgaggggtaaagcacagggccagacacataggaggcacttgataaactgggtgttattgcagttactc

SEQ ID NO: 68987 - DNA, 201 bp, Homo sapiens
ccccagacccacctccaaaactcactatcccagaccccaggcctgcctgtcccccaccacctgcagcctcgggtctggcacttcctcatttctttatttchaagaggcctcagaactgggcgtggaggacgtgcagctgcatgaggctcactgctggctgggctcctccatccctctgctccttataaaagaggccccaag

SEQ ID NO: 68988 - DNA, 201 bp, Homo sapiens
tctagcaagagggaagcgggactctggtccacccctccctcttgccctccatccacctctggtgagaaccttgaggccctgcaagggggcggatctctgtyttcattcttcccctctgcactccacccagacaccagttcctcttccccctgagtcgctgggtgcagagccagaggaacgccagcgaccccagcagcgctg

SEQ ID NO: 68989 - DNA, 201 bp, Homo sapiens
ctttgggaggccgatgcaggtggatcacttgaggtcaggagttcaagaccagcctggccgatatgtggccaatatggtgaaacgcccgcttctactaaaamtaccaaaaattagctgggcatggtggctggcgcctgtgatcccagctactcgggaggctgaggcagaagaatggcttgaatcggggcggtggaggttgca

SEQ ID NO: 68990 - DNA, 201 bp, Homo sapiens
gctgacgccgcagcggtcgtgtcacgtcccacgaccttgacgccgtcggggacagccggaacagagcccggtgaaggcgggaggcctcggggagcccctcrggaagggcggcccgagagatacgcaggtgcaggtggccgccggatcccagccgcactgtgggaagacagatagggaagctggtcacccacaggcctaccg

SEQ ID NO: 68991 - DNA, 201 bp, Homo sapiens
aagattctgccagcagttggtccgactgcgacggcggcggcgacagtcgcaggtgcagcgcgggcgcctggggtcttgcaaggctgagctgacgccgcagmggtcgtgtcacgtcccacgaccttgacgccgtcggggacagccggaacagagcccggtgaaggcgggaggcctcggggagcccctcgggaagggcggccc

SEQ ID NO: 68992 - DNA, 201 bp, Homo sapiens
ctcaggacccttagattccaggactctcagacccctggatccccagacctcagagtccccaaatctcaggaccccacagacctcagactccaaggcccccrgctcccccagacccacctccaaaactcactatcccagaccccaggcctgcctgtcccccaccacctgcagcctcgggtctggcacttcctcatttcttta

SEQ ID NO: 68993 - DNA, 201 bp, Homo sapiens
taagaccaagtctccatctgagactcccaaattgctccccacctcccatccctgtttttttttgttgttgttgtttgtttgtttgtttttgaaactgagtstcactctgtcacccaggctggagtgcaatgctgcggtctcagctcactgcaacctccgcctcctgggttcaagtgattctcctgcctcagcctcctgagt

SEQ ID NO: 68994 - DNA, 201 bp, Homo sapiens
cccctggcggcttgcggccgcaagtgcaactccagctggggccgtgcggacgaagattctgccagcagttggtccgactgcgacggcggcggcgacagtckcaggtgcagcgcgggcgcctggggtcttgcaaggctgagctgacgccgcagcggtcgtgtcacgtcccacgaccttgacgccgtcggggacagccggaac

SEQ ID NO: 68995 - DNA, 201 bp, Homo sapiens
tccccttcactcaaccaggctccgcaaagtggggtggtccttgtgtgtctttttacagctgtgtccggggcctggcataaagtgggcactcactgaatacrttaaggggaacctgcagtcattcaggttggcctgtgggtgatggcattcccagcagatacacctcactgctggaagtgggtactctgtccctcaagacac

SEQ ID NO: 68996 - DNA, 201 bp, Homo sapiens
atgggattgtagctggcgggcacgcagcagggcgctggcaccgtgtcgggcttcaggcggtgcaggctcgtcttgatctgcgcgtgcatgtttgccgcccsgaactggctcgggcacgcgccgatgcacatggtcacttgcacctcccgtggcgacagcacccaatcggcccagcccaggtcttccagcgacgcgcggacc

SEQ ID NO: 68997 - DNA, 201 bp, Homo sapiens
ttaagaggtggctgtctatgcccatgggatttcctctcttctctttttggttggggtcaaaggctaaagatggtgaaaaacaaaggaagcagaggagaacrggctagatggagccaggaagggcaaccttgatgtgtcatgcctctctgccatgcctgtttcctcaccaggaaaaaaaggactgagactctcactggagag

SEQ ID NO: 68998 - DNA, 201 bp, Homo sapiens
taaacactccaatgaccacagctgggcggggtctgggggtgtatttagggggaggatctttaggtgggggcgctcctagtaaagctagggcacatttctgrgcctcagtatcctcttcctcgatatgaggacaccattccagcctgggagtctttttggaggaaaaaaagacattgttactatgtgaaaaattccagacaa

SEQ ID NO: 68999 - DNA, 201 bp, Homo sapiens
gggcggtggaggttgcagtgagccaagatcgtgccactgcactccagcctgggcaacagaggaagactccctctcaaaaaaaaaaaaaaaaaaaaaaaaargggcatttctccccttgaatctcctgaatctcagtatggctggctcctcctcttccttccagcctgcctaaaataggaagcaccctattttatttccttg

SEQ ID NO: 69000 - DNA, 201 bp, Homo sapiens
tacccctggtctgtctgtccccccagggctcacccttcagaggacaatgacttttacatcaactacaaggacatcgacctggcttcccagcctgtctactrtaacctgcagtcactgggccaggccccaatggatgaagaggagtacgtgatccccgggcactgagcctaagatgtcctaacctccacccagaaccccttc

SEQ ID NO: 69001 - DNA, 201 bp, Homo sapiens
taaataacagacttatataaatacagctgtttgggcaggaatcgggtgtctcaggaaccttgagcccattccacagggcaggacaactgaggtcgcgtccyccgcgcaggtgcacagtggaaggaccaggactgctcatatgcagtggcagtctttggctaacaagtcatcataggtctggagcgacaccccggtgtcggt

SEQ ID NO: 69002 - DNA, 201 bp, Homo sapiens
ataataaataacagacttatataaatacagctgtttgggcaggaatcgggtgtctcaggaaccttgagcccattccacagggcaggacaactgaggtcgcstcccccgcgcaggtgcacagtggaaggaccaggactgctcatatgcagtggcagtctttggctaacaagtcatcataggtctggagcgacaccccggtgt

SEQ ID NO: 69003 - DNA, 201 bp, Homo sapiens
ccccctacaaccacttaggggttggtgggcaattcgtactagagtataattgactgatagatgctgttaacacaaagtagcccttttgcctttttttttttcccgctctgtcgcccaggctagagtgcaatggcatgatctcggctcactgcaaccttcacctcccgggttcaagtgattctcctgcctcctgcctcagcc

SEQ ID NO: 69004 - DNA, 201 bp, Homo sapiens
gagtccccaagaaggtcaccccaataaattaataataaataacagacttatataaatacagctgtttgggcaggaatcgggtgtctcaggaaccttgagcscattccacagggcaggacaactgaggtcgcgtcccccgcgcaggtgcacagtggaaggaccaggactgctcatatgcagtggcagtctttggctaacaag

SEQ ID NO: 69005 - DNA, 201 bp, Homo sapiens
ccagagttttaaataaatacacagttccatcagaccagcccccgagtccccaagaaggtcaccccaataaattaataataaataacagacttatataaatrcagctgtttgggcaggaatcgggtgtctcaggaaccttgagcccattccacagggcaggacaactgaggtcgcgtcccccgcgcaggtgcacagtggaag

SEQ ID NO: 69006 - DNA, 201 bp, Homo sapiens
gtccccttcactcaaccaggctccgcaaagtggggtggtccttgtgtgtctttttacagctgtgtccggggcctggcataaagtgggcactcactgaataygttaaggggaacctgcagtcattcaggttggcctgtgggtgatggcattcccagcagatacacctcactgctggaagtgggtactctgtccctcaagaca

SEQ ID NO: 69007 - DNA, 201 bp, Homo sapiens
tgaactgatgggttgaatccccagcacaaatcttactgcaatcaactactttcttaggatttactcatttgtccccttcactcaaccaggctccgcaaagkggggtggtccttgtgtgtctttttacagctgtgtccggggcctggcataaagtgggcactcactgaatacgttaaggggaacctgcagtcattcaggttg

SEQ ID NO: 69008 - DNA, 201 bp, Homo sapiens
atgaagaggagtacgtgatccccgggcactgagcctaagatgtcctaacctccacccagaaccccttcagtccctgctgggtgactcagggcgtcctaackcctccatggcctcagtttccccatctgaagaatggggacaggaaaggattgtccttgaggccccaggaagctctgccgccccctccctgtccctcatgcc

SEQ ID NO: 69009 - DNA, 201 bp, Homo sapiens
ggctcacccttcagaggacaatgacttttacatcaactacaaggacatcgacctggcttcccagcctgtctactgtaacctgcagtcactgggccaggccycaatggatgaagaggagtacgtgatccccgggcactgagcctaagatgtcctaacctccacccagaaccccttcagtccctgctgggtgactcagggcgt

SEQ ID NO: 69010 - DNA, 201 bp, Homo sapiens
acctcccgtggcgacagcacccaatcggcccagcccaggtcttccagcgacgcgcggaccgtgtgcagacggcagcaacgcccgggcccgagcggacagtsgtccccgttgcgcgcacgcgctctgcggcgccccctggcggcttgcggccgcaagtgcaactccagctggggccgtgcggacgaagattctgccagcagt

SEQ ID NO: 69011 - DNA, 201 bp, Homo sapiens
atgttgtccaggctggtcttgaactcatgatctcaggtgatccacccacctcagcctcccaaagtgctggattacaggcgtgagtcagagcacctggcccrctctggactttctcaaagctcatgtgcctgtcccctgagtcctccccctcccacacttacccctggtctgtctgtccccccagggctcacccttcagagg

SEQ ID NO: 69012 - DNA, 201 bp, Homo sapiens
cccgggaaacttgcgcggctcgcctcggccagagacagggcgcccccatgcggcagccacgagagcaccagcaacaccaggagcatctgagagccattcascgtcctgagttcttgcccgggcatggctgtgcaggttgcggctctgagctgggactgaccagatgctgccggaccggcctttatagtccccggactttgt

SEQ ID NO: 69013 - DNA, 201 bp, Homo sapiens
agtagctgggactacaggcctgtgccaccatgcctggataatttttgtatttttagtagagacgaggtttcatcatgttgtccaggctggtcttgaactcmtgatctcaggtgatccacccacctcagcctcccaaagtgctggattacaggcgtgagtcagagcacctggcccactctggactttctcaaagctcatgtg

SEQ ID NO: 69014 - DNA, 201 bp, Homo sapiens
caggctggtacaagtgttagggagactggggagactggggtttgagggtgccttaacctagttgctaggcttagcaagggtgagaggtttgccggagtcayacggcacagatgggtttagggcgggctaagagtgtgcccctctgcctgccccctcctgggtcccaccacagcccagacctcatccagtgccctgcacccc

SEQ ID NO: 69015 - DNA, 201 bp, Homo sapiens
acgaggtcggtgttcgaatcttcccagctctggttggcccgcagcctggttagcaggtcctcgtagcgtttccgcaactctcggaatctggagtcttcggwgtgcaactctgagggtcccgggaaacttgcgcggctcgcctcggccagagacagggcgcccccatgcggcagccacgagagcaccagcaacaccaggagc

SEQ ID NO: 69016 - DNA, 201 bp, Homo sapiens
ttcaagaccctggtgcaatgccacctcctttgagaagctgtccctggtttcttctcaggcagagttaatgactcacagatgtctgtatttcaagagttttktcaggctcatgcctcaactgggtttcctatcagctggtcccagcccaatcctccaacctgggggagatagaactagagacaagtaccctcagtcctggga

SEQ ID NO: 69017 - DNA, 201 bp, Homo sapiens
accttccttaactgcatgggactaggagtgtctatgtccagctctgtcctctcttaagatagctccttgaggacctggtcagggctgaggcctcttggggscccagcgtgggtgatgcttgttgaatgaataaatgactgcatgagctgggaaccagccaagctgagatcaagaagcgagttgatgaggtggcagtcggtt

SEQ ID NO: 69018 - DNA, 201 bp, Homo sapiens
tccagcatagaggtgccactgtgcaagaactcagtgggagaggcttggaggagcttggagagccaatgataggtttggggaatcttagtgaactcctactyatgcgttgaagccccaactgtaatgcctcctcctccaggaagccttccaggaccctgtctttccctctggaccttccttaactgcatgggactaggagtg

SEQ ID NO: 69019 - DNA, 201 bp, Homo sapiens
gtggccactgcgcccaggcacattcctcccttctgcccctctcagggccccttcccaggtccctgatctccaggcttggcctccagagcagcccacaccamccccaaaataaaaaaatgtatatattcctttagctctaatattctgagaaaatctttcaagaccctggtgcaatgccacctcctttgagaagctgtccct

SEQ ID NO: 69020 - DNA, 201 bp, Homo sapiens
ggtttcgccatgttggccaggctggtctcgaactcctgacctcaagcgatctgcccgcctcggcctcctgaagtgctgggattacaggcgtggccactgcrcccaggcacattcctcccttctgcccctctcagggccccttcccaggtccctgatctccaggcttggcctccagagcagcccacaccacccccaaaataa

SEQ ID NO: 69021 - DNA, 201 bp, Homo sapiens
tggggtttcgccatgttggccaggctggtctcgaactcctgacctcaagcgatctgcccgcctcggcctcctgaagtgctgggattacaggcgtggccacygcgcccaggcacattcctcccttctgcccctctcagggccccttcccaggtccctgatctccaggcttggcctccagagcagcccacaccacccccaaaa

SEQ ID NO: 69022 - DNA, 201 bp, Homo sapiens
ccgccaccatgccgagctaatttttgtatttataatagagatggggtttcgccatgttggccaggctggtctcgaactcctgacctcaagcgatctgcccrcctcggcctcctgaagtgctgggattacaggcgtggccactgcgcccaggcacattcctcccttctgcccctctcagggccccttcccaggtccctgatc

SEQ ID NO: 69023 - DNA, 201 bp, Homo sapiens
gcacagaatgtcattgcattgttggatttttgccaatttgattggtgaagacaaacagtttgtgatttgcagttttcttattaagtgtgaacttttttttktttttgagacaggtctcactctgttgcccaggctggaatgcagtggagtgatcttggctcactgcagcctccacctcctgggttcaaacaattctcctgc

SEQ ID NO: 69024 - DNA, 201 bp, Homo sapiens
ccttccctaaatcactgccctcccgcagcctcctcagagagaggtggggttggctaggagtcagaacgctagcccgtgccagtttccccatatgtaaataytcggggtggactgagccactctgaagctttctttttttttttccttctgagatagagtcttgctctgtctcccaggctgaagtgcaatggcacgatctcg

SEQ ID NO: 69025 - DNA, 201 bp, Homo sapiens
tggtggaaccctgtttctactaaaaaatacaaaaattaggccgggcacggtggctcatgcctgtaatcccaacactttgggaggccaaggcaggaggatcmcgaggtcaggagttcgagaccagcctggccaatatggtgaaaccctgtctctactaaaaatacaaaaattagccgggcatggtcgtgggtgcctgtaatc

SEQ ID NO: 69026 - DNA, 201 bp, Homo sapiens
accggcttctggatgattttgctgggcttagacaaatgagttgaacttttctaggttggtgtggggtgcggtggctcatgcctataatcccagcacttttygaggccaaggcgaggtcagatcacctgtggtcaggacctcaagaccagcctgaccaacatggtggaaccctgtttctactaaaaaatacaaaaattaggc

SEQ ID NO: 69027 - DNA, 201 bp, Homo sapiens
cacggtgaaacccagtctgtactaaaaatacaaaaattagccaggtgtggtggcgggcgcctgtggttccagctactgaggaggctgaggcaagagaatckcttgaacctgggagtcagaggttgcagtgagccaagttcatgccattgcactccagcctgggtgacagagtgagactccatctcaaaaataaaatcaata

SEQ ID NO: 69028 - DNA, 201 bp, Homo sapiens
ctggccaacacggtgaaacccagtctgtactaaaaatacaaaaattagccaggtgtggtggcgggcgcctgtggttccagctactgaggaggctgaggcargagaatctcttgaacctgggagtcagaggttgcagtgagccaagttcatgccattgcactccagcctgggtgacagagtgagactccatctcaaaaataa

SEQ ID NO: 69029 - DNA, 201 bp, Homo sapiens
gcggatcacttgaagtcaggagtttgagaccagcctggccaacacggtgaaacccagtctgtactaaaaatacaaaaattagccaggtgtggtggcgggcrcctgtggttccagctactgaggaggctgaggcaagagaatctcttgaacctgggagtcagaggttgcagtgagccaagttcatgccattgcactccagcc

SEQ ID NO: 69030 - DNA, 201 bp, Homo sapiens
acaggtgtgagccaccacgcctgactttgccttctcaaaaaaacaaacctgcaacatacacacaacataaaattgaacattttagccaatttatttatttrttattattattttgagatggagttttgctcttgttgcccaggctggagtgcagtgccgtgatctcggctcaactgcaaactctacctcccaggctcaagt

SEQ ID NO: 69031 - DNA, 201 bp, Homo sapiens
tttatttatttattatggtcttgctgttacccaggctggagtgcagtggggcactcatggctcagtgcagcctcaatctcctggattcaagtgctcctccygcctcagcctcctgaataactgagactacaggcacacaccatcatgtctggctaattttttttaaacatttttggtagagatggattctcgctatactgc

SEQ ID NO: 69032 - DNA, 201 bp, Homo sapiens
gatctgctcacttcagcctcccaaagtgttgggattacaggtgtaagccactgcacctggcaagaatgagcatctctggacatgttgaaaagcagtttccygctttttcttcaaggtctccgttcaaagcctttgaccatttcttggagtttggcgatgtgaaggacagaggccgaaaagaggggaaaacgtgggggagtg

SEQ ID NO: 69033 - DNA, 201 bp, Homo sapiens
agatgtcctaacctccacccagaaccccttcagtccctgctgggtgactcagggcgtcctaactcctccatggcctcagtttccccatctgaagaatgggkacaggaaaggattgtccttgaggccccaggaagctctgccgccccctccctgtccctcatgccgctcctcagctccctcagctcctagagggggaagagg

SEQ ID NO: 69034 - DNA, 201 bp, Homo sapiens
cctcagcctcccaaagtgctggattacaggcgtgagtcagagcacctggcccactctggactttctcaaagctcatgtgcctgtcccctgagtcctccccstcccacacttacccctggtctgtctgtccccccagggctcacccttcagaggacaatgacttttacatcaactacaaggacatcgacctggcttcccagc

SEQ ID NO: 69035 - DNA, 201 bp, Homo sapiens
ttaccaagcacactgcctgcaaacattttattagcaaagcacatcctgcacagccctagatcccttaaaccttgattccatacaacacatatttctgtgarctcgaggttggggctaaagttacagattaacagcatctcagggcaaagcaattgttcagggtatgggtcaaaatgaagttttttatgtcttccttttcta

SEQ ID NO: 69036 - DNA, 201 bp, Homo sapiens
cttttactaatcctcctcagcacagacccttcacgggtgtcgggctggggggacgatcagatctttcccatcccacgaggccatgtttcagactatcccayggggagaaatcttggacagtacctgactttccagagcagaggtccctgcggctttctgcagtgcattgtgcccctggttactcgagaatggagaatggcg

SEQ ID NO: 69037 - DNA, 201 bp, Homo sapiens
atacgtctcgcctcccgccatagggcggtttttctcctatctcagaattgaacaaatgtacaatcgggttttataccgagacattcagttcccaggggcargcaggagacagaggccttcctcttagctcaactgcaagaggccttcctcttttactaatcctcctcagcacagacccttcacgggtgtcgggctgggggg

SEQ ID NO: 69038 - DNA, 201 bp, Homo sapiens
atcccagcactttgggaggccgatgcaggtggatcacttgaggtcaggagttcaagaccagcctggccgatatgtggccaatatggtgaaacgcccgcttytactaaaaataccaaaaattagctgggcatggtggctggcgcctgtgatcccagctactcgggaggctgaggcagaagaatggcttgaatcggggcggtg

SEQ ID NO: 69039 - DNA, 201 bp, Homo sapiens
ctcacacctgtaatcctagcactttgggaggccaaggcaggcggatcacttgaagtcaggagtttgagaccagcctggccaacacggtgaaacccagtctstactaaaaatacaaaaattagccaggtgtggtggcgggcgcctgtggttccagctactgaggaggctgaggcaagagaatctcttgaacctgggagtcag

SEQ ID NO: 69040 - DNA, 201 bp, Homo sapiens
atggtggctcacacctgtaatcctagcactttgggaggccaaggcaggcggatcacttgaagtcaggagtttgagaccagcctggccaacacggtgaaacscagtctgtactaaaaatacaaaaattagccaggtgtggtggcgggcgcctgtggttccagctactgaggaggctgaggcaagagaatctcttgaacctgg

SEQ ID NO: 69041 - DNA, 201 bp, Homo sapiens
ggactggacatggtggctcacacctgtaatcctagcactttgggaggccaaggcaggcggatcacttgaagtcaggagtttgagaccagcctggccaacayggtgaaacccagtctgtactaaaaatacaaaaattagccaggtgtggtggcgggcgcctgtggttccagctactgaggaggctgaggcaagagaatctct

SEQ ID NO: 69042 - DNA, 201 bp, Homo sapiens
tgacaccatctgctgccttttggtattgagtttaattttgaagcctcctaggtgcccattttcaacagctttgctgtgactgaagtgagcctgctcccatmtcagggcctttgcacttgctgtttgcatttacttgcaatgtccaccctcaactaccccctccccgactccttttcttcctccaggtctcagctcaaatgt

SEQ ID NO: 69043 - DNA, 201 bp, Homo sapiens
ggggagaggactggacatggtggctcacacctgtaatcctagcactttgggaggccaaggcaggcggatcacttgaagtcaggagtttgagaccagcctgrccaacacggtgaaacccagtctgtactaaaaatacaaaaattagccaggtgtggtggcgggcgcctgtggttccagctactgaggaggctgaggcaagag

SEQ ID NO: 69044 - DNA, 201 bp, Homo sapiens; identical to SEQ ID NO: 54665

SEQ ID NO: 69045 - DNA, 201 bp, Homo sapiens; identical to SEQ ID NO: 54774

SEQ ID NO: 69046 - DNA, 201 bp, Homo sapiens; identical to SEQ ID NO: 54776

SEQ ID NO: 69047 - DNA, 201 bp, Homo sapiens; identical to SEQ ID NO: 54777

SEQ ID NO: 69048 - DNA, 201 bp, Homo sapiens; identical to SEQ ID NO: 54705

SEQ ID NO: 69049 - DNA, 201 bp, Homo sapiens; identical to SEQ ID NO: 54668

SEQ ID NO: 69050 - DNA, 201 bp, Homo sapiens; identical to SEQ ID NO: 54778

SEQ ID NO: 69051 - DNA, 201 bp, Homo sapiens; identical to SEQ ID NO: 54779

SEQ ID NO: 69052 - DNA, 201 bp, Homo sapiens; identical to SEQ ID NO: 54669

SEQ ID NO: 69053 - DNA, 201 bp, Homo sapiens; identical to SEQ ID NO: 54889

SEQ ID NO: 69054 - DNA, 201 bp, Homo sapiens; identical to SEQ ID NO: 54857

SEQ ID NO: 69055 - DNA, 201 bp, Homo sapiens; identical to SEQ ID NO: 54924

SEQ ID NO: 69056 - DNA, 201 bp, Homo sapiens; identical to SEQ ID NO: 54859

SEQ ID NO: 69057 - DNA, 201 bp, Homo sapiens; identical to SEQ ID NO: 54862

SEQ ID NO: 69058 - DNA, 201 bp, Homo sapiens; identical to SEQ ID NO: 54748

SEQ ID NO: 69059 - DNA, 201 bp, Homo sapiens; identical to SEQ ID NO: 54927

SEQ ID NO: 69060 - DNA, 201 bp, Homo sapiens; identical to SEQ ID NO: 54753

SEQ ID NO: 69061 - DNA, 201 bp, Homo sapiens; identical to SEQ ID NO: 54715

SEQ ID NO: 69062 - DNA, 201 bp, Homo sapiens; identical to SEQ ID NO: 54891

SEQ ID NO: 69063 - DNA, 201 bp, Homo sapiens; identical to SEQ ID NO: 54783

SEQ ID NO: 69064 - DNA, 201 bp, Homo sapiens; identical to SEQ ID NO: 54786

SEQ ID NO: 69065 - DNA, 201 bp, Homo sapiens; identical to SEQ ID NO: 54787

SEQ ID NO: 69066 - DNA, 201 bp, Homo sapiens; identical to SEQ ID NO: 54683

SEQ ID NO: 69067 - DNA, 201 bp, Homo sapiens; identical to SEQ ID NO: 54685

SEQ ID NO: 69068 - DNA, 201 bp, Homo sapiens; identical to SEQ ID NO: 54687

SEQ ID NO: 69069 - DNA, 201 bp, Homo sapiens; identical to SEQ ID NO: 54688

SEQ ID NO: 69070 - DNA, 201 bp, Homo sapiens; identical to SEQ ID NO: 54716

SEQ ID NO: 69071 - DNA, 201 bp, Homo sapiens; identical to SEQ ID NO: 54689

SEQ ID NO: 69072 - DNA, 201 bp, Homo sapiens; identical to SEQ ID NO: 54718

SEQ ID NO: 69073 - DNA, 201 bp, Homo sapiens; identical to SEQ ID NO: 54943

SEQ ID NO: 69074 - DNA, 201 bp, Homo sapiens; identical to SEQ ID NO: 54945

SEQ ID NO: 69075 - DNA, 201 bp, Homo sapiens; identical to SEQ ID NO: 54897

SEQ ID NO: 69076 - DNA, 201 bp, Homo sapiens; identical to SEQ ID NO: 54726

SEQ ID NO: 69077 - DNA, 201 bp, Homo sapiens; identical to SEQ ID NO: 54898

SEQ ID NO: 69078 - DNA, 201 bp, Homo sapiens; identical to SEQ ID NO: 54900

SEQ ID NO: 69079 - DNA, 201 bp, Homo sapiens; identical to SEQ ID NO: 54955

SEQ ID NO: 69080 - DNA, 201 bp, Homo sapiens
tcttttcatggtcatgtatccctgatccttaacatggcttatgtggtgggtgactatatatttgattgttcaaactgggacgcttatgagaatgaaaaggrgtgctattaatgattacacaggggaaaaccaagactgccctgggcaaaccgtgtgtggggctgcccaacttataagacatcattctcttctttatttaag

SEQ ID NO: 69081 - DNA, 201 bp, Homo sapiens
ctaaactggcttctcgctcctcgctcctcatgccccaaaactgatcaggccccaacccccctccccacaactcagtgttccctccacacggaccgtcgagkctcccccagatcccacgtcttcgtccttcctggaccccgtgctccattccttacagtcacagacagggattcgttacctgcagagcagctcgacaaccct

SEQ ID NO: 69082 - DNA, 201 bp, Homo sapiens
tatatatttgattgttcaaactgggacgcttatgagaatgaaaaggggtgctattaatgattacacaggggaaaaccaagactgccctgggcaaaccgtgkgtggggctgcccaacttataagacatcattctcttctttatttaagaaaaacatgtgtaacccctaattccaagcccatcctccaccagctgaaagcaca

SEQ ID NO: 69083 - DNA, 201 bp, Homo sapiens
atcccaatttttttggtatcccacatcccactacccaagcagagtcctgaggctgtgcgtgcagttgggaaactgagttacaaccagctggtggagaggaycatcacctgcaaacactccagtgacaccaacctcgtgacagaaggtgacattcctccccttctcatggatagtatgtggagggaatgacagctacttagg

SEQ ID NO: 69084 - DNA, 201 bp, Homo sapiens
aatgaaaaggggtgctattaatgattacacaggggaaaaccaagactgccctgggcaaaccgtgtgtggggctgcccaacttataagacatcattctcttytttatttaagaaaaacatgtgtaacccctaattccaagcccatcctccaccagctgaaagcacaagccaaacagcctcagttttctgaccatcagagaaa

SEQ ID NO: 69085 - DNA, 201 bp, Homo sapiens
aatgaaaagcaaaggcgtcgggagtcctgggttgtaacaccaattctgcccttagcttttgtatctgaccctgggtgggccgttcacctttatgaggctgycgcctcctctgagaaatgaagagtctggattagactctaagtattttccagctctgaaaatctgtgttctgtgacattacccgcattctccaggagaaga

SEQ ID NO: 69086 - DNA, 201 bp, Homo sapiens
agctagctgcccaacccccacttcatcattgatcatttctggcactggagagaaaatataaaaaataaggcctgcttttcttttttttttttctttttttytttttttttttggaggcaagagtctcactcttgtcacccaggctggagtgcagaggcacaatcttggcttactgcaacctccacctccggggttcaagca

SEQ ID NO: 69087 - DNA, 201 bp, Homo sapiens
cttgcaagatttcacattcattcccttgtgccagttgcaagccttttttcctaccccaccctactactggagctcccccttgcctttccatgggttcttcyttcagtgctctttggaggaaagcacacacgtgatcaccccttctgcctccaggtgaagctccccccgcagaaggaagtgatcacatcggatgagctcatg

SEQ ID NO: 69088 - DNA, 201 bp, Homo sapiens
ctctgggcctcagcccactgcacaactcttgttctccccaggactacctgattgctctgtccctgcagcagcaacagccacgaggcccgctggggcttacygacttggagctggcccagcagcttcagcaagaggagtatcaacagcagcaggcagcgcagccagtgcggatgcggacgcgggtcctgtcactgcaggtgg

SEQ ID NO: 69089 - DNA, 201 bp, Homo sapiens
acaaaaattagccaggtgtggtggtaggcgcctataatcccagctactgaggagggtgaggtaggagaattgcttgaacctgggaggcggacgttgcagtragctgagatcacaccactgcactccagcctgggacagagcaagactccgtctcaaaaaaaaagaaaagaaaagaaataacacaggtacaagtcatcaaaa

SEQ ID NO: 69090 - DNA, 201 bp, Homo sapiens
attctcacgctcctaaactggcttctcgctcctcgctcctcatgccccaaaactgatcaggccccaacccccctccccacaactcagtgttccctccacayggaccgtcgaggctcccccagatcccacgtcttcgtccttcctggaccccgtgctccattccttacagtcacagacagggattcgttacctgcagagcag

SEQ ID NO: 69091 - DNA, 201 bp, Homo sapiens
tgtaatcccagaattttgggaggccaaggcaagcagatcatttatggtcaggagttcgagaccagcctggccaacatggtgaaacccccgtctctattaaractacaaaaattagccaggtgtggtggtaggcgcctataatcccagctactgaggagggtgaggtaggagaattgcttgaacctgggaggcggacgttgc

SEQ ID NO: 69092 - DNA, 201 bp, Homo sapiens
atggtgtgaacctgggaggcagagcttgcggtgagcagagattgtgccactgcactccagcctggatgacagagcgagactccatctccaagaaaaaaaawgtccacatgctcataccgagatttctggcagtgaactgcctccgtatcaactgtccccccaatgagctctgttcttttctttgtagagtcacttatacct

SEQ ID NO: 69093 - DNA, 201 bp, Homo sapiens
cttatttatggactgttggggatgagagcaggcaacaaatgccaaggtcagacttggtaatgtccttgacctcacgtgctgctgccttctctgcctcccayccagggcaacactaggattggtgggtttctggttctcaactcccggtccctgaatagtcacacgtatgtacagactgaggctctggggtgaggtccctat

SEQ ID NO: 69094 - DNA, 201 bp, Homo sapiens
gtctaaaaaaaaaaaaaaccttctttcctgagatctgttgtttgccttaccctgaagcaatagggttaagtatttgacccaattgaagaatgcaaaaagcrggaggtgggtcagaggcaggaaggtggttacctgtcatttctttttttcttttttttttttttttgagatggagcctcgctgtattgcccaggctggagt

SEQ ID NO: 69095 - DNA, 201 bp, Homo sapiens
gaagaatgcaaaaagcgggaggtgggtcagaggcaggaaggtggttacctgtcatttctttttttcttttttttttttttttgagatggagcctcgctgtrttgcccaggctggagtgcagtggtgcaatctgagctcactgcaacctccgcctcccggattcaagcgattctcctacctcagcctcctgagtagctggga

SEQ ID NO: 69096 - DNA, 201 bp, Homo sapiens
ggtgaggggagacctggagtgggagacctgggtgtggattactgtagcactaaggcaaaacaggattcctgcggaatagccaagtgcacatcaaaggcacytccaactccagtgcctcttcccggtccatgtcctgctccacccaaccttcaatcagggaacacaaacaacagcgaagtttgccaaaagaattcgagtatc

SEQ ID NO: 69097 - DNA, 201 bp, Homo sapiens
ctctactaaaaatacaaaaataagccaggcatggtggtgggtgcctgcaatcccagctacttggaaggctgaggcaggagaattgcttgaacccaggaggyggaggttgcagtgagctgagatcgcgccactgcactccaacctgggcaagaagagcaaaactccgtctcaaaaaaaaaaaaaaaaaagaaagaaagaaaa

SEQ ID NO: 69098 - DNA, 201 bp, Homo sapiens
acacggaccgtcgaggctcccccagatcccacgtcttcgtccttcctggaccccgtgctccattccttacagtcacagacagggattcgttacctgcagarcagctcgacaaccctgcaggtagtcctccatgatgaagcccaaagtacgccgtcgcccctggtcgagtagaggtgcccctggtcgaggagaggtttcccc

SEQ ID NO: 69099 - DNA, 201 bp, Homo sapiens
cacaatcttggcttactgcaacctccacctccggggttcaagcaattctcctgcctcagcctcctgagtagctgggattacaggtgcccgccaccgtgccyggctaatttttgtatttttagtagagatggggtttcgccatgttagccaggccgatcttgagctcctgacctcaggtgatccgcccgcctcggcctctca

SEQ ID NO: 69100 - DNA, 201 bp, Homo sapiens
ggatgaacacctaaactgcaatgcagccccaccctgaagcaaagatttctcccctcagaagtgaaagatgagtcaccataaataggacatttggttaaatsatttttttttaatggaacatcctattgtctctgtggcagaggctatagaaaatttctgtggtatcaaatactaaaaatatggtagcaacgggagacttgg

SEQ ID NO: 69101 - DNA, 201 bp, Homo sapiens
gcaggatttgtggttttttattatttatacccacagtattagttaaatgtctatctgtgcttgcctcaatgtgcctccagtgctgatagagaacaggttamacaggtccggtgttcacatctaaaatgacctggagaggactgggcacggtggctcatgcctgtaatcccagcactttgggaggccaaggtgggaggatca

SEQ ID NO: 69102 - DNA, 201 bp, Homo sapiens
caggatttgtggttttttattatttatacccacagtattagttaaatgtctatctgtgcttgcctcaatgtgcctccagtgctgatagagaacaggttaamcaggtccggtgttcacatctaaaatgacctggagaggactgggcacggtggctcatgcctgtaatcccagcactttgggaggccaaggtgggaggatcac

SEQ ID NO: 69103 - DNA, 201 bp, Homo sapiens
ggccagtctgggcaacatagcaaccctatgatgaatggttcctgaaatttttttcttttttgagagaccaaaaaaaaaaagtgtttaggaaccattcatcmtagggttgtagtccttgtgagctttgttcatttccttccttaaaaaagaaaaaaaaatcccaatttttttggtatcccacatcccactacccaagcagag

SEQ ID NO: 69104 - DNA, 201 bp, Homo sapiens
tttgggaggccgaggcgggcagatcatgaggtcaggagatcgaggccatcctggctaacacggtgaaaccccgtctctactaaaaaaataccaaacattakccaggcatggtggcgggtgcctgtagtcccagctacttgggaggctgaggcaggagaatggtgtgaacctgggaggcagagcttgcggtgagcagagatt

SEQ ID NO: 69105 - DNA, 201 bp, Homo sapiens
gtgggtcagaggcaggaaggtggttacctgtcatttctttttttcttttttttttttttttgagatggagcctcgctgtattgcccaggctggagtgcagkggtgcaatctgagctcactgcaacctccgcctcccggattcaagcgattctcctacctcagcctcctgagtagctgggactacaggcatgcgccactgcg

SEQ ID NO: 69106 - DNA, 201 bp, Homo sapiens
ggtcagaggcaggaaggtggttacctgtcatttctttttttcttttttttttttttttgagatggagcctcgctgtattgcccaggctggagtgcagtggkgcaatctgagctcactgcaacctccgcctcccggattcaagcgattctcctacctcagcctcctgagtagctgggactacaggcatgcgccactgcgccc

SEQ ID NO: 69107 - DNA, 201 bp, Homo sapiens
gaggagaggtttccccgacgaatgcagcccgcccgggactcagggactagaggccagagtcaggaggcgggactcgaacccgccacacggcgaatcggccwccgaccccgggaggaactgcgtaagcgggcgctccggagtccggcgtcgccccgcccccagcggcggaggcggggctctacgcccagaggctcctgggac

SEQ ID NO: 69108 - DNA, 201 bp, Homo sapiens
ggattacaggtgcacgccaccatgcctggctaatttttgtatttttagtagagacggggtttcaccatgttggtcagggtggtcttgaactcctgacctcrtgatccgcccacctcagcctctcaaagtgctgggattacaggcgtgagccactgtgcctggctaactactgggttttctatggggcaagaatatgctcag

SEQ ID NO: 69109 - DNA, 201 bp, Homo sapiens
tgcccaaagggcccctaaagaagtttgccctgaggtcctccccatgcctatttctctaagtctacttcaagagtttggaagcaggccgggcgcggtggctyacgcctgtaatcccagcactttgggaggccgaggcggacagattacaaggtcaggagatcgagactatcctggctaacctggtgaaaccccgtctctact

SEQ ID NO: 69110 - DNA, 201 bp, Homo sapiens
tggaagcaggccgggcgcggtggcttacgcctgtaatcccagcactttgggaggccgaggcggacagattacaaggtcaggagatcgagactatcctggcyaacctggtgaaaccccgtctctactaaaaatacaaaaaattagccaggcgtggtggcgggtgcctgtagtcccagctactcgggaggctgaggcaggaga

SEQ ID NO: 69111 - DNA, 201 bp, Homo sapiens
ttacatatatcacaccgagcatctggtgacattttaaatgacacttggcaaaacagatcatcttctttctacaaattctgccctttaccaaactgactcartcgccaccaattttgtggttgttcatgttaggagaacattagaataatctttgacccctcttgttaacacctacagtctcctgccaactcctgctgcttc

SEQ ID NO: 69112 - DNA, 201 bp, Homo sapiens
tcactatgttggccaggttggtcttgatctcttgaccttgtgatccgcccgccttggcttcccaaagtgctgggattacaggcgtcagccatcgcgcccaragcctggggcttctaccacaccctctgcactctaccaggtgcacaacccaaccagtttcatttctagacttaaaaatgatacagcaaggacttggaaagg

SEQ ID NO: 69113 - DNA, 201 bp, Homo sapiens
gatctcttgaccttgtgatccgcccgccttggcttcccaaagtgctgggattacaggcgtcagccatcgcgcccagagcctggggcttctaccacaccctytgcactctaccaggtgcacaacccaaccagtttcatttctagacttaaaaatgatacagcaaggacttggaaaggagctctctggagggctccagaggga

SEQ ID NO: 69114 - DNA, 201 bp, Homo sapiens
aatgttcctcaacctcatctcccaggccttcccctagccccaaattcctgtaggtttacaagaaggaagcagtctcaggctgggaggagggtggagaaaaracaagatttctaactagtttaatttattttattttattttattttattttattttattttattttattttattttatttttgagatggagtttcgctctg

SEQ ID NO: 69115 - DNA, 201 bp, Homo sapiens
aattgcttgaacctgggaggcggacgttgcagtaagctgagatcacaccactgcactccagcctgggacagagcaagactccgtctcaaaaaaaaagaaargaaaagaaataacacaggtacaagtcatcaaaatcctgaattataattgattatactaagtaatgtgttgttatgagagatttttaaataaaaactttta

SEQ ID NO: 69116 - DNA, 201 bp, Homo sapiens
tccacccctgagatgtgctggataacttatttatggactgttggggatgagagcaggcaacaaatgccaaggtcagacttggtaatgtccttgacctcacrtgctgctgccttctctgcctcccacccagggcaacactaggattggtgggtttctggttctcaactcccggtccctgaatagtcacacgtatgtacagac

SEQ ID NO: 69117 - DNA, 201 bp, Homo sapiens
ctgaaagttataattaaactgtagtttaacagaaacattcaaacttaagagtgtatctgtctaaatcacctctctctctttacacaagaaacttaacggtstcctctggagaactggatggagaggagaaaagaaaaatgatctttatctttttcatttcatatccctttggtatttaaatttgttcatgaaatacacatt

SEQ ID NO: 69118 - DNA, 201 bp, Homo sapiens
caggcatatcacttgaggtcaggagttcaagaccagcctgtccaacatggtgacaccctgtctctactaaaaatacaaaacttagccaggcatagtggcgyacacttgtaatcccagctactcaggaggctgaggcagaagaatcgcttgaattcgggaagtggaggttgcagtgagcctactccagcctgggcgacagag

SEQ ID NO: 69119 - DNA, 201 bp, Homo sapiens
gacggttgtaaccttggctttttgctctctgccaccctaattgttccaattgctctttcagcctttagagttgcttgaaatttcatcctgtggcggccctrtacatagagtttagggaacccttcagaatgtggagttaggttccaacctcccttaactgccactttccagccgcagagtagtgcaggtactgcaaataaa

SEQ ID NO: 69120 - DNA, 201 bp, Homo sapiens
tgtaaccttggctttttgctctctgccaccctaattgttccaattgctctttcagcctttagagttgcttgaaatttcatcctgtggcggccctgtacatrgagtttagggaacccttcagaatgtggagttaggttccaacctcccttaactgccactttccagccgcagagtagtgcaggtactgcaaataaatggaca

SEQ ID NO: 69121 - DNA, 201 bp, Homo sapiens
atcaaaaattccctcatttatttatctatccctttatttcctaccgtcagcctcacaccagcttttcctgcttccccagctgtaaatcgagaggaggtgaytgatgagaggcctgcagtggaaccaagatccagagcacaggcgtgttggatctcctgcctgctctgccagttcttttcttcttcttcttctttttgagac

SEQ ID NO: 69122 - DNA, 201 bp, Homo sapiens
aaacattgctatcttcctcctgtacatgcagcaggcctgttttttggctaaagaaagtaatgaaaggttcagtttagaaataacaggccaggcacagtggytcatgcctgtaatcccagcactttgggaggatgaggcgcgtggatcatctgaggtaggagttcgagaccagcctgaccaaaatggtgaaaccccgtctct

SEQ ID NO: 69123 - DNA, 201 bp, Homo sapiens
gttttttggctaaagaaagtaatgaaaggttcagtttagaaataacaggccaggcacagtggctcatgcctgtaatcccagcactttgggaggatgaggcrcgtggatcatctgaggtaggagttcgagaccagcctgaccaaaatggtgaaaccccgtctctactaaaaatacaaaaataagccaggcatggtggtgggt

SEQ ID NO: 69124 - DNA, 201 bp, Homo sapiens
cagtggctcatgcctgtaatcccagcactttgggaggatgaggcgcgtggatcatctgaggtaggagttcgagaccagcctgaccaaaatggtgaaacccygtctctactaaaaatacaaaaataagccaggcatggtggtgggtgcctgcaatcccagctacttggaaggctgaggcaggagaattgcttgaacccagga

SEQ ID NO: 69125 - DNA, 201 bp, Homo sapiens
atccagcccctggtaaggccgggactgcagaagcagtcatccctgaaaaccatgaggttctggcaggcccagatgagcaccctcaggacacagatgcaagwgatgctgatggggaggctagagaacgggagccagcagaccaagctttgctgcctagccagtgtggggacaaccttgagtcccctctgcctgaagctagct

SEQ ID NO: 69126 - DNA, 201 bp, Homo sapiens
gttacagaattgggcaagagtcactcattaactgaatactctcattgttgtacaagtattcttttttcttgctctgtcacccagagtggaatgcagtggcrtgaattcagctcactgcaacctccgcctcccaggttcaagcaagtctcctgcctcagcctcccaagcagctgggactatagcatgtgccaaacgcccagc

SEQ ID NO: 69127 - DNA, 201 bp, Homo sapiens
ggcctcccaaagtgctgagattacaggcatgagccaccgcgcctggcctgtttatttattttttttgaggcaggtctcactttgtcacccagactggagcrcagtggcgtcacctcggctgaccgcaacctctgcttcccaggctcgagattctcctgcttcagcctcccaagtagctgagattacaggcgctcaccacta

SEQ ID NO: 69128 - DNA, 201 bp, Homo sapiens
aaagtgctgagattacaggcatgagccaccgcgcctggcctgtttatttattttttttgaggcaggtctcactttgtcacccagactggagcacagtggcrtcacctcggctgaccgcaacctctgcttcccaggctcgagattctcctgcttcagcctcccaagtagctgagattacaggcgctcaccactaccccctgg

SEQ ID NO: 69129 - DNA, 201 bp, Homo sapiens
gagcaaaggactgccatacccagagagagagcccagatccaacaagctgcttctgtccagcccttctcctccctacttagcaagggcacttgctcttcccyattctcaccagagaggcacaagcgctccgtcccttctagaggcaggcagagggaagagaaagggtctgttgtttttctctcctgtttctcgctccctctc

SEQ ID NO: 69130 - DNA, 201 bp, Homo sapiens
agagttcagggaaaatacagctatacttagcagcatgaggaaatctaagctgccaatggaaaaaatacaatctgagggccacaagtaaataaatacaaactttttttcttttttcttttttttaaagacccactagttggccaggcacggtggctcacgcctgtaatcccagcactttgggaggccgaggtgggccgacca

SEQ ID NO: 69131 - DNA, 201 bp, Homo sapiens
agggaaaatacagctatacttagcagcatgaggaaatctaagctgccaatggaaaaaatacaatctgagggccacaagtaaataaatacaaactttttttyttttttcttttttttaaagacccactagttggccaggcacggtggctcacgcctgtaatcccagcactttgggaggccgaggtgggccgaccacgaggtc

SEQ ID NO: 69132 - DNA, 201 bp, Homo sapiens
tttgggaggccaaggcaagcagatcatttatggtcaggagttcgagaccagcctggccaacatggtgaaacccccgtctctattaaaactacaaaaattasccaggtgtggtggtaggcgcctataatcccagctactgaggagggtgaggtaggagaattgcttgaacctgggaggcggacgttgcagtaagctgagatc

SEQ ID NO: 69133 - DNA, 201 bp, Homo sapiens
ccaggtgaagctccccccgcagaaggaagtgatcacatcggatgagctcatggcccatcttggtgagtgactgggcgttgaagaggaattacccaaggggytccagagctatccactcagccagaaatccagactattcagggatctccatttgggggttctgatacagcagggagggtaagggtctatggggcttctctg

SEQ ID NO: 69134 - DNA, 201 bp, Homo sapiens
ctgcttctccctttgcaactctgtagcctgtttttttctacagcctcggcaaatatcttcttcctttcttggacggttgtaaccttggctttttgctctcygccaccctaattgttccaattgctctttcagcctttagagttgcttgaaatttcatcctgtggcggccctgtacatagagtttagggaacccttcagaat

SEQ ID NO: 69135 - DNA, 201 bp, Homo sapiens
ctctctggatggtccttcctgttgtggaccttgaatttaagccaagtttcccccgactcgtccctttctggcaggcctgattgcagagcagttcctggagwccaccgcggcccagctgacctaccacggactgtgtgagctgacagcagctgctaaggagggtgaacttagcgtctttttccgaaacaaccactttagcac

SEQ ID NO: 69136 - DNA, 201 bp, Homo sapiens
actaaaaaaataccaaacattagccaggcatggtggcgggtgcctgtagtcccagctacttgggaggctgaggcaggagaatggtgtgaacctgggaggcrgagcttgcggtgagcagagattgtgccactgcactccagcctggatgacagagcgagactccatctccaagaaaaaaaaagtccacatgctcataccgag

SEQ ID NO: 69137 - DNA, 201 bp, Homo sapiens
gctgcctgggcgcccacactcccggtttccacctcatgctttgccgggtccagaacacctgttattcctgcactggtctcttcaaggtttcttctctcagrgtccttcccctgcctgtccctctcccctggagccccttcctgtcttcctctccctactctctgtcccaatcctgacaccccttcttctagaatctcttct

SEQ ID NO: 69138 - DNA, 201 bp, Homo sapiens
gccaaaaaccgggagactgaacaagcagcattctcacgctcctaaactggcttctcgctcctcgctcctcatgccccaaaactgatcaggccccaaccccsctccccacaactcagtgttccctccacacggaccgtcgaggctcccccagatcccacgtcttcgtccttcctggaccccgtgctccattccttacagtca

SEQ ID NO: 69139 - DNA, 201 bp, Homo sapiens
ctgaggcaggaaaatcacttgaacctggcaggcggaggttgcagtgagccgagatcatgcaactgtactccagcctggtgacagagcgagactttgtctcaaaaaaaaaaaaaattaattaattaaaataaataaatgaataaacacccactagttgaaatgactctcttatcctgatatgttctttgtggcctcaagagg

SEQ ID NO: 69140 - DNA, 201 bp, Homo sapiens
tcctcatgccccaaaactgatcaggccccaacccccctccccacaactcagtgttccctccacacggaccgtcgaggctcccccagatcccacgtcttcgwccttcctggaccccgtgctccattccttacagtcacagacagggattcgttacctgcagagcagctcgacaaccctgcaggtagtcctccatgatgaagc

SEQ ID NO: 69141 - DNA, 201 bp, Homo sapiens
ttggcttaaaaacactgacttaaagtaaaatactgtgactacttctaacctagaaatgagttcagcccgccagacagaaactgccattcggaggaaataargccgtgagcaccggttccctccacacccccgaggttcacctggaggccagtgggccaagcgaagccttgggagcggagaactcaaagaggggcggggaga

SEQ ID NO: 69142 - DNA, 201 bp, Homo sapiens
agaggaattacccaaggggttccagagctatccactcagccagaaatccagactattcagggatctccatttgggggttctgatacagcagggagggtaarggtctatggggcttctctgcaaggctggagaatgaaaagcaaaggcgtcgggagtcctgggttgtaacaccaattctgcccttagcttttgtatctgacc

SEQ ID NO: 69143 - DNA, 201 bp, Homo sapiens
gcattttcatatttcatagaaatagcaggcaagagagtacctctgggtttaggtagtttctggggaaaaaaaatgaactgaggaaaagttgctgtctcaaygctagctgtcaagagatgcttactgggtccaggcaccgtggctcatgcctgtaatcccagtcctttggcaggctgaggagggcggattgcttgggccccc

SEQ ID NO: 69144 - DNA, 201 bp, Homo sapiens
gtcaagagatgcttactgggtccaggcaccgtggctcatgcctgtaatcccagtcctttggcaggctgaggagggcggattgcttgggcccccaggagttragaccagcctaggcaacaaagcaagaccctgtctcagtttaattaaaagaaatttgatatctttattaattttttttaaagagaagcttactggaagaac

SEQ ID NO: 69145 - DNA, 201 bp, Homo sapiens
agccaaaaaccgggagactgaacaagcagcattctcacgctcctaaactggcttctcgctcctcgctcctcatgccccaaaactgatcaggccccaacccscctccccacaactcagtgttccctccacacggaccgtcgaggctcccccagatcccacgtcttcgtccttcctggaccccgtgctccattccttacagtc

SEQ ID NO: 69146 - DNA, 201 bp, Homo sapiens
ccactgatttccttcttattggacaggtcactcttttgcatcccaagcctggcttaggcaagtccctgaggttagtaaacaccttcagtgcccctcagccragtcccttttgaccatggaataccatcagcctgaggatccagcccctggtaaggccgggactgcagaagcagtcatccctgaaaaccatgaggttctggc

SEQ ID NO: 69147 - DNA, 201 bp, Homo sapiens
cattctgcaggagtcagaggagagtttatctttgtcctagaaaatatgttcattggccgggtgctcacacctgtaatcccagcactttgagatgccaaagygggaggatcacttgaggccaggagttcgaggccagcctgggcaacataataatacccctgtctctaaaaaaaaccattttttttttcaagaattagccag

SEQ ID NO: 69148 - DNA, 201 bp, Homo sapiens
gccagtctgggcaacatagcaaccctatgatgaatggttcctgaaatttttttcttttttgagagaccaaaaaaaaaaagtgtttaggaaccattcatcayagggttgtagtccttgtgagctttgttcatttccttccttaaaaaagaaaaaaaaatcccaatttttttggtatcccacatcccactacccaagcagagt

SEQ ID NO: 69149 - DNA, 201 bp, Homo sapiens
aatgtggatggagacagctgcttttgtgactctgactttcacctgagtcattccctgggcaaggggcctggagcagaaggtgggagtggctccccagaaamgcagctgcaggtagaccaggtgtgtagggcacttaggaaaagtgcagagagcacatgtgcctcagagagctttttactgcatacattttaactgctagag

SEQ ID NO: 69150 - DNA, 201 bp, Homo sapiens; identical to SEQ ID NO: 64919

SEQ ID NO: 69151 - DNA, 201 bp, Homo sapiens
agaacaagccctacacagagaccgtggattcagatgggcggcccgatgaggtcagggttagggacagagggtgggcatgtctcatgagcatcccagccccyggtactctttggttctcaccactctgcctctcaggtggtagctgaggaagcatggcagcggcacaagatgaggaatgactctttcatcgtggacctattt

SEQ ID NO: 69152 - DNA, 201 bp, Homo sapiens; identical to SEQ ID NO: 64923

SEQ ID NO: 69153 - DNA, 201 bp, Homo sapiens
acccagagtgagggtgtgggttcccagaatatctctaaaggtggctttcctgaaccacatggtttggctttctgcaggtggaggctgctattaacaggcaycggccccagctcctggtggaacgttaccatttcaacatggggctgctgatgggtgagcagggcctggaacggggctatattgttctctctggtcatgcct

SEQ ID NO: 69154 - DNA, 201 bp, Homo sapiens; identical to SEQ ID NO: 64924

SEQ ID NO: 69155 - DNA, 201 bp, Homo sapiens
gcgaggccgctactcaggtgcgagcccctctgcccccggcctggtttgcagaccatgctgcaacgcagcgcggggcggggtccagatcccgacctgccccrtttgtcccgccctttcctctcactgagcgcggggcttctctcttgacccctctgacctcaggctcagcagaccctgggttccaccattgacaaagctacc

SEQ ID NO: 69156 - DNA, 201 bp, Homo sapiens; identical to SEQ ID NO: 64928

SEQ ID NO: 69157 - DNA, 201 bp, Homo sapiens; identical to SEQ ID NO: 64929

SEQ ID NO: 69158 - DNA, 201 bp, Homo sapiens; identical to SEQ ID NO: 64930

SEQ ID NO: 69159 - DNA, 201 bp, Homo sapiens
agctagcagacccacatgagaagagatgggatgggctaggtaggttttttcagtcagtgctggtagataggccaggaagccttgggttggtgggtaggatyagtcaggggctccttgaaagaggatactcctgcctctgcctgattctggtctctgctcaggtcctccaccttctgggccccaagttggaggctgatctgg

SEQ ID NO: 69160 - DNA, 201 bp, Homo sapiens; identical to SEQ ID NO: 64934

SEQ ID NO: 69161 - DNA, 201 bp, Homo sapiens
ccaaccgagagcagcggctagaggacaaaggtgtctgaggctgtgggtgggagccatggggtgggttgagctggctgttctccacagctgcatgacctctytccctgcgaatctccaggagacaccccactggagctgggtgacgactgtagcctggctctcgtctggcggaacaatgagcgcttgcaggagtttgtgttg

SEQ ID NO: 69162 - DNA, 201 bp, Homo sapiens
gggcctggtgggcctggtgaggccctgatgggcagggaagctttgattatcatgttctcacacagctgctgtgcctgggtaccagcatccaagtgaagctwtgaatgcccacacaccccagttcttcatctataaaattgattcatccaaccgagagcagcggctagaggacaaaggtgtctgaggctgtgggtgggagcc

SEQ ID NO: 69163 - DNA, 201 bp, Homo sapiens
ggtaattaagaatcgttttcatcgtgtgttcctaccctcccactcactggacactgtgtccccatctgatacgctcctctgctttgagctgctatcctcaragttggctaaggagcgggtagtggtgctagaggtgcaacaggtgagtgggggccaacctgatggcacagcgccctggtgggtggggcacttcttcctggt

SEQ ID NO: 69164 - DNA, 201 bp, Homo sapiens
gtttatatatgagagaccctgaaagtgccctagtctgaagggagatgatggggtcccagctcatgtcctatgggtcatgaagcccccagtgctatcagctytttggagcctacctgctgctctttcatcccactggttctggatcctacataagaggcagcttggtaggcatcgtcaggatctcaatatagccaagggaca

SEQ ID NO: 69165 - DNA, 201 bp, Homo sapiens
tgctagaggtgcaacaggtgagtgggggccaacctgatggcacagcgccctggtgggtggggcacttcttcctggtcttgctgagccagacgacccacccwagcgcccccaggtgcccagcgtccccatctccaagtgtgcagcctgccagcggaagcaacagtcggaggatgaaaagctgaagcgctgtacccggtgcta

SEQ ID NO: 69166 - DNA, 201 bp, Homo sapiens; identical to SEQ ID NO: 64937

SEQ ID NO: 69167 - DNA, 201 bp, Homo sapiens
cctctgatgcaccaggctccttatggcattgggcactgagacaggtgccagcagaggcataagcctatttgggcctacagacctcaccactgcccacataracccaaggcagggccaagccttcttaaactctggggcagggctagggaaagggcttatcctcacgtgggatctgtgtgttctctgtccccaggtaattaa

SEQ ID NO: 69168 - DNA, 201 bp, Homo sapiens
gagtccctcagtgtggagagctggtgtggttgatatctgcctcacacctggtctttcaggccctctgatgcaccaggctccttatggcattgggcactgaracaggtgccagcagaggcataagcctatttgggcctacagacctcaccactgcccacatagacccaaggcagggccaagccttcttaaactctggggcag

SEQ ID NO: 69169 - DNA, 201 bp, Homo sapiens
cagcgagtgaatgccgacctgcagactggggcctaagtttcttttagtttccggtgtctctgcaatggcggctctagactccctgtcgctcttcactagcytcggcctgagcgagcagaaggcccgcgagacgctcaagaactcggctctgagcgcgcagctgcgcgaggccgctactcaggtgcgagcccctctgccccc

SEQ ID NO: 69170 - DNA, 201 bp, Homo sapiens
ccgctactcaggtgcgagcccctctgcccccggcctggtttgcagaccatgctgcaacgcagcgcggggcggggtccagatcccgacctgccccgtttgtyccgccctttcctctcactgagcgcggggcttctctcttgacccctctgacctcaggctcagcagaccctgggttccaccattgacaaagctaccgggatc

SEQ ID NO: 69171 - DNA, 201 bp, Homo sapiens
gtccctggctgatgggggggactgggtttgggacacccacacagagggccagctccttgccgcttctccttctctaacccagaggacactggctctgtcartgggaagctgaggggtatgatttgggtgtggagacctctcaggttgggacttcttgtcagcttggacccctgaccagtgggctttggcttctccagccgc

SEQ ID NO: 69172 - DNA, 201 bp, Homo sapiens; identical to SEQ ID NO: 64943

SEQ ID NO: 69173 - DNA, 201 bp, Homo sapiens
gacacagaatatagataaagactagtcaggatcctgcctattccttgaaggtccagaagtatgagcatcaccaattcctgcaagagctccaatctcaaatktggggatttccaccatcccaccaccagctgctcattctctgcaaccccctacctcagtcccttactaccttagtcccttttctcacacacacacaaagtc

SEQ ID NO: 69174 - DNA, 201 bp, Homo sapiens; identical to SEQ ID NO: 64947

SEQ ID NO: 69175 - DNA, 201 bp, Homo sapiens; identical to SEQ ID NO: 64949

SEQ ID NO: 69176 - DNA, 201 bp, Homo sapiens
tgtggagacctctcaggttgggacttcttgtcagcttggacccctgaccagtgggctttggcttctccagccgcctccagtgctgcgtgatttgattctgwtgtaccttcaattcttctgacccgcattataaacattataattttattctaaaaattgtaattttttttgcattttggaagtgactgctgctgtttaaat

SEQ ID NO: 69177 - DNA, 201 bp, Homo sapiens
actctcattggtcagcgagtgaatgccgacctgcagactggggcctaagtttcttttagtttccggtgtctctgcaatggcggctctagactccctgtcgmtcttcactagcctcggcctgagcgagcagaaggcccgcgagacgctcaagaactcggctctgagcgcgcagctgcgcgaggccgctactcaggtgcgagc

SEQ ID NO: 69178 - DNA, 201 bp, Homo sapiens; identical to SEQ ID NO: 64950

SEQ ID NO: 69179 - DNA, 201 bp, Homo sapiens; identical to SEQ ID NO: 64951

SEQ ID NO: 69180 - DNA, 201 bp, Homo sapiens
tggtgtttcttttgttccctttgcccagagactggcatgagaggcctcagatgtctggctctagatatcttgtctctggaattgagggaataggggtctaytcagttctgttctggctgtaggatatggtaaatgtatctagaggacaagttttccttgttttgttccccacaggcgagactgctgaccagaccctgtctc

SEQ ID NO: 69181 - DNA, 201 bp, Homo sapiens; identical to SEQ ID NO: 64952

SEQ ID NO: 69182 - DNA, 201 bp, Homo sapiens; identical to SEQ ID NO: 64954

SEQ ID NO: 69183 - DNA, 201 bp, Homo sapiens; identical to SEQ ID NO: 13144

SEQ ID NO: 69184 - DNA, 201 bp, Homo sapiens; identical to SEQ ID NO: 64957

SEQ ID NO: 69185 - DNA, 201 bp, Homo sapiens
cattcagccacctgagctccagctggtgacccctatggctgagggggacacagggcttccccgggtgtgggcagcccctgaccggggtcctgtgcccagcrccagtggaatttcttctgagatgctggccagtgggcccattgaggttggctccttgccagctggcgagagggtgtcccgacccgaaggtaagatccagtg

SEQ ID NO: 69186 - DNA, 201 bp, Homo sapiens
agtgggcccattgaggttggctccttgccagctggcgagagggtgtcccgacccgaaggtaagatccagtgaaaggctctagaagctggggaggaggatargggaggatggagggggctgttgtttagggcctggtgggcctggtgaggccctgatgggcagggaagctttgattatcatgttctcacacagctgctgtgc

SEQ ID NO: 69187 - DNA, 201 bp, Homo sapiens; identical to SEQ ID NO: 64959

SEQ ID NO: 69188 - DNA, 201 bp, Homo sapiens
tttcttctgagatgctggccagtgggcccattgaggttggctccttgccagctggcgagagggtgtcccgacccgaaggtaagatccagtgaaaggctctrgaagctggggaggaggataggggaggatggagggggctgttgtttagggcctggtgggcctggtgaggccctgatgggcagggaagctttgattatcatg

SEQ ID NO: 69189 - DNA, 201 bp, Homo sapiens; identical to SEQ ID NO: 64960

SEQ ID NO: 69190 - DNA, 201 bp, Homo sapiens; identical to SEQ ID NO: 64961

SEQ ID NO: 69191 - DNA, 201 bp, Homo sapiens
tatctgcctcacacctggtctttcaggccctctgatgcaccaggctccttatggcattgggcactgagacaggtgccagcagaggcataagcctatttggrcctacagacctcaccactgcccacatagacccaaggcagggccaagccttcttaaactctggggcagggctagggaaagggcttatcctcacgtgggatc

SEQ ID NO: 69192 - DNA, 201 bp, Homo sapiens
agttcctggtgagcgtcagcaaggagaactccactgcgagcgaagtattggactccctctctcagagtgttcatgtgaagcctgagaacctgcgtttggcrgaggtatctttgtccttccttgggctatcacatgtgtggatgtgtgtgtgtactcaccacagacgtgtgtacagtcattggcatctacagacatacacat

SEQ ID NO: 69193 - DNA, 201 bp, Homo sapiens; identical to SEQ ID NO: 64964

SEQ ID NO: 69194 - DNA, 201 bp, Homo sapiens
cagagattgcaccacagcactccagcctgggtgacagagtgagactctgtctcaaaaataaataaataaatagataaaaaaataaaaatagggccaggcgyggtggctcatgcctgtaatcccagctctttgggaggccaaggctgatggatcacaaggtcaggagatccagaccaccctggcttacatggtgaaacccca

SEQ ID NO: 69195 - DNA, 201 bp, Homo sapiens; identical to SEQ ID NO: 64965

SEQ ID NO: 69196 - DNA, 201 bp, Homo sapiens; identical to SEQ ID NO: 64966

SEQ ID NO: 69197 - DNA, 201 bp, Homo sapiens; identical to SEQ ID NO: 13158

SEQ ID NO: 69198 - DNA, 201 bp, Homo sapiens
agatggggctaagggcctatccttgtcttcctcttcccgtcaggctctgccagaaaacccactggcctgaccacaagggcctctgccgacctgagaacatyggctaccccttcctggtcagtgtacctgcctcacgcctcacttatgcccgcctcgctcagttgctagagggctatgcccggtaagtgcccagtggttgga

SEQ ID NO: 69199 - DNA, 201 bp, Homo sapiens; identical to SEQ ID NO: 64968

SEQ ID NO: 69200 - DNA, 201 bp, Homo sapiens
acagactggggccgggttgggggatatagcttcctctcctccagccacaggcccattgagccttgggattcatgagaattgcagagttctcttaacatcaragctttagccagaggcatccccatgccttggggacactaacaaacatacaagtacactaacatgctgccactggcaagcacattggcacctacttggcac

SEQ ID NO: 69201 - DNA, 201 bp, Homo sapiens; identical to SEQ ID NO: 20295

SEQ ID NO: 69202 - DNA, 201 bp, Homo sapiens; identical to SEQ ID NO: 19661

SEQ ID NO: 69203 - DNA, 201 bp, Homo sapiens; identical to SEQ ID NO: 19662

SEQ ID NO: 69204 - DNA, 201 bp, Homo sapiens; identical to SEQ ID NO: 19663

SEQ ID NO: 69205 - DNA, 201 bp, Homo sapiens; identical to SEQ ID NO: 19664

SEQ ID NO: 69206 - DNA, 201 bp, Homo sapiens; identical to SEQ ID NO: 19665

SEQ ID NO: 69207 - DNA, 201 bp, Homo sapiens; identical to SEQ ID NO: 19667

SEQ ID NO: 69208 - DNA, 201 bp, Homo sapiens; identical to SEQ ID NO: 19668

SEQ ID NO: 69209 - DNA, 201 bp, Homo sapiens; identical to SEQ ID NO: 19669

SEQ ID NO: 69210 - DNA, 201 bp, Homo sapiens; identical to SEQ ID NO: 19670

SEQ ID NO: 69211 - DNA, 201 bp, Homo sapiens; identical to SEQ ID NO: 19490

SEQ ID NO: 69212 - DNA, 201 bp, Homo sapiens; identical to SEQ ID NO: 19836

SEQ ID NO: 69213 - DNA, 201 bp, Homo sapiens; identical to SEQ ID NO: 19672

SEQ ID NO: 69214 - DNA, 201 bp, Homo sapiens; identical to SEQ ID NO: 19673

SEQ ID NO: 69215 - DNA, 201 bp, Homo sapiens; identical to SEQ ID NO: 19839

SEQ ID NO: 69216 - DNA, 201 bp, Homo sapiens; identical to SEQ ID NO: 20272

SEQ ID NO: 69217 - DNA, 201 bp, Homo sapiens; identical to SEQ ID NO: 19723

SEQ ID NO: 69218 - DNA, 201 bp, Homo sapiens; identical to SEQ ID NO: 19724

SEQ ID NO: 69219 - DNA, 201 bp, Homo sapiens; identical to SEQ ID NO: 19725

SEQ ID NO: 69220 - DNA, 201 bp, Homo sapiens; identical to SEQ ID NO: 20164

SEQ ID NO: 69221 - DNA, 201 bp, Homo sapiens; identical to SEQ ID NO: 19726

SEQ ID NO: 69222 - DNA, 201 bp, Homo sapiens; identical to SEQ ID NO: 20042

SEQ ID NO: 69223 - DNA, 201 bp, Homo sapiens; identical to SEQ ID NO: 20045

SEQ ID NO: 69224 - DNA, 201 bp, Homo sapiens; identical to SEQ ID NO: 20414

SEQ ID NO: 69225 - DNA, 201 bp, Homo sapiens; identical to SEQ ID NO: 19394

SEQ ID NO: 69226 - DNA, 201 bp, Homo sapiens; identical to SEQ ID NO: 20049

SEQ ID NO: 69227 - DNA, 201 bp, Homo sapiens; identical to SEQ ID NO: 19450

SEQ ID NO: 69228 - DNA, 201 bp, Homo sapiens; identical to SEQ ID NO: 19452

SEQ ID NO: 69229 - DNA, 201 bp, Homo sapiens; identical to SEQ ID NO: 19453

SEQ ID NO: 69230 - DNA, 201 bp, Homo sapiens; identical to SEQ ID NO: 19454

SEQ ID NO: 69231 - DNA, 201 bp, Homo sapiens; identical to SEQ ID NO: 19645

SEQ ID NO: 69232 - DNA, 201 bp, Homo sapiens; identical to SEQ ID NO: 19647

SEQ ID NO: 69233 - DNA, 201 bp, Homo sapiens; identical to SEQ ID NO: 19648

SEQ ID NO: 69234 - DNA, 201 bp, Homo sapiens; identical to SEQ ID NO: 19649

SEQ ID NO: 69235 - DNA, 201 bp, Homo sapiens; identical to SEQ ID NO: 20493

SEQ ID NO: 69236 - DNA, 201 bp, Homo sapiens; identical to SEQ ID NO: 19650

SEQ ID NO: 69237 - DNA, 201 bp, Homo sapiens; identical to SEQ ID NO: 20495

SEQ ID NO: 69238 - DNA, 201 bp, Homo sapiens; identical to SEQ ID NO: 19804

SEQ ID NO: 69239 - DNA, 201 bp, Homo sapiens; identical to SEQ ID NO: 20497

SEQ ID NO: 69240 - DNA, 201 bp, Homo sapiens; identical to SEQ ID NO: 20206

SEQ ID NO: 69241 - DNA, 201 bp, Homo sapiens; identical to SEQ ID NO: 20498

SEQ ID NO: 69242 - DNA, 201 bp, Homo sapiens; identical to SEQ ID NO: 20499

SEQ ID NO: 69243 - DNA, 201 bp, Homo sapiens; identical to SEQ ID NO: 20500

SEQ ID NO: 69244 - DNA, 201 bp, Homo sapiens; identical to SEQ ID NO: 20501

SEQ ID NO: 69245 - DNA, 201 bp, Homo sapiens; identical to SEQ ID NO: 20172

SEQ ID NO: 69246 - DNA, 201 bp, Homo sapiens; identical to SEQ ID NO: 20070

SEQ ID NO: 69247 - DNA, 201 bp, Homo sapiens; identical to SEQ ID NO: 19414

SEQ ID NO: 69248 - DNA, 201 bp, Homo sapiens; identical to SEQ ID NO: 35108

SEQ ID NO: 69249 - DNA, 201 bp, Homo sapiens; identical to SEQ ID NO: 35587

SEQ ID NO: 69250 - DNA, 201 bp, Homo sapiens; identical to SEQ ID NO: 35139

SEQ ID NO: 69251 - DNA, 201 bp, Homo sapiens; identical to SEQ ID NO: 35114

SEQ ID NO: 69252 - DNA, 201 bp, Homo sapiens; identical to SEQ ID NO: 35115

SEQ ID NO: 69253 - DNA, 201 bp, Homo sapiens; identical to SEQ ID NO: 35596

SEQ ID NO: 69254 - DNA, 201 bp, Homo sapiens; identical to SEQ ID NO: 35598

SEQ ID NO: 69255 - DNA, 201 bp, Homo sapiens; identical to SEQ ID NO: 35600

SEQ ID NO: 69256 - DNA, 201 bp, Homo sapiens; identical to SEQ ID NO: 35602

SEQ ID NO: 69257 - DNA, 201 bp, Homo sapiens; identical to SEQ ID NO: 35605

SEQ ID NO: 69258 - DNA, 201 bp, Homo sapiens; identical to SEQ ID NO: 35607

SEQ ID NO: 69259 - DNA, 201 bp, Homo sapiens; identical to SEQ ID NO: 35291

SEQ ID NO: 69260 - DNA, 201 bp, Homo sapiens; identical to SEQ ID NO: 35521

SEQ ID NO: 69261 - DNA, 201 bp, Homo sapiens; identical to SEQ ID NO: 35232

SEQ ID NO: 69262 - DNA, 201 bp, Homo sapiens; identical to SEQ ID NO: 35609

SEQ ID NO: 69263 - DNA, 201 bp, Homo sapiens; identical to SEQ ID NO: 35524

SEQ ID NO: 69264 - DNA, 201 bp, Homo sapiens; identical to SEQ ID NO: 35611

SEQ ID NO: 69265 - DNA, 201 bp, Homo sapiens; identical to SEQ ID NO: 35058

SEQ ID NO: 69266 - DNA, 201 bp, Homo sapiens; identical to SEQ ID NO: 35613

SEQ ID NO: 69267 - DNA, 201 bp, Homo sapiens; identical to SEQ ID NO: 35616

SEQ ID NO: 69268 - DNA, 201 bp, Homo sapiens; identical to SEQ ID NO: 35182

SEQ ID NO: 69269 - DNA, 201 bp, Homo sapiens; identical to SEQ ID NO: 35147

SEQ ID NO: 69270 - DNA, 201 bp, Homo sapiens; identical to SEQ ID NO: 35148

SEQ ID NO: 69271 - DNA, 201 bp, Homo sapiens; identical to SEQ ID NO: 35149

SEQ ID NO: 69272 - DNA, 201 bp, Homo sapiens; identical to SEQ ID NO: 35065

SEQ ID NO: 69273 - DNA, 201 bp, Homo sapiens; identical to SEQ ID NO: 35103

SEQ ID NO: 69274 - DNA, 201 bp, Homo sapiens; identical to SEQ ID NO: 35330

SEQ ID NO: 69275 - DNA, 201 bp, Homo sapiens; identical to SEQ ID NO: 35066

SEQ ID NO: 69276 - DNA, 201 bp, Homo sapiens; identical to SEQ ID NO: 35641

SEQ ID NO: 69277 - DNA, 201 bp, Homo sapiens; identical to SEQ ID NO: 35067

SEQ ID NO: 69278 - DNA, 201 bp, Homo sapiens; identical to SEQ ID NO: 35648

SEQ ID NO: 69279 - DNA, 201 bp, Homo sapiens; identical to SEQ ID NO: 35576

SEQ ID NO: 69280 - DNA, 201 bp, Homo sapiens; identical to SEQ ID NO: 35650

SEQ ID NO: 69281 - DNA, 201 bp, Homo sapiens; identical to SEQ ID NO: 35577

SEQ ID NO: 69282 - DNA, 201 bp, Homo sapiens; identical to SEQ ID NO: 35652

SEQ ID NO: 69283 - DNA, 201 bp, Homo sapiens; identical to SEQ ID NO: 35481

SEQ ID NO: 69284 - DNA, 201 bp, Homo sapiens; identical to SEQ ID NO: 35581

SEQ ID NO: 69285 - DNA, 201 bp, Homo sapiens; identical to SEQ ID NO: 35654

SEQ ID NO: 69286 - DNA, 201 bp, Homo sapiens; identical to SEQ ID NO: 35656

SEQ ID NO: 69287 - DNA, 201 bp, Homo sapiens; identical to SEQ ID NO: 35070

SEQ ID NO: 69288 - DNA, 201 bp, Homo sapiens; identical to SEQ ID NO: 35072

SEQ ID NO: 69289 - DNA, 201 bp, Homo sapiens; identical to SEQ ID NO: 35211

SEQ ID NO: 69290 - DNA, 201 bp, Homo sapiens; identical to SEQ ID NO: 35107

SEQ ID NO: 69291 - DNA, 201 bp, Homo sapiens; identical to SEQ ID NO: 35074

SEQ ID NO: 69292 - DNA, 201 bp, Homo sapiens
ccagaatatgcttagaggtgctgctgtatttacctgagagctatgcttttcatcaaaaacctaaacgtgatcatctcttggatgaggtgtggccctgcacmctcgcctgctcgtggaaggagtctgggccagcagtgacccacgcgctagggtctctgctgaggaagtggcaggtgtgtggccctgccctggccccgtagt

SEQ ID NO: 69293 - DNA, 201 bp, Homo sapiens
cctgctttccggaaacacagatttctagagtttgaaagggacgggaggctaaagtgagactgccctaaatatagcgtcctgggtatttccggatatttccrgacacctggggaaatgtgggctttattccgcaactacagcctttgtttgattggcaggccagcccctgccacggggccctgctgcccatctcacttccag

SEQ ID NO: 69294 - DNA, 201 bp, Homo sapiens
tgagcagcttgtttaaagtccctgaaactcagtttccacacctttgaggcaaggtaagtgagccagcctcccggggttgcatgcagtgtggccagctggargccgacacacagtaggaacttcacaaatgggggctgatcgattgtgccccacttctgcaccattgctcgttgggtagctccttcatagaatacacttacc

SEQ ID NO: 69295 - DNA, 201 bp, Homo sapiens
ctccctgcattggctacgactgcagctctgggaggtgtgggcaggggagggccagctggggagggccggctggggaggggacacaaagtgaagatgggggwtgttgggcctgagctcctgcccagccttttccgccgggggttcctgggtggattcaagcctcttgggggagacggccctgcagggctggaggatgggttt

SEQ ID NO: 69296 - DNA, 201 bp, Homo sapiens; identical to SEQ ID NO: 36255

SEQ ID NO: 69297 - DNA, 201 bp, Homo sapiens
ccgcagggtaactgagacctccctgcattggctacgactgcagctctgggaggtgtgggcaggggagggccagctggggagggccggctggggaggggacrcaaagtgaagatgggggttgttgggcctgagctcctgcccagccttttccgccgggggttcctgggtggattcaagcctcttgggggagacggccctgca

SEQ ID NO: 69298 - DNA, 201 bp, Homo sapiens
aaccatgaaaatgaagactgaatcaaccaactaagctgtcagcattgccgcagggtaactgagacctccctgcattggctacgactgcagctctgggaggygtgggcaggggagggccagctggggagggccggctggggaggggacacaaagtgaagatgggggttgttgggcctgagctcctgcccagccttttccgcc

SEQ ID NO: 69299 - DNA, 201 bp, Homo sapiens
atccaaactgtagcaaggggtatattatctgtactgttcaccttgcttttttctttttctttttttgagacggagtctcaccctggagtgccatggcacartgacagctcactgcagtctccacctcccaggctcaagccatcctcctacctcagcctcctgaatagactataagcaaagtgccattgtgtctggctaatt

SEQ ID NO: 69300 - DNA, 201 bp, Homo sapiens
tttttttttttttttccagatagagtctcactctgtcacccaggctggagtgcagtggtgcaatcctggctcactgcaacctctgcctcccaggttcaagsaattctcgtgcctcagcctcctgagtagctgggattacaggggcccaccaccacgcccagctcattcttgtatttttagtagagacggggtttcaccata

SEQ ID NO: 69301 - DNA, 201 bp, Homo sapiens
tcatggtgacttcaattttcttatgtatttttttcttctgtgttttccaagttttctaaagtgagaatatggtgagaaagggttttgttgttgttgttgtdttttttgttttttttaaaaccatgaaaatgaagactgaatcaaccaactaagctgtcagcattgccgcagggtaactgagacctccctgcattggctacg

SEQ ID NO: 69302 - DNA, 201 bp, Homo sapiens
gatgaacagagccgtctggatttgggagaagcaggactgagtgggaattcgggacctggcccgggtcctgctctgcccttgccagccgtgtgacctggaasggtggcaccatctccgtgggccccagggccacttcctttggttctttaccagggacctctttcattttcccattcattcattcagcaaatagttctgtag

SEQ ID NO: 69303 - DNA, 201 bp, Homo sapiens
acatagaatcatggtgacttcaattttcttatgtatttttttcttctgtgttttccaagttttctaaagtgagaatatggtgagaaagggttttgttgttkttgttgtgttttttgttttttttaaaaccatgaaaatgaagactgaatcaaccaactaagctgtcagcattgccgcagggtaactgagacctccctgcat

SEQ ID NO: 69304 - DNA, 201 bp, Homo sapiens
gggaggacatagaatcatggtgacttcaattttcttatgtatttttttcttctgtgttttccaagttttctaaagtgagaatatggtgagaaagggttttkttgttgttgttgtgttttttgttttttttaaaaccatgaaaatgaagactgaatcaaccaactaagctgtcagcattgccgcagggtaactgagacctcc

SEQ ID NO: 69305 - DNA, 201 bp, Homo sapiens
tgcagatgacgtccacggctcccacggccggcaggtctgccgtcggcacgagctctacgtcagcttccaggaccttggctggctggtaattgctgactctycttgtttctgaaatgacaatcaccacctgtagatcagaagtgaatctgcagggaggacatagaatcatggtgacttcaattttcttatgtatttttttct

SEQ ID NO: 69306 - DNA, 201 bp, Homo sapiens
gaaaagaccttgccccttctgtccctgcagatgacgtccacggctcccacggccggcaggtctgccgtcggcacgagctctacgtcagcttccaggacctyggctggctggtaattgctgactctccttgtttctgaaatgacaatcaccacctgtagatcagaagtgaatctgcagggaggacatagaatcatggtgact

SEQ ID NO: 69307 - DNA, 201 bp, Homo sapiens
caattcacacacatcctcttctctcctgggcttcatggcagccctgagtagctgccttatcctggcctcaatgctgcctgtcctgacggccatgactgacyaccagtaatgacaccgacattgaggagtgagagtgcctgctgggaaagctgcaggcccaagctgatcaagcggggagaagccccacccagggtgccagag

SEQ ID NO: 69308 - DNA, 201 bp, Homo sapiens
acagagtcagtaacgtcgctaacttcccacagctctgcaggaactggtcctcatacagccacactactacacatagacccacacccaaacacggacacacrtgaacagtcgcgtatgcatgcctgttctatgcactgaacaaactcctgtgggacacttacacacctgcgtgcggcgctcagaggcacagcacatgaaaca

SEQ ID NO: 69309 - DNA, 201 bp, Homo sapiens
aggatgggtttgggccctgaggctcagggaggagcacatggatgggactcaccttctcccttgccccccaggactgggtcatcgccccccaaggctactcrgcctattactgtgagggggagtgctccttcccgctggactcctgcatgaacgccaccaaccacgccatcctgcagtccctggtcagtaccgtgcccatcc

SEQ ID NO: 69310 - DNA, 201 bp, Homo sapiens
tgaatcaaccaactaagctgtcagcattgccgcagggtaactgagacctccctgcattggctacgactgcagctctgggaggtgtgggcaggggagggccrgctggggagggccggctggggaggggacacaaagtgaagatgggggttgttgggcctgagctcctgcccagccttttccgccgggggttcctgggtggat

SEQ ID NO: 69311 - DNA, 201 bp, Homo sapiens
ctccctgcattattcccagccccccttctttgtgtacttcctagcacttagcacataggctaatcttgtttgttaactttcctgtttgttatctgacttcyctgcaagcctgtaaaccccacgggggcaggagctgccccatcttgcttacctcagtgtctcctgcacctaaataatgacttctgcaccattagtactgct

SEQ ID NO: 69312 - DNA, 201 bp, Homo sapiens
gggggcttccccccagaagacatccacgttcctaacatttatgtaggtcgcgtgataaaggggcagaaatacgagaaacgaattgagcgcttaacgatcckgaaagaggaagatggagacgctggaaaggaagaggacgccaggacgcgcatcatcagacgcgcagctctggaatttgaggacggcatgtacgccaatctg

SEQ ID NO: 69313 - DNA, 201 bp, Homo sapiens; identical to SEQ ID NO: 36266

SEQ ID NO: 69314 - DNA, 201 bp, Homo sapiens
ccttggcctcagtttccccatctctgcaggacctgaagtcctttccagctctgaccaaagaatatgcccaccccctgcctgctgatgggggctcctccggkctgaggcacagggtggggaggtgcacccagcccccctcctcctggaacctctttcccacaggcaagagaggatgtgtcaccatgaccacttctttctgga

SEQ ID NO: 69315 - DNA, 201 bp, Homo sapiens
gcaacctctaattcccgggctccagcaatcttcctccctcagcctccccagtagctagggctacagtcgcacaccaccacacccagataatttttaaatayttcttgtagagacggggagtctcactgtattgcccagactggtcttgaactcctgaactcaagcaatcctcccacctcagcctcccaaagtgctgggatt

SEQ ID NO: 69316 - DNA, 201 bp, Homo sapiens
caggcctgtaatctaaccctggaaaccctctgcccctccttggcctcagtttccccatctctgcaggacctgaagtcctttccagctctgaccaaagaatrtgcccaccccctgcctgctgatgggggctcctccggtctgaggcacagggtggggaggtgcacccagcccccctcctcctggaacctctttcccacaggc

SEQ ID NO: 69317 - DNA, 201 bp, Homo sapiens
atcaaaaacctaaacgtgatcatctcttggatgaggtgtggccctgcaccctcgcctgctcgtggaaggagtctgggccagcagtgacccacgcgctaggktctctgctgaggaagtggcaggtgtgtggccctgccctggccccgtagtgagtgtggggcccacctgtgccctcatgggcagctgaagggggagctttct

SEQ ID NO: 69318 - DNA, 201 bp, Homo sapiens
aactactttctgattttcattgccatggcctgttctttgaacttcacataaatggaatcttacagtgcatactcttgagtctagtctttgactcagcatgyttctttttccattttcctccatgttgttgtatctgtagttctttttttcataactgagttgtattccattgcatgaatatacataccacagtccatccat

SEQ ID NO: 69319 - DNA, 201 bp, Homo sapiens
gctggagtgcagtggcagtgtcatggctcactgcagcctcaacctgctgggctcaagcaatcctcccacctcagcccgagttgctgggatgacaggcacaygccaccatacccagctaatttttttattttttatagaaaccaggtctcactatgttgcccaggccggtcttaaactttgcccaggccagtcttgaactcc

SEQ ID NO: 69320 - DNA, 201 bp, Homo sapiens
gaaaaggagagggcaggttttggagccaagtcgacctggcatcaggtcctggctgcctttttttttttttttttaaagacatacatggtcttgctttgtcrcccaggctggagtgcagtggcagtgtcatggctcactgcagcctcaacctgctgggctcaagcaatcctcccacctcagcccgagttgctgggatgacag

SEQ ID NO: 69321 - DNA, 201 bp, Homo sapiens
agaaaccttgctccaaacatcaatggctcctttcagggccaccatagagagaggattcctggcaggatgtatctcagatgatcgggatcaggacactggcyggacagagagcatctccctcatgggccccccagcctatctgaatctgacagggagccctggaattaacttcccaaccttacaactggcagcagaatttta

SEQ ID NO: 69322 - DNA, 201 bp, Homo sapiens; identical to SEQ ID NO: 36768

SEQ ID NO: 69323 - DNA, 201 bp, Homo sapiens
ataaaaaagtttaaggaaagttgctgtgcctcgatgtgcatgtaggccagatttatgtttgactttacacgaacatctcaatgcagtaaagagcagtattrtcgccagcatgtctcacctccagccataaggtggttttctcctatctcagtaaatagaatgtccaatcgggttttacaccacgacattccaatcccaggg

SEQ ID NO: 69324 - DNA, 201 bp, Homo sapiens
accccaggccaggtccccgcctatcattagatgcagtaagtgctgtcgaattgaactgaatgtgaatgtgtattgtaagctgagaagcctgttgttaaagwatttttattttgggggaatttatagaaataatgcatgctcattctacaaaattcagattctgcagaagcatgtaacttgggtgcccctagggagccccat

SEQ ID NO: 69325 - DNA, 201 bp, Homo sapiens
gaagaaaagtgggcccaggcagcactcagcatacggaggacccgcaccagcactggtctctgagttccttcagtatttattgatcactatctaccatctcrgtgagggggatgtggcaggactatagggtaatggtggggagagggtcagcaggaaaacatgtgagcaaaggactctgtgtcataaaaaagtttaaggaaa

SEQ ID NO: 69326 - DNA, 201 bp, Homo sapiens
caaagtacagaggaagaaaagtgggcccaggcagcactcagcatacggaggacccgcaccagcactggtctctgagttccttcagtatttattgatcactrtctaccatctcagtgagggggatgtggcaggactatagggtaatggtggggagagggtcagcaggaaaacatgtgagcaaaggactctgtgtcataaaaa

SEQ ID NO: 69327 - DNA, 201 bp, Homo sapiens
ggcagattcgcactcatgcctcagcccagctcagctgtcagccctgagccctcccctgccgcacctcccatccaggcagcgggcaggctctggatggcttrtgtcccctgagatgccgtcggttatgtcggttatgtccctgtctaccaggtttccctgcagggctggggcccttttctgccttgggtccaatgtccatct

SEQ ID NO: 69328 - DNA, 201 bp, Homo sapiens
ggcaggactatagggtaatggtggggagagggtcagcaggaaaacatgtgagcaaaggactctgtgtcataaataagtttaaggaaaggcgctgtgcctcratgtgcatgtaggccagatttatgtttgactttacacaaacatctcaatgcagtaaagagcagtattgccaccagcatgtctcagtcggtatagtgtgag

SEQ ID NO: 69329 - DNA, 201 bp, Homo sapiens
cactgcaacctctacctcccaggttcaagtgattcccctgcctcagcctcctgagtagctgggactacaggcacacaccactatacctgactaattttttkttttttggtagagatgaggtttcaccatgttggccaggatggtctcgatctcctgaccttgtgatccactcacctcggccacccaaagtgctaggattat

SEQ ID NO: 69330 - DNA, 201 bp, Homo sapiens
cccctgctttccggaaacacagatttctagagtttgaaagggacgggaggctaaagtgagactgccctaaatatagcgtcctgggtatttccggatatttycggacacctggggaaatgtgggctttattccgcaactacagcctttgtttgattggcaggccagcccctgccacggggccctgctgcccatctcacttcc

SEQ ID NO: 69331 - DNA, 201 bp, Homo sapiens
ataagatacagagagacaaagtatagaggaagaaaagtgggcccaggggaccggcactcagcatatggaggacctgcaccggcactggtctctgagttccytcagtatttattgatcactatctctaccatctcagcgagggggatgtggcaggactatagggtaatggtggggagagggtcagcaggaaaacatgtgagc

SEQ ID NO: 69332 - DNA, 201 bp, Homo sapiens
gtgggcccaggggaccggcactcagcatatggaggacctgcaccggcactggtctctgagttccctcagtatttattgatcactatctctaccatctcagygagggggatgtggcaggactatagggtaatggtggggagagggtcagcaggaaaacatgtgagcaaaggactctgtgtcataaataagtttaaggaaagg

SEQ ID NO: 69333 - DNA, 201 bp, Homo sapiens
gtggtgtcactgcccacacccaggctctcacacctgcttctgccagctccacctctcctatcagcctcatctgagtcctgaaaagccaggcctggtgcccstagggcccaactcttgatggcagcctgtgggacccagagggcggggctctcgctggcttcccacccatgggttcaggcctccgtgcagagcaggtgcttt

SEQ ID NO: 69334 - DNA, 201 bp, Homo sapiens
gccgcaggctgcaacctgggctctgggacttggttcaatgtttctgctctgcctggcatctcccttgtgggcatcagggagacagttaatgccctgctctwgggctgtgcccagcagaacaagcactcgctcaacctggcagatgctaccacgagctgtctcggtgataagtttgacattcacaccccagaaagtgcggga

SEQ ID NO: 69335 - DNA, 201 bp, Homo sapiens
aaactgaggctcagcaggaccccttgggtcctcagcctccacgctcctggacctgcccaggccccggcagagagaccgctgctgtgtctgctgcagggccrctgcccgtgagtgacccctctctcctttctgtctcagggcacagcgtggatcctggcctggccggcctgctgggtcaacgggccccacgctcccaacagc

SEQ ID NO: 69336 - DNA, 201 bp, Homo sapiens
atgtttgactttacacgaacatctcaatgcagtaaagagcagtattgtcgccagcatgtctcacctccagccataaggtggttttctcctatctcagtaartagaatgtccaatcgggttttacaccacgacattccaatcccagggatgagcaggagacagatgccttcctcttatctcaactgcaaagagtccttcctc

SEQ ID NO: 69337 - DNA, 201 bp, Homo sapiens
ttttataaatttgaaatgtttattgtggagacttatttaaacaaccagaaaaagttttgtgttttgttttttttttcttgaaacacactctcattctgtckcccagctggagtgtggtgacacaatcacacctcactgcagcctcaacctcccaggctcaagcagtcctcccacctcagcttcccgggaagttcaccacca

SEQ ID NO: 69338 - DNA, 201 bp, Homo sapiens
tgatgggctcaccctttattagatacaaggttgtcttattccatcttgtgttgctgtaacagactccctaaggctgagtaatttacaaaaaaaaaaaaaaagaggtttattttattttatttttgagacggagtcttgctctgtcaccctggctggagtgcagtggtacagtttcagctcactgcaacctctacctcctgg

SEQ ID NO: 69339 - DNA, 201 bp, Homo sapiens
gtgtgtgtgtgcgcatgcacgcgtgcacacgtgctgttgacagccaagcctggcctggtgcatgcactgcataagtgtagctctgggggttcccaggccaytgggggcatgtggtcagagtagtaagttctcactggtcaaggacagactttccaggggcccattggagcctcaccctgcaggaaaggccagatcctggga

SEQ ID NO: 69340 - DNA, 201 bp, Homo sapiens
gtgtgtgtgtgtgtgtgcgcatgcacgcgtgcacacgtgctgttgacagccaagcctggcctggtgcatgcactgcataagtgtagctctgggggttcccmggccattgggggcatgtggtcagagtagtaagttctcactggtcaaggacagactttccaggggcccattggagcctcaccctgcaggaaaggccagatc

SEQ ID NO: 69341 - DNA, 201 bp, Homo sapiens
ccgcaatttcaacgtgcccatgtgcaaagctgcagacgtcacggcggtggaggtgggggcttccccccagaagacatccacgttcctaacatttatgtagrtcgcgtgataaaggggcagaaatacgagaaacgaattgagcgcttaacgatccggaaagaggaagatggagacgctggaaaggaagaggacgccaggacg

SEQ ID NO: 69342 - DNA, 201 bp, Homo sapiens
agggtgagcctggctgcagggcctcttggccctgtctacaccccgggaccaagcctggaacaaacgtttgcacaaaatgaagccggccccacccaggcctscctgggtccgctccaccttgagtggtgggtgtctgggggcggtggctcacaccagctctgccccctccagagcccgagccattctgagtgccagcccagc

SEQ ID NO: 69343 - DNA, 201 bp, Homo sapiens
gaagctcccagaggaggctccctcctgtctcatctctgggtcccaggaccagccgggccaagaaggggcgcaacgggagttcaggatttggagcctggggmctgctgagcaccagccaggtgcagggctcagggtgagcctggctgcagggcctcttggccctgtctacaccccgggaccaagcctggaacaaacgtttgc

SEQ ID NO: 69344 - DNA, 201 bp, Homo sapiens
ccatggcagattcgcactcatgcctcagcccagctcagctgtcagccctgagccctcccctgccgcacctcccatccaggcagcgggcaggctctggatgscttatgtcccctgagatgccgtcggttatgtcggttatgtccctgtctaccaggtttccctgcagggctggggcccttttctgccttgggtccaatgtcc

SEQ ID NO: 69345 - DNA, 201 bp, Homo sapiens
ggcccgtctccctgacaccatggcagattcgcactcatgcctcagcccagctcagctgtcagccctgagccctcccctgccgcacctcccatccaggcagygggcaggctctggatggcttatgtcccctgagatgccgtcggttatgtcggttatgtccctgtctaccaggtttccctgcagggctggggcccttttctg

SEQ ID NO: 69346 - DNA, 201 bp, Homo sapiens
acggtcttcatccccatctcccagatgaggacagtgaggttcagagaggcagcgccatgcctaggacagcgcagcctctatgttgctgagccaggacaggyccaggaagcctgactgtccatccagggctcaatgagatgacatttctgttgtcaggtcaggctttcagggtgcagagagctttctgaggagtctgggctg

SEQ ID NO: 69347 - DNA, 201 bp, Homo sapiens
cagtgatctctgcctatgggaagagatcgtggcctgtgtcacggcatctgagcagcccggctctcaggcgagcttttgctgcatgcccagcaccctcaggygctgtgggacaagacaagttcatttttcctccgccctgggctgggatgagcggccacctcctcctgcccacacacgtctggccccatcccccgccccgca

SEQ ID NO: 69348 - DNA, 201 bp, Homo sapiens
ctcctgccctctgctgtttcctggtgcttgctttccctgccctgccctcagacccctctgctctggccctctgccttggctggccggcccctgcagggccygtctccctgacaccatggcagattcgcactcatgcctcagcccagctcagctgtcagccctgagccctcccctgccgcacctcccatccaggcagcgggc

SEQ ID NO: 69349 - DNA, 201 bp, Homo sapiens
cacctctgtgctctactatgacagcagcaacaacgtcatcctgcgcaagcaccgcaacatggtggtcaaggcctgcggctgccactgagtcagcccgcccrgccctactgcagccacccttctcatctggatcgggccctgcagaggcagaaaacccttaaatgctgtcacagctcaagcaggagtgtcaggggccctcac

SEQ ID NO: 69350 - DNA, 201 bp, Homo sapiens
gctgagcgccacctctgtgctctactatgacagcagcaacaacgtcatcctgcgcaagcaccgcaacatggtggtcaaggcctgcggctgccactgagtcmgcccgcccagccctactgcagccacccttctcatctggatcgggccctgcagaggcagaaaacccttaaatgctgtcacagctcaagcaggagtgtcagg

SEQ ID NO: 69351 - DNA, 201 bp, Homo sapiens
ctgagcgccacctctgtgctctactatgacagcagcaacaacgtcatcctgcgcaagcaccgcaacatggtggtcaaggcctgcggctgccactgagtcarcccgcccagccctactgcagccacccttctcatctggatcgggccctgcagaggcagaaaacccttaaatgctgtcacagctcaagcaggagtgtcaggg

SEQ ID NO: 69352 - DNA, 201 bp, Homo sapiens; identical to SEQ ID NO: 36585

SEQ ID NO: 69353 - DNA, 201 bp, Homo sapiens
atgagagactgagaaaagaaataagatacagagagacaaagtatagaggaagaaaagtgggcccaggggaccggcactcagcatatggaggacctgcaccrgcactggtctctgagttccctcagtatttattgatcactatctctaccatctcagcgagggggatgtggcaggactatagggtaatggtggggagagggt

SEQ ID NO: 69354 - DNA, 201 bp, Homo sapiens; identical to SEQ ID NO: 36586

SEQ ID NO: 69355 - DNA, 201 bp, Homo sapiens
gtggagatgagagactgagaaaagaaataagatacagagagacaaagtatagaggaagaaaagtgggcccaggggaccggcactcagcatatggaggaccygcaccggcactggtctctgagttccctcagtatttattgatcactatctctaccatctcagcgagggggatgtggcaggactatagggtaatggtgggga

SEQ ID NO: 69356 - DNA, 201 bp, Homo sapiens
agaaataagatacagagagacaaagtatagaggaagaaaagtgggcccaggggaccggcactcagcatatggaggacctgcaccggcactggtctctgagktccctcagtatttattgatcactatctctaccatctcagcgagggggatgtggcaggactatagggtaatggtggggagagggtcagcaggaaaacatgt

SEQ ID NO: 69357 - DNA, 201 bp, Homo sapiens
tctcgaaaggtggagatgagagactgagaaaagaaataagatacagagagacaaagtatagaggaagaaaagtgggcccaggggaccggcactcagcatayggaggacctgcaccggcactggtctctgagttccctcagtatttattgatcactatctctaccatctcagcgagggggatgtggcaggactatagggtaa

SEQ ID NO: 69358 - DNA, 201 bp, Homo sapiens
atcactttgaagggggcctgcccctccacacctgtgggtatttctcgaaaggtggagatgagagactgagaaaagaaataagatacagagagacaaagtayagaggaagaaaagtgggcccaggggaccggcactcagcatatggaggacctgcaccggcactggtctctgagttccctcagtatttattgatcactatct

SEQ ID NO: 69359 - DNA, 201 bp, Homo sapiens
taactgtagaagaaaggacaagtcttcctttcaaaagaattccagttaataaatgtagaaggaaagaaggaaatagaaaatcgctattccagcctggacargatggcaagaccccatctctacaaaaaatacaaaaaaaatagccaggtgtggtggtacatgactgtacatgactgtagtcccagctacttgacaggctga

SEQ ID NO: 69360 - DNA, 201 bp, Homo sapiens
aaacaacaggaaaacagatcagttcctcactgtgtttctcgagcactgcaaggcgcaggtctgcagtggtgaggaatggatgtccgctttgctctgtgatstttacacagagcgtgcacagctcagcgcattcacagcaagatttgattcaagcgcctccctcgtacttgaaccatgaaatggagataaaaactgacgagg

SEQ ID NO: 69361 - DNA, 201 bp, Homo sapiens
actcatgaggccttctcaaacatcacatctaaagaaaccccacactgggccgggcgcaatggctcacgcctataatcccagcactttgggaggccaaggcrggtggatcatgaggtcgggagttcaagaccagcctggccaagatggtgaaaccctgtctctactgaaaatacaaaagttagctgggcttagtggcaggca

SEQ ID NO: 69362 - DNA, 201 bp, Homo sapiens
tgggagccagtgggcagccctgggggaggtttctggagactgatagggctcagtttcaacacctgaaagaggccatgaggtggcctggctggcccaaaatyggtgcagggtgagaggccatcctagcacaggctgcgcaccatgacaccacactgcagtttccaggtaggcctggggttggggaggaggaagtaggagcca

SEQ ID NO: 69363 - DNA, 201 bp, Homo sapiens
caggactagcaggcagaagtccagccaggatcagaatgcaggcagcttcatttttgtcctgatcccttcctgaaccagacagatttgctcctgtggtctcyggtggccatggacaggggtgttgatgaacagagccgtctggatttgggagaagcaggactgagtgggaattcgggacctggcccgggtcctgctctgccc

SEQ ID NO: 69364 - DNA, 201 bp, Homo sapiens
tgcttgaacctgggaggcagaggttgtagtgagctgagatcatgctccagcctgagtgacaaaagcaaaactccatctcaaaaaaaaaaaaaaaaaaaaaaggcttgattcagacagagctcctaggacatgtcatgggagccagtgggcagccctgggggaggtttctggagactgatagggctcagtttcaacacctga

SEQ ID NO: 69365 - DNA, 201 bp, Homo sapiens
ccatctcagcagagaggcaggtgcccatgttccagattgagaaactgaggcataagcaggactagcaggcagaagtccagccaggatcagaatgcaggcarcttcatttttgtcctgatcccttcctgaaccagacagatttgctcctgtggtctccggtggccatggacaggggtgttgatgaacagagccgtctggatt

SEQ ID NO: 69366 - DNA, 201 bp, Homo sapiens
cccagtgccagggacaggactctagccggtgggatctgtatgctgcctttgtagttagaggacagggtggggatgtgggacagaggagaccatctgtgaakctggggctggggctctgtcatcaggacaggctgacactgggctcaggaccaagaagagttgtggatggagtcgtccaagaatgtccccagggagccgccc

SEQ ID NO: 69367 - DNA, 201 bp, Homo sapiens
tacactagagcagaagagggcatggccaagcctctgcttcccgcaacccagagctggtggtggaggcgagcagcagaaggcagccattcaccatcgctgarcgcccagtgccagggacaggactctagccggtgggatctgtatgctgcctttgtagttagaggacagggtggggatgtgggacagaggagaccatctgtg

SEQ ID NO: 69368 - DNA, 201 bp, Homo sapiens
tgctgtgctaactgcactagtagaactgtctcagagtagctttaactggtaattactgaggctgggtggggcggggtgggtggggggtggatagacacgtmccaggatgctctcagtgtttggaggcccctgaaggttggtggccccagagccaccatgggatctaatagcagggtcgctgtggtgtcactgcccacaccc

SEQ ID NO: 69369 - DNA, 201 bp, Homo sapiens
aattacggtatactgctccaagggattttataaatttgaaatgtttattgtggagacttatttaaacaaccagaaaaagttttgtgttttgtttttttttycttgaaacacactctcattctgtcgcccagctggagtgtggtgacacaatcacacctcactgcagcctcaacctcccaggctcaagcagtcctcccacct

SEQ ID NO: 69370 - DNA, 201 bp, Homo sapiens
aaacatatcattgaaatctcagtgttgggttttggggaaggcactgggcggctcccacccctgctttccggaaacacagatttctagagtttgaaagggaygggaggctaaagtgagactgccctaaatatagcgtcctgggtatttccggatatttccggacacctggggaaatgtgggctttattccgcaactacagcc

SEQ ID NO: 69371 - DNA, 201 bp, Homo sapiens
tctgtgcttataacatggaggtgaaatgtactttcgtgtaaactgaacaactggcactgtttaaagagacatgaaaatgagctggtaatcatgcttctgcmattcagtatcaggaaatttcacccatgcacggagtgaagaggctccattgcactcccatctttatcatgaaagccgggaaataacctacatgtctatgat

SEQ ID NO: 69372 - DNA, 201 bp, Homo sapiens
acggcatctgagcagcccggctctcaggcgagcttttgctgcatgcccagcaccctcaggtgctgtgggacaagacaagttcatttttcctccgccctggsctgggatgagcggccacctcctcctgcccacacacgtctggccccatcccccgccccgcacagctgttcgcctgcccttggctggaccaggttcccacca

SEQ ID NO: 69373 - DNA, 201 bp, Homo sapiens
ccttgacaaagatcaggcaggtgaaaaggaggcacccagaagttgaactgatagatttctctcattccatacttttatttagaaaaaaagaaaactagccrggtgcagtggctcacgcttgtaatcccagcactttgggaggccgaggcgggcagatcacaagatcaggagatcgagaccatcctggctaacacggtgaaa

SEQ ID NO: 69374 - DNA, 201 bp, Homo sapiens
gtgaggttcagagaggcagcgccatgcctaggacagcgcagcctctatgttgctgagccaggacaggcccaggaagcctgactgtccatccagggctcaawgagatgacatttctgttgtcaggtcaggctttcagggtgcagagagctttctgaggagtctgggctgaggaacacagggtactgagctgcagcaggtctt

SEQ ID NO: 69375 - DNA, 201 bp, Homo sapiens
tgaagtgggaggatcacctgagcccaggtggttgaggctgcagtgagctgtgactgtgccactgcactccagcctgggtgacagagcaagaccctgtctcmaaaaaaaaaaaaaaaaaaaagtgtcaaggttgaaagggaaggaaagactgaggaacagtcagatcggaggggccccggggaaatgacactaaatgtattc

SEQ ID NO: 69376 - DNA, 201 bp, Homo sapiens
ggagtcgtccaagaatgtccccagggagccgcccatcagaatgcgtcaccacccagcccacatccgacctcccctggcatcccctgggtcaaggcatgcayagcctggtggggctgttgctgtgaattgggcagggcccacccctctgtgtgaccttagggaagttcctcaccttctcagccttggttgctccttataaaa

SEQ ID NO: 69377 - DNA, 201 bp, Homo sapiens
tactcaagactggagaatggcaatgacttttaccaaacatactgcctgcaaacacatttttaacaaaacacatcctgcacagccctaaatccattaaaccytgagtcaatacagtacatgtttctgcaagcacagggttggggctagggttacagattaacagcatctcaaagcagaagaatttttcttagtacagatcaa

SEQ ID NO: 69378 - DNA, 201 bp, Homo sapiens
ggggatgtggcaggactatagggtaatggtggggagagggtcagcaggaaaacatgtgagcaaaggactctgtgtcataaaaaagtttaaggaaagttgcygtgcctcgatgtgcatgtaggccagatttatgtttgactttacacgaacatctcaatgcagtaaagagcagtattgtcgccagcatgtctcacctccagc

SEQ ID NO: 69379 - DNA, 201 bp, Homo sapiens
tgggcccaggcagcactcagcatacggaggacccgcaccagcactggtctctgagttccttcagtatttattgatcactatctaccatctcagtgaggggratgtggcaggactatagggtaatggtggggagagggtcagcaggaaaacatgtgagcaaaggactctgtgtcataaaaaagtttaaggaaagttgctgtg

SEQ ID NO: 69380 - DNA, 201 bp, Homo sapiens; identical to SEQ ID NO: 69328

SEQ ID NO: 69381 - DNA, 201 bp, Homo sapiens
ctggcatcccctgggtcaaggcatgcacagcctggtggggctgttgctgtgaattgggcagggcccacccctctgtgtgaccttagggaagttcctcaccytctcagccttggttgctccttataaaaggaggtgcctggtgatctgtcctcagggttgttgtgtgattggtagaggggcaggagtagaaagcctgtgctg

SEQ ID NO: 69382 - DNA, 201 bp, Homo sapiens
tatctaccatctcagtgagggggatgtggcaggactatagggtaatggtggggagagggtcagcaggaaaacatgtgagcaaaggactctgtgtcataaawaagtttaaggaaaggcgctgtgcctcgatgtgcatgtaggccagatttatgtttgactttacacaaacatctcaatgcagtaaagagcagtattgccacc

SEQ ID NO: 69383 - DNA, 201 bp, Homo sapiens
tgggtcaaggcatgcacagcctggtggggctgttgctgtgaattgggcagggcccacccctctgtgtgaccttagggaagttcctcaccttctcagccttsgttgctccttataaaaggaggtgcctggtgatctgtcctcagggttgttgtgtgattggtagaggggcaggagtagaaagcctgtgctgctcccctcaga

SEQ ID NO: 69384 - DNA, 201 bp, Homo sapiens
agaaaagtgggcccaggcagcactcagcatacggaggacccgcaccagcactggtctctgagttccttcagtatttattgatcactatctaccatctcagygagggggatgtggcaggactatagggtaatggtggggagagggtcagcaggaaaacatgtgagcaaaggactctgtgtcataaataagtttaaggaaagg

SEQ ID NO: 69385 - DNA, 201 bp, Homo sapiens
atgcacagcctggtggggctgttgctgtgaattgggcagggcccacccctctgtgtgaccttagggaagttcctcaccttctcagccttggttgctccttrtaaaaggaggtgcctggtgatctgtcctcagggttgttgtgtgattggtagaggggcaggagtagaaagcctgtgctgctcccctcagagggtgaacctg

SEQ ID NO: 69386 - DNA, 201 bp, Homo sapiens
agtaaccagagagaatttttaaaaagactcacaaacatatcattgaaatctcagtgttgggttttggggaaggcactgggcggctcccacccctgctttcyggaaacacagatttctagagtttgaaagggacgggaggctaaagtgagactgccctaaatatagcgtcctgggtatttccggatatttccggacacctgg

SEQ ID NO: 69387 - DNA, 201 bp, Homo sapiens
aatatttaaataaataaataactgtagaagaaaggacaagtcttcctttcaaaagaattccagttaataaatgtagaaggaaagaaggaaatagaaaatcrctattccagcctggacaagatggcaagaccccatctctacaaaaaatacaaaaaaaatagccaggtgtggtggtacatgactgtacatgactgtagtccc

SEQ ID NO: 69388 - DNA, 201 bp, Homo sapiens; identical to SEQ ID NO: 36590

SEQ ID NO: 69389 - DNA, 201 bp, Homo sapiens; identical to SEQ ID NO: 36591

SEQ ID NO: 69390 - DNA, 201 bp, Homo sapiens; identical to SEQ ID NO: 36592

SEQ ID NO: 69391 - DNA, 201 bp, Homo sapiens
ggacaggcccaggaagcctgactgtccatccagggctcaatgagatgacatttctgttgtcaggtcaggctttcagggtgcagagagctttctgaggagtytgggctgaggaacacagggtactgagctgcagcaggtcttgtggggccatcagccatttgcttcctacactagagcagaagagggcatggccaagcctct

SEQ ID NO: 69392 - DNA, 201 bp, Homo sapiens
aggacaggcccaggaagcctgactgtccatccagggctcaatgagatgacatttctgttgtcaggtcaggctttcagggtgcagagagctttctgaggagwctgggctgaggaacacagggtactgagctgcagcaggtcttgtggggccatcagccatttgcttcctacactagagcagaagagggcatggccaagcctc

SEQ ID NO: 69393 - DNA, 201 bp, Homo sapiens; identical to SEQ ID NO: 36298

SEQ ID NO: 69394 - DNA, 201 bp, Homo sapiens
ctgagggagctctgggagggcctgacggtggacgacatcaaaaagagcacggggtgtgcctttgctgtgtccccgaacctcaggcccatgcagcaggtggyaccctgacgggacctggatctgggcggggtggtgcgctcctcagggcggatgccaccgggttccccaggggaatacatgtccccagctctgggaggggtt

SEQ ID NO: 69395 - DNA, 201 bp, Homo sapiens; identical to SEQ ID NO: 36299

SEQ ID NO: 69396 - DNA, 201 bp, Homo sapiens
gcggtgcgtggaccgcatcatcaccgagaaggccgtgtttgacgtgcacaggaagaaagagctgacgctgagggagctctgggagggcctgacggtggacracatcaaaaagagcacggggtgtgcctttgctgtgtccccgaacctcaggcccatgcagcaggtggcaccctgacgggacctggatctgggcggggtggt

SEQ ID NO: 69397 - DNA, 201 bp, Homo sapiens; identical to SEQ ID NO: 36594

SEQ ID NO: 69398 - DNA, 201 bp, Homo sapiens; identical to SEQ ID NO: 36300

SEQ ID NO: 69399 - DNA, 201 bp, Homo sapiens
ccccaagatcatggagaaatgcaccatgccgctgaccgggaagcggtgcgtggaccgcatcatcaccgagaaggccgtgtttgacgtgcacaggaagaaaragctgacgctgagggagctctgggagggcctgacggtggacgacatcaaaaagagcacggggtgtgcctttgctgtgtccccgaacctcaggcccatgca

SEQ ID NO: 69400 - DNA, 201 bp, Homo sapiens; identical to SEQ ID NO: 36595

SEQ ID NO: 69401 - DNA, 201 bp, Homo sapiens; identical to SEQ ID NO: 36301

SEQ ID NO: 69402 - DNA, 201 bp, Homo sapiens; identical to SEQ ID NO: 36302

SEQ ID NO: 69403 - DNA, 201 bp, Homo sapiens; identical to SEQ ID NO: 36303

SEQ ID NO: 69404 - DNA, 201 bp, Homo sapiens; identical to SEQ ID NO: 36304

SEQ ID NO: 69405 - DNA, 201 bp, Homo sapiens
cacagcacatgaaacagatgtgtacactgtgtgggggctgtgtgatcttaacacacgggcccccgagtacgctggcaagtctgaccgcccgtgatatgtgygcacagtgtgtggggtgtgcgtgtgcactcacccacctgtgccgcaccacaggcaggaagcttctagatggtgtggctctcaaccttttggctttttccc

SEQ ID NO: 69406 - DNA, 201 bp, Homo sapiens
gcgctcagaggcacagcacatgaaacagatgtgtacactgtgtgggggctgtgtgatcttaacacacgggcccccgagtacgctggcaagtctgaccgccygtgatatgtgcgcacagtgtgtggggtgtgcgtgtgcactcacccacctgtgccgcaccacaggcaggaagcttctagatggtgtggctctcaacctttt

SEQ ID NO: 69407 - DNA, 201 bp, Homo sapiens
caaatttcacgccactagtaataagatagattggtatcatattgtcccatttgatgctctgagaagggcatatcactttgaagggggcctgcccctccacrcctgtgggtatttctcgaaaggtggagatgagagactgagaaaagaaataagatacagagagacaaagtatagaggaagaaaagtgggcccaggggaccg

SEQ ID NO: 69408 - DNA, 201 bp, Homo sapiens
agctactcgggaggctgaggcaggagaatcgcttgaacccaggcagcagaggttgcagtgagctgagatcacgccactgcactccagcctggccgacagaktgagactgtctcaaaaaaaaaaaaaaaaagaaaaggaaaccccacactggactggaattggaggtgccagtatgatctcagatatttaaaataaaaaata

SEQ ID NO: 69409 - DNA, 201 bp, Homo sapiens
gcccagccgaaaacaggtttatttggcatacaattctagtggctgaaaggctcaaggctgggcagctgcatctggtgagagcctcaggctacttcaattcmtggcagaaagtggaaggacagtgggtgtgtacaaagagagcatgtggtgagaggaagcaagagagcaagccagactttttaacagcctcccccatctagg

SEQ ID NO: 69410 - DNA, 201 bp, Homo sapiens
ccaacacctgatctcagtgtgatctgggctttccagtcaacctccccaagcctcagtttcctcctctgtaaaatggagatactcatcttatgggactgttstgggcttgtgtgagatgatacccagcgatgcccacgtgcccagaacctctgcatctcttccttcattggtatctcacaattgccgtcacatctgtgtttg

SEQ ID NO: 69411 - DNA, 201 bp, Homo sapiens
ctgacgccaacacctgatctcagtgtgatctgggctttccagtcaacctccccaagcctcagtttcctcctctgtaaaatggagatactcatcttatgggrctgttctgggcttgtgtgagatgatacccagcgatgcccacgtgcccagaacctctgcatctcttccttcattggtatctcacaattgccgtcacatctg

SEQ ID NO: 69412 - DNA, 201 bp, Homo sapiens
ggggatataacaatgagagaagtaaagtccctgccctcagggagatgactttctagtctagagacacataatacatacatgagccctaaaggtaattgtcrggtgtgctagacagcaacgccccatcgggaaacaggaggggctgaacaatggcaggacagacagggctagattgggggtttctgacctgagacccacaca

SEQ ID NO: 69413 - DNA, 201 bp, Homo sapiens
tgttgatgaacagagccgtctggatttgggagaagcaggactgagtgggaattcgggacctggcccgggtcctgctctgcccttgccagccgtgtgacctrgaacggtggcaccatctccgtgggccccagggccacttcctttggttctttaccagggacctctttcattttcccattcattcattcagcaaatagttct

SEQ ID NO: 69414 - DNA, 201 bp, Homo sapiens
ccatgttccagattgagaaactgaggcataagcaggactagcaggcagaagtccagccaggatcagaatgcaggcagcttcatttttgtcctgatcccttyctgaaccagacagatttgctcctgtggtctccggtggccatggacaggggtgttgatgaacagagccgtctggatttgggagaagcaggactgagtggga

SEQ ID NO: 69415 - DNA, 201 bp, Homo sapiens
aaggaccacctctgcacactccttctgaatccttctccacccatctcagcagagaggcaggtgcccatgttccagattgagaaactgaggcataagcaggmctagcaggcagaagtccagccaggatcagaatgcaggcagcttcatttttgtcctgatcccttcctgaaccagacagatttgctcctgtggtctccggtg

SEQ ID NO: 69416 - DNA, 201 bp, Homo sapiens
agcctggtggggctgttgctgtgaattgggcagggcccacccctctgtgtgaccttagggaagttcctcaccttctcagccttggttgctccttataaaakgaggtgcctggtgatctgtcctcagggttgttgtgtgattggtagaggggcaggagtagaaagcctgtgctgctcccctcagagggtgaacctggacctg

SEQ ID NO: 69417 - DNA, 201 bp, Homo sapiens; identical to SEQ ID NO: 36609

SEQ ID NO: 69418 - DNA, 201 bp, Homo sapiens; identical to SEQ ID NO: 36538

SEQ ID NO: 69419 - DNA, 201 bp, Homo sapiens
gctcactgcagcctcaacctgctgggctcaagcaatcctcccacctcagcccgagttgctgggatgacaggcacacgccaccatacccagctaattttttwattttttatagaaaccaggtctcactatgttgcccaggccggtcttaaactttgcccaggccagtcttgaactcctgagctcaagcaatcctcctgcctc

SEQ ID NO: 69420 - DNA, 201 bp, Homo sapiens; identical to SEQ ID NO: 36610

SEQ ID NO: 69421 - DNA, 201 bp, Homo sapiens
gcctggccggggagacctgctgggagggagtgcgtcagggcgcgggcgcccgccctgctctgtgacgcgcggcccgaggcgcacgcagggctcacaccacytgtcctggcctccgacccgggccgactatggcggcgctgcggctcctggcgtcagtgctcgggcgcggggtccccgccggcggctcagggctcgcgctgt

SEQ ID NO: 69422 - DNA, 201 bp, Homo sapiens
aggccctaagacaggagcaggctggccctaagttcagggccagcagggaggagaggggctgggtgcagtgaaggggaggagagtggagggaggtgatgccrgggtgagccaggccagctcccgtagggcctggggttccctgggaaggagggtggattttattccaagcaaccccagaggctgtcagaggtcttcagcaaa

SEQ ID NO: 69423 - DNA, 201 bp, Homo sapiens
gcctggcctagagcctgcgcctggccggggagacctgctgggagggagtgcgtcagggcgcgggcgcccgccctgctctgtgacgcgcggcccgaggcgcwcgcagggctcacaccacctgtcctggcctccgacccgggccgactatggcggcgctgcggctcctggcgtcagtgctcgggcgcggggtccccgccggcg

SEQ ID NO: 69424 - DNA, 201 bp, Homo sapiens
cctctcaggccccatggcaggcagggctccccagggagtcacaggacagagctgcaagtggagccaggagggctgccctgggccccaggctgtccccatgkgtcagccagtctgcagagtgacactccagtgcccgggctggtgaccaccaccaccccactcaggctgctctgttctctctccgttgtgacctcacttgtc

SEQ ID NO: 69425 - DNA, 201 bp, Homo sapiens
ttcgcctgcccttggctggaccaggttcccaccacgaggacaggaagtgctccccacatccgcctcggcccgcacagcctggtgcttttccaaacctgacygtggtcactgagcccagtaaccagagagaatttttaaaaagactcacaaacatatcattgaaatctcagtgttgggttttggggaaggcactgggcggct

SEQ ID NO: 69426 - DNA, 201 bp, Homo sapiens
gacgcgtggggtggcctggcccagccaccctttatgccgtgtggttctcacagctgcatgtgtgggaggtacatgggaaggtgactgcacctgcagctccyggactccatctcctctgcccttgcccctgcccctcaggggctcaactagagtgagtgctcacagcctacagggcagcaaacaggcactgtgctctagggg

SEQ ID NO: 69427 - DNA, 201 bp, Homo sapiens
tgggaggcagcagcaggcattgcatgctgtatattgaggacctgtctagaggcctcgagcgcttttggccagttccagcatggttttaatgccccatttcycagcatcagacggaggtggtccacggtagcagaaggagcccagcgaggagtcagggttccgtttccacgtgtgggaacatgggaggagattgtatttggt

SEQ ID NO: 69428 - DNA, 201 bp, Homo sapiens
tgaaaagccaggcctggtgcccctagggcccaactcttgatggcagcctgtgggacccagagggcggggctctcgctggcttcccacccatgggttcaggyctccgtgcagagcaggtgctttaggaagccaagcctgcgtcctgatgttcagagcctgcactgggaggccagggctggggtcagagccggggccctgcct

SEQ ID NO: 69429 - DNA, 201 bp, Homo sapiens
agaagcagagctgatggagaagggaggctctgggctctggaaggagagggctggggatgggggagcttctccaggcctgccagatgcagggctctgaaccsagacccactgttagtccccttcaccaccccccatcttgcccagccacatccagctgggccctgcagtttgctggaaaagtatatgacaatcctggctccg

SEQ ID NO: 69430 - DNA, 201 bp, Homo sapiens
cagggtcgctgtggtgtcactgcccacacccaggctctcacacctgcttctgccagctccacctctcctatcagcctcatctgagtcctgaaaagccaggyctggtgcccctagggcccaactcttgatggcagcctgtgggacccagagggcggggctctcgctggcttcccacccatgggttcaggcctccgtgcagag

SEQ ID NO: 69431 - DNA, 201 bp, Homo sapiens
tctaatagcagggtcgctgtggtgtcactgcccacacccaggctctcacacctgcttctgccagctccacctctcctatcagcctcatctgagtcctgaawagccaggcctggtgcccctagggcccaactcttgatggcagcctgtgggacccagagggcggggctctcgctggcttcccacccatgggttcaggcctcc

SEQ ID NO: 69432 - DNA, 201 bp, Homo sapiens
ccatgggatctaatagcagggtcgctgtggtgtcactgcccacacccaggctctcacacctgcttctgccagctccacctctcctatcagcctcatctgastcctgaaaagccaggcctggtgcccctagggcccaactcttgatggcagcctgtgggacccagagggcggggctctcgctggcttcccacccatgggttc

SEQ ID NO: 69433 - DNA, 201 bp, Homo sapiens
cacacagcacatccaaggtgacatccatggctgtggattccaaatcccagcttcttcccacaccagctctgagcacttcatgaagactcggggcctccagygccgtgggattaacaagcagatcgttgttagtggaagcccaggctgtgggtgggcgcagccagctgtcagaaaggccttctttattctgctgtgctaact

SEQ ID NO: 69434 - DNA, 201 bp, Homo sapiens
gcctttgtagttagaggacagggtggggatgtgggacagaggagaccatctgtgaagctggggctggggctctgtcatcaggacaggctgacactgggctyaggaccaagaagagttgtggatggagtcgtccaagaatgtccccagggagccgcccatcagaatgcgtcaccacccagcccacatccgacctcccctggc

SEQ ID NO: 69435 - DNA, 201 bp, Homo sapiens
gggtgcagagagctttctgaggagtctgggctgaggaacacagggtactgagctgcagcaggtcttgtggggccatcagccatttgcttcctacactagarcagaagagggcatggccaagcctctgcttcccgcaacccagagctggtggtggaggcgagcagcagaaggcagccattcaccatcgctgagcgcccagtg

SEQ ID NO: 69436 - DNA, 201 bp, Homo sapiens
aagcctgactgtccatccagggctcaatgagatgacatttctgttgtcaggtcaggctttcagggtgcagagagctttctgaggagtctgggctgaggaamacagggtactgagctgcagcaggtcttgtggggccatcagccatttgcttcctacactagagcagaagagggcatggccaagcctctgcttcccgcaacc

SEQ ID NO: 69437 - DNA, 201 bp, Homo sapiens; identical to SEQ ID NO: 36980

SEQ ID NO: 69438 - DNA, 201 bp, Homo sapiens; identical to SEQ ID NO: 36981

SEQ ID NO: 69439 - DNA, 201 bp, Homo sapiens
tctgggattcttctcatttggtccagggtgcagttagcatattagaaaaagaataagctggacatccccacgaagccactggggattttttttttttttttccagatagagtctcactctgtcacccaggctggagtgcagtggtgcaatcctggctcactgcaacctctgcctcccaggttcaagcaattctcgtgcctc

SEQ ID NO: 69440 - DNA, 201 bp, Homo sapiens
tgaactgatagatttctctcattccatacttttatttagaaaaaaagaaaactagccgggtgcagtggctcacgcttgtaatcccagcactttgggaggcygaggcgggcagatcacaagatcaggagatcgagaccatcctggctaacacggtgaaaccctgtctctactaaaaatacaaaaaattagctaggcgtggtt

SEQ ID NO: 69441 - DNA, 201 bp, Homo sapiens
tctgagcccttggcctgggactcgaggcccctcattagtgccctgcccacctgccccacaccctggggctgccatgtatccctccctgggcactgtgggcyaccacagctcccgctcccagagctctcagggctgctcttattcctgttaataattcttattattgtgctgctcccatgtggcttggagatggccagggca

SEQ ID NO: 69442 - DNA, 201 bp, Homo sapiens; identical to SEQ ID NO: 36873

SEQ ID NO: 69443 - DNA, 201 bp, Homo sapiens
gacaaatgtgtggtctcttcagtgcccagtgtgtaacctggcatggtttgggtgtgctaggagtttgtgaaatgaatgttttcaagacgcaaacgctgctrtgcccatcaggtgtgcacagcaggcctgaggatcatgatgagactccctttttatgcagcaaagcacaaagtgtgacagtcgtggccttcctggtggcca

SEQ ID NO: 69444 - DNA, 201 bp, Homo sapiens; identical to SEQ ID NO: 36193

SEQ ID NO: 69445 - DNA, 201 bp, Homo sapiens; identical to SEQ ID NO: 36328

SEQ ID NO: 69446 - DNA, 201 bp, Homo sapiens
ctgtctggaagatggtgagttccccactagtctaaggcttcaagctcagctagcagagattggaagaggcaatggcctgagtgttaggagacaggtattcyggttccaactcagccactgacttggtgtcaggacaagtcccctttcttattcacgcttcagtttctcatctgcaacatgaggacataggactctttaatt

SEQ ID NO: 69447 - DNA, 201 bp, Homo sapiens
tactgcagccacccttctcatctggatcgggccctgcagaggcagaaaacccttaaatgctgtcacagctcaagcaggagtgtcaggggccctcactctckgtgcctacttcctgtcaggcttctggtcctttctcggtacctctgtgcccctcccctggggtttgtggctgtcactctgcccgacactttggtggcctaa

SEQ ID NO: 69448 - DNA, 201 bp, Homo sapiens
ggaggtccagaactctgccatcagtgatctctgcctatgggaagagatcgtggcctgtgtcacggcatctgagcagcccggctctcaggcgagcttttgcygcatgcccagcaccctcaggtgctgtgggacaagacaagttcatttttcctccgccctgggctgggatgagcggccacctcctcctgcccacacacgtct

SEQ ID NO: 69449 - DNA, 201 bp, Homo sapiens
gcctggtatagggtgagtgtccggtcctgtggaatggcccagtgggcagctggacccactgtgttctcccaggcaaagccgggcttttcctgtctgcaaayatcttgtatcaaaccctggagctatttattccttaagatctcagatttttcttttccagtactaaactctttggtctatgctcgtgtagttactgttggt

SEQ ID NO: 69450 - DNA, 201 bp, Homo sapiens; identical to SEQ ID NO: 36664

SEQ ID NO: 69451 - DNA, 201 bp, Homo sapiens; identical to SEQ ID NO: 36991

SEQ ID NO: 69452 - DNA, 201 bp, Homo sapiens; identical to SEQ ID NO: 36992

SEQ ID NO: 69453 - DNA, 201 bp, Homo sapiens
ggccctgcagaggcagaaaacccttaaatgctgtcacagctcaagcaggagtgtcaggggccctcactctcggtgcctacttcctgtcaggcttctggtcytttctcggtacctctgtgcccctcccctggggtttgtggctgtcactctgcccgacactttggtggcctaaggcacacagcagcctcagagcctgtgctg

SEQ ID NO: 69454 - DNA, 201 bp, Homo sapiens; identical to SEQ ID NO: 36993

SEQ ID NO: 69455 - DNA, 201 bp, Homo sapiens; identical to SEQ ID NO: 36994

SEQ ID NO: 69456 - DNA, 201 bp, Homo sapiens; identical to SEQ ID NO: 36995

SEQ ID NO: 69457 - DNA, 201 bp, Homo sapiens; identical to SEQ ID NO: 36997

SEQ ID NO: 69458 - DNA, 201 bp, Homo sapiens; identical to SEQ ID NO: 36999

SEQ ID NO: 69459 - DNA, 201 bp, Homo sapiens; identical to SEQ ID NO: 37000

SEQ ID NO: 69460 - DNA, 201 bp, Homo sapiens; identical to SEQ ID NO: 37002

SEQ ID NO: 69461 - DNA, 201 bp, Homo sapiens
atcaaccaactaagctgtcagcattgccgcagggtaactgagacctccctgcattggctacgactgcagctctgggaggtgtgggcaggggagggccagcwggggagggccggctggggaggggacacaaagtgaagatgggggttgttgggcctgagctcctgcccagccttttccgccgggggttcctgggtggattca

SEQ ID NO: 69462 - DNA, 201 bp, Homo sapiens; identical to SEQ ID NO: 37004

SEQ ID NO: 69463 - DNA, 201 bp, Homo sapiens
agcagggtgactggcagtctccggccaggcatggggcaagggtggggactgccagtgtttgcttgtgtctaggagttatgaacaagctggccaccaaaatyggcgtcaccctgggtgcccaccagcgctgtcctgtgtcttgggtctgtgagtcaaagaaaaggtccctggcccagggagtgacaggcagtaattaggctg

SEQ ID NO: 69464 - DNA, 201 bp, Homo sapiens
ggctcactgcagcctcaacctgctgggctcaagcaatcctcccacctcagcccgagttgctgggatgacaggcacacgccaccatacccagctaatttttwtattttttatagaaaccaggtctcactatgttgcccaggccggtcttaaactttgcccaggccagtcttgaactcctgagctcaagcaatcctcctgcct

SEQ ID NO: 69465 - DNA, 201 bp, Homo sapiens
actgcaacctctacctcccaggttcaagtgattcccctgcctcagcctcctgagtagctgggactacaggcacacaccactatacctgactaattttttgktttttggtagagatgaggtttcaccatgttggccaggatggtctcgatctcctgaccttgtgatccactcacctcggccacccaaagtgctaggattata

SEQ ID NO: 69466 - DNA, 201 bp, Homo sapiens
ctgggctgtttactggagcataaagacgctcataggctgaaggacaggggaggactgggcacagtgtcactctagccattgggagccatggcaggcttctragctgggtcatggtacaagcagagttccagggatgggctttatgagaccaaatggtttcctgtcattcatttatttgacaaatgtgctcatcagggcatc

SEQ ID NO: 69467 - DNA, 201 bp, Homo sapiens
accatgctgacccatttggggctcagcactgagacagaggcaagaccagcagctccaacatgtagtgtaggctggcacagagcaaatgcccccgcagcctrctccccttgcccatggctcatgtcagtaatcaacctacgtacctttcccactgaaccaggacagggcctccaggcctcagcacagaactgcagacagcca

SEQ ID NO: 69468 - DNA, 201 bp, Homo sapiens
gcttctttgaatcactgtgctgagttcttggaggctgagaaacaggatttcttggagatgaactggccttgcctgtcactccaacctcctcatacacctcrgccccctgaccactagattccaaccacaccagcctccttgatgtttctcaaacatgcagagcctttgtatccactgttccctctgcctagaaggctgtcc

SEQ ID NO: 69469 - DNA, 201 bp, Homo sapiens
gaggaggcaggtccacagcaacgggaatgtcggtggcttctgatggagtcacatggggacatggtagccacacccagactggcagtgatacccagcccaargggctctgagtgccggacactgagccgctgtcctggggacaagaggcccttgggaagaaggggccggggcacccccgctctggggccccggaacacagcg

SEQ ID NO: 69470 - DNA, 201 bp, Homo sapiens
ttatgccaggcagtaggaatacagaggccaaagtgggcacgagatgggtgtgtttgaggcccggcaagggggcgccatggagcagcggtgagggcgggggwcccaggggccattctgagtcagagtaaaccagggccaggtgctggggttcttagcgtcatttattttatttactagcagtggaggacgacaggatctgat

SEQ ID NO: 69471 - DNA, 201 bp, Homo sapiens
tgtccctggtctctctgtgctcagggaggggagagccctgagctgggaggcaggacccaggttcttgtgctgcctgggcccaccattaactcctgcatgtsctgagccacggcccttcccttccctgggcctctgctttctcgtccattctacggtgatggcatcagaaaagcaaggtgcctcccagccctgaccctgtgg

SEQ ID NO: 69472 - DNA, 201 bp, Homo sapiens
cagcacatccaaggtgacatccatggctgtggattccaaatcccagcttcttcccacaccagctctgagcacttcatgaagactcggggcctccagcgccrtgggattaacaagcagatcgttgttagtggaagcccaggctgtgggtgggcgcagccagctgtcagaaaggccttctttattctgctgtgctaactgcac

SEQ ID NO: 69473 - DNA, 201 bp, Homo sapiens
gctagtgacaggccggggtctgggagccaaggaccacagctcagcccgaagtgggggagctgtggggctgagagcagggagtgggtacctgccccagccaycagcctccctccacagacagcatcattaattcttcatcctcccgacaaccctgataacagccacggtcttcatccccatctcccagatgaggacagtgag

SEQ ID NO: 69474 - DNA, 201 bp, Homo sapiens; identical to SEQ ID NO: 37013

SEQ ID NO: 69475 - DNA, 201 bp, Homo sapiens; identical to SEQ ID NO: 37014

SEQ ID NO: 69476 - DNA, 201 bp, Homo sapiens; identical to SEQ ID NO: 37015

SEQ ID NO: 69477 - DNA, 201 bp, Homo sapiens
tgttcctgcatcattcacaccagacacttaggccctcctctctgggatggaggcccaaactggccacttgtgtgatggtccgttgtaacccaagaggctgygaggcatttcctcctgaatctatagtctcaaaaactaaaattaagattgtgtgtgtgtgtgtgtgcgcatgcacgcgtgcacacgtgctgttgacagcca

SEQ ID NO: 69478 - DNA, 201 bp, Homo sapiens
aagacatacatggtcttgctttgtcgcccaggctggagtgcagtggcagtgtcatggctcactgcagcctcaacctgctgggctcaagcaatcctcccacytcagcccgagttgctgggatgacaggcacacgccaccatacccagctaatttttttattttttatagaaaccaggtctcactatgttgcccaggccggtc

SEQ ID NO: 69479 - DNA, 201 bp, Homo sapiens; identical to SEQ ID NO: 37016

SEQ ID NO: 69480 - DNA, 201 bp, Homo sapiens
aggagttatgaacaagctggccaccaaaatcggcgtcaccctgggtgcccaccagcgctgtcctgtgtcttgggtctgtgagtcaaagaaaaggtccctgkcccagggagtgacaggcagtaattaggctgagttgggtggggaggtttgtctcggcctccactgttcccggaaaccgctgttctccttggaacagccact

SEQ ID NO: 69481 - DNA, 201 bp, Homo sapiens
atcctgtgtctgggagaccccccataagacccttgaacacagctgcacagaagcaaatagtgaggaaagcctgcaggactgatggcctctcaggccccatrgcaggcagggctccccagggagtcacaggacagagctgcaagtggagccaggagggctgccctgggccccaggctgtccccatgggtcagccagtctgca

SEQ ID NO: 69482 - DNA, 201 bp, Homo sapiens
ctattatttcacaggaaaggaggctgtgaaaaggagagggcaggttttggagccaagtcgacctggcatcaggtcctggctgcctttttttttttttttttaaagacatacatggtcttgctttgtcgcccaggctggagtgcagtggcagtgtcatggctcactgcagcctcaacctgctgggctcaagcaatcctccca

SEQ ID NO: 69483 - DNA, 201 bp, Homo sapiens
caaggtgacatccatggctgtggattccaaatcccagcttcttcccacaccagctctgagcacttcatgaagactcggggcctccagcgccgtgggattarcaagcagatcgttgttagtggaagcccaggctgtgggtgggcgcagccagctgtcagaaaggccttctttattctgctgtgctaactgcactagtagaac

SEQ ID NO: 69484 - DNA, 201 bp, Homo sapiens
atatggtgagaaagggttttgttgttgttgttgtgttttttgttttttttaaaaccatgaaaatgaagactgaatcaaccaactaagctgtcagcattgcygcagggtaactgagacctccctgcattggctacgactgcagctctgggaggtgtgggcaggggagggccagctggggagggccggctggggaggggacac

SEQ ID NO: 69485 - DNA, 201 bp, Homo sapiens
cacccacctgtgccgcaccacaggcaggaagcttctagatggtgtggctctcaaccttttggctttttcccgcagtttctctcttggctgtctgtgttttytctggatcccctggcttttgatgccttggtgtctggggcaaccttaaaggacaaaagcaggcttctgatgggatcactggtgctgctcaccactgagtgc

SEQ ID NO: 69486 - DNA, 201 bp, Homo sapiens
accgtgcccatcctgcccagccccctggggtgggaggccctgcagagaggggtctggtccagccagccgggagggcagtgaggccacctgctccatgtctsgggggctttgtctgcacagagtcagtaacgtcgctaacttcccacagctctgcaggaactggtcctcatacagccacactactacacatagacccacacc

SEQ ID NO: 69487 - DNA, 201 bp, Homo sapiens
tcacaaacatatcattgaaatctcagtgttgggttttggggaaggcactgggcggctcccacccctgctttccggaaacacagatttctagagtttgaaasggacgggaggctaaagtgagactgccctaaatatagcgtcctgggtatttccggatatttccggacacctggggaaatgtgggctttattccgcaactac

SEQ ID NO: 69488 - DNA, 201 bp, Homo sapiens
ccttctcccttgccccccaggactgggtcatcgccccccaaggctactcagcctattactgtgagggggagtgctccttcccgctggactcctgcatgaaygccaccaaccacgccatcctgcagtccctggtcagtaccgtgcccatcctgcccagccccctggggtgggaggccctgcagagaggggtctggtccagcc

SEQ ID NO: 69489 - DNA, 201 bp, Homo sapiens
gcacatggatgggactcaccttctcccttgccccccaggactgggtcatcgccccccaaggctactcagcctattactgtgagggggagtgctccttcccrctggactcctgcatgaacgccaccaaccacgccatcctgcagtccctggtcagtaccgtgcccatcctgcccagccccctggggtgggaggccctgcaga

SEQ ID NO: 69490 - DNA, 201 bp, Homo sapiens
cagccttttccgccgggggttcctgggtggattcaagcctcttgggggagacggccctgcagggctggaggatgggtttgggccctgaggctcagggaggrgcacatggatgggactcaccttctcccttgccccccaggactgggtcatcgccccccaaggctactcagcctattactgtgagggggagtgctccttccc

SEQ ID NO: 69491 - DNA, 201 bp, Homo sapiens
cacacgagcccagaagttcaagacaagcctgagcaacacagcaaaaccctgtctctaaaataaaaattaaaacacacacacacacacacacacacacacamgtgcgcacacaatgccttggtgtgagaggaaagaaattaccaaaagctgctctgagcctatgataatacttcctttctgggcagtcaaatggtgtttgct

SEQ ID NO: 69492 - DNA, 201 bp, Homo sapiens
aggtgtgggcaggggagggccagctggggagggccggctggggaggggacacaaagtgaagatgggggttgttgggcctgagctcctgcccagccttttcygccgggggttcctgggtggattcaagcctcttgggggagacggccctgcagggctggaggatgggtttgggccctgaggctcagggaggagcacatggat

SEQ ID NO: 69493 - DNA, 201 bp, Homo sapiens
gggccccacgctcccaacagcctttcgtggtcactttcttcagggccagtccgagtcccatccgcacccctcgggcagtgaggccactgaggaggaggcarccgaagaaaagcaacgagctgccgcaggccaaccgactcccagggatctttggtgagggtcgggcaggctggggccgaggccctgtgggcttctggctga

SEQ ID NO: 69494 - DNA, 201 bp, Homo sapiens
tcctgtgtcttgggtctgtgagtcaaagaaaaggtccctggcccagggagtgacaggcagtaattaggctgagttgggtggggaggtttgtctcggcctcyactgttcccggaaaccgctgttctccttggaacagccactgggagttggagtgtttatttgatttctgacttgctaagcctgtaatttacctgctggaac

SEQ ID NO: 69495 - DNA, 201 bp, Homo sapiens
caacctgagttttgtcagggataaaacacatccaaactgtagcaaggggtatattatctgtactgttcaccttgcttttttctttttctttttttgagacrgagtctcaccctggagtgccatggcacaatgacagctcactgcagtctccacctcccaggctcaagccatcctcctacctcagcctcctgaatagactat

SEQ ID NO: 69496 - DNA, 201 bp, Homo sapiens
gcctggtggggctgttgctgtgaattgggcagggcccacccctctgtgtgaccttagggaagttcctcaccttctcagccttggttgctccttataaaagraggtgcctggtgatctgtcctcagggttgttgtgtgattggtagaggggcaggagtagaaagcctgtgctgctcccctcagagggtgaacctggacctgg

SEQ ID NO: 69497 - DNA, 201 bp, Homo sapiens; identical to SEQ ID NO: 7733

SEQ ID NO: 69498 - DNA, 201 bp, Homo sapiens
tatcaaaccctggagctatttattccttaagatctcagatttttcttttccagtactaaactctttggtctatgctcgtgtagttactgttggtcaggtcmcccgtctgctttgcctcctgtctgtggctagtgacaggccggggtctgggagccaaggaccacagctcagcccgaagtgggggagctgtggggctgagag

SEQ ID NO: 69499 - DNA, 201 bp, Homo sapiens; identical to SEQ ID NO: 36077

SEQ ID NO: 69500 - DNA, 201 bp, Homo sapiens
ctgtgctctactatgacagcagcaacaacgtcatcctgcgcaagcaccgcaacatggtggtcaaggcctgcggctgccactgagtcagcccgcccagcccwactgcagccacccttctcatctggatcgggccctgcagaggcagaaaacccttaaatgctgtcacagctcaagcaggagtgtcaggggccctcactctcg

SEQ ID NO: 69501 - DNA, 201 bp, Homo sapiens
tggatgaggtgtggccctgcaccctcgcctgctcgtggaaggagtctgggccagcagtgacccacgcgctagggtctctgctgaggaagtggcaggtgtgyggccctgccctggccccgtagtgagtgtggggcccacctgtgccctcatgggcagctgaagggggagctttctaccccaggttcctttccttactgaaaa

SEQ ID NO: 69502 - DNA, 201 bp, Homo sapiens
atgcttttcatcaaaaacctaaacgtgatcatctcttggatgaggtgtggccctgcaccctcgcctgctcgtggaaggagtctgggccagcagtgacccaygcgctagggtctctgctgaggaagtggcaggtgtgtggccctgccctggccccgtagtgagtgtggggcccacctgtgccctcatgggcagctgaagggg

SEQ ID NO: 69503 - DNA, 201 bp, Homo sapiens
ttggaaaatgctgccagtccgcaggaaaaagttgttactgctgctgtctgtgaccaagaggacactttatttcttgaaacaactgggggcaaactggctcycagataaggcttcagtccctactcatgtgaggaaaccagccctggtaggttccatgcacaagaatacaggacaaggagcagcttttttcacctcatgcaa

SEQ ID NO: 69504 - DNA, 201 bp, Homo sapiens
gtgtttcatggaacctggaggttccttagagacccctcagaagcagacctagtggtcagagtaaaagctgaggagtaagctgtgcctctccctccccaggmcccatcccaaccacagaagttccacttgcatcagttttatataccagactattgcatgaaattacattttgacagatgattattcttaaaaaatatataa

SEQ ID NO: 69505 - DNA, 201 bp, Homo sapiens
cactttcttcctactgcagaaagtaggaagatagagaaagcagaaagtaattcaagatactttatactgggtactcaatctaaactacctgggtgagactrtgtgtttcaatttctcagtactcccgtggaactgggttaataaatatttgctgagtagaatttactgcatgcaggctgagctgtcttaatgacccagctg

SEQ ID NO: 69506 - DNA, 201 bp, Homo sapiens
tgaacatagatcagatgaaggggctgggggaagatagcagacatgaggttacaggtatggggactacaaggtgtaagctatgccagggagtttgaacttgrccctgtaggaaataaggaggcaacgtacttagttaaaattattatcattgttatgttaaaatatgcataacataaaatttaccatttcacccatttaaaa

SEQ ID NO: 69507 - DNA, 201 bp, Homo sapiens
agctggttcaagcttccacagcgctaaggtggcagtgacactgcggactgtaagctttggaacaaggctcagtggggagctgggagaacccaggacccctytctggaaaacccattgccagctagtctcacacttggaattgtgatcccttctgtgaccaccttgataacagccactcgccctgttccagccccagtctct

SEQ ID NO: 69508 - DNA, 201 bp, Homo sapiens
acctaagtgcaagatgactggggaagggtaatccttccatttgcctaaaggtagataagaacccaatgtgagtaagcagtaaaaatctagcatataaatcraccttagaacaagtccagtaatactctaaggaagcttgtaatgcactgggtaaggagtagtaaataataaagaaattcagaggccaggtgtggtggctta

SEQ ID NO: 69509 - DNA, 201 bp, Homo sapiens
aacagtcattgttattattgactcacccttccttaaaattatattttcccttgtctttatagatacagctatagcctatctttcattctgcctttcagatkaatttatctttctgtgttttgggtccaatttcagctacgaggtaaaacggcttaaacacatacacatttatcctgtggttacctaatacttgtaagggtt

SEQ ID NO: 69510 - DNA, 201 bp, Homo sapiens
agagtattgctaaggtagagaatggagaatgttgactctcacagccctctgacaaattagaatcctagaataagacaactttaaatgtgtagactcggacygtggctattcaatggacaattttagatttgcataggactatgccttgattccttagagtatcattgtgagatggttgtatattctgactagaaataacac

SEQ ID NO: 69511 - DNA, 201 bp, Homo sapiens
ttccttaaaattatattttcccttgtctttatagatacagctatagcctatctttcattctgcctttcagattaatttatctttctgtgttttgggtccartttcagctacgaggtaaaacggcttaaacacatacacatttatcctgtggttacctaatacttgtaagggtttctggttagataggatggtgaagaggga

SEQ ID NO: 69512 - DNA, 201 bp, Homo sapiens
caatggaaaataaaagtcttttaatcatccaatgggaatttaatggacaccttctgtatgcactacatggattcgccacagaggacaagccacagatgagraggacctgccctctctcttcagagactatgatctagatcagagttggcagatcagttgccttcattagtttaagaactattttgtatgcacctctatatt

SEQ ID NO: 69513 - DNA, 201 bp, Homo sapiens
ctctcttcagagactatgatctagatcagagttggcagatcagttgccttcattagtttaagaactattttgtatgcacctctatattccaggcactactstaaattccaaaaatacaacagcacaaaaagacagactggcattttattatcatcgaggaagtgggtggagggtgcaggcaattttaataaggtagactag

SEQ ID NO: 69514 - DNA, 201 bp, Homo sapiens
tgttcactgtactctgaaatagactgtgcaaaacattaaaactgaccaaatcaataaggtcttgttttcaacatctctatgtttatctatgaataggaaarggactgacgtgaggtgggaccattggtgattttgttctgaaataagtgaaagtttaatggaaagatacatatggcacaaaaggaagataaaatttttttt

SEQ ID NO: 69515 - DNA, 201 bp, Homo sapiens
ggaaatgggggctggggatctggcccaatcttacacccagcccacagcacaagcatagtgagtggtcccaacaggggactctgaatgacactgacaaagaygagaaagcaggaggcaaggcaccctatggtgtccttcagagaaggtccttctggcccctcgtctgccagccagctgatgccccaaagtctaccatctgag

SEQ ID NO: 69516 - DNA, 201 bp, Homo sapiens
gcagagatagcaccactgcactccagcctgggcaacagtgcaagactctgactcaaaaaaaaaaagagaaaaaaagaaattcagagtggtgataccaacaygtgtagctcaaaaagtctctatagagaggaagggtactcgggccagatcttgatggatgagcagcgtcctgttactcaatcctcaccatctgatgcccaa

SEQ ID NO: 69517 - DNA, 201 bp, Homo sapiens
atcttacacccagcccacagcacaagcatagtgagtggtcccaacaggggactctgaatgacactgacaaagacgagaaagcaggaggcaaggcaccctayggtgtccttcagagaaggtccttctggcccctcgtctgccagccagctgatgccccaaagtctaccatctgagcatttaaagtctgatcagtccctttgc

SEQ ID NO: 69518 - DNA, 201 bp, Homo sapiens
gtcacaccacaaacaatgataaaaacggagacacctgggtgagcctcactcactgcgcatgcctccatcttcgaagagctcctgttcactgtactctgaartagactgtgcaaaacattaaaactgaccaaatcaataaggtcttgttttcaacatctctatgtttatctatgaataggaaagggactgacgtgaggtggg

SEQ ID NO: 69519 - DNA, 201 bp, Homo sapiens
ggaaaacttcctccattctcacctagtgttgtgggtcaggggacatccagcatgggggagtcatgtctccacagacaaaccaaccaacaacaacatttccrttgcttcgcccaatggagaagccgcccctcatccagtgaacagtgcctgctccccaaatcattgcattcaacaggtgcctcctgctttctccaggatgca

SEQ ID NO: 69520 - DNA, 201 bp, Homo sapiens
tatattctgactagaaataacaccattttctctttgcagcacctgagagtttattcagtgacgataatactcacaagaccctttttggatttgtggcccamcccacaagttatagttccttctctgaatatttcatccagattgtgaagagcagcttctggcagccacagttgtactatgtgacccctacttcccatgccc

SEQ ID NO: 69521 - DNA, 201 bp, Homo sapiens
ccaggctgcggcgggcactcaccgatctgcgccaggctcagcggcacgaggcagagtccccaggctgcgtgccaccaaaacttgtccatggtgtccggagygaacggagggcgcgggcgaaaggagctggaggatccctgggcgcggggcaggggccggcggaggacgggacgaggatggcggaccgaacctggcagaggc

SEQ ID NO: 69522 - DNA, 201 bp, Homo sapiens
aaatctttcctggctttaagagatatggggatagaaaagtttaatccctttttgattcttgatgtagcaaaaatgctaaattaatggagtcctaattcatyagtctttactaaattttattctgaatcatggaaatcagtttcttttaagaaggaagatttcctttggaagcttttgttggagtggaggaggtgaaaagag

SEQ ID NO: 69523 - DNA, 201 bp, Homo sapiens
gaagagtgtttgggactgaaaaatccttgtctggatctagtcctcagccactcagaagctggcatgccatgactcaaagagccgcccgtctggaatgaagrcagtgacccgtaactcccacctgaagagcaggtgcttggaaaatgctgccagtccgcaggaaaaagttgttactgctgctgtctgtgaccaagaggacac

SEQ ID NO: 69524 - DNA, 201 bp, Homo sapiens
agaaaaaaagaaattcagagtggtgataccaacatgtgtagctcaaaaagtctctatagagaggaagggtactcgggccagatcttgatggatgagcagcrtcctgttactcaatcctcaccatctgatgcccaataaacgccccactttccctggctcaatcccatccactattctgcaagtcactttaactgactcttt

SEQ ID NO: 69525 - DNA, 201 bp, Homo sapiens
tgtgaactactaaaagtaaatctgcatggacttcttgcctggtgagttacacagaaaatgaaagtgattatcagtggctgtggcaagatgaaaggaaccaygccaggacttctgagggaaggtaagattttgttatttatttcaagaaattgaaaagttgagagaaatgcacccagccatccccctatgcattcattcatc

SEQ ID NO: 69526 - DNA, 201 bp, Homo sapiens
cagaggatgaccgaaccgtaaaaccttgcaccattgggttcagcctttggcctctcctttcccgctaaatttctctgaatccggctggagcaagatctctkggtttcacaggatgttggatatcctgggagaggagctggagagagggcgaggtcttgccctgggtggcgcagtgcctccgtgcccacagtggggagtgag

SEQ ID NO: 69527 - DNA, 201 bp, Homo sapiens
ttttattctgtttacattagcataagctggtttccgttgcaaccaaaaagacttgatgaatataggagagcatcacaccattttacaaaagagtaaacagyggctcaagtggatggcggatgcccctaccactgggtcttgaattcaggactttgactctaaatcttaggtcttctgattctgaggtctgtgctcttttca

SEQ ID NO: 69528 - DNA, 201 bp, Homo sapiens
aattttcttttttttttcttttttttctttttttttttgagacggagtctgagtctggctctgtcgcccaggctggagtgcagtggtacaatctcggctcwctgcaagctccgcctcccaggttcatgccattctcctgcctcagcctcctgagtagctgggactacaggcacctgacactacgccgggctaattttttgt

SEQ ID NO: 69529 - DNA, 201 bp, Homo sapiens
aatatcatactttgaatgataactctatatctatctataatatactatggtttaatgtttggaaatcaaacgcagtatttatttgtcatgtgaactactamaagtaaatctgcatggacttcttgcctggtgagttacacagaaaatgaaagtgattatcagtggctgtggcaagatgaaaggaaccatgccaggacttct

SEQ ID NO: 69530 - DNA, 201 bp, Homo sapiens
aatttttgacgatgaaatttgaattaatggtatgtggctttatgtagcaagctaactggaaggaacacaagcaaaacagtctatattttatgcactattayttaagggaatgtaattatatttatttttaattatatttattttatgttcatgtagtaactaaaattcatatttattcctcttctctccacttcatacaaa

SEQ ID NO: 69531 - DNA, 201 bp, Homo sapiens
tggagaccatcctggctaacacggtgaaaccccgtctctactaaaaatacaaaaaaaattagctgggcatggtggtgggtgcctgtagtcccagctactcrggaggctgaggtaggagaatggtgtaaacccaggaggcggagcttgcagtgagcagagatagcaccactgcactccagcctgggcaacagtgcaagactc

SEQ ID NO: 69532 - DNA, 201 bp, Homo sapiens
gtcccagtccagatggagctataccaatggtggttgctggtactctccaagtcattgcttgcccttgttcatggatggaaaacttcctccattctcacctmgtgttgtgggtcaggggacatccagcatgggggagtcatgtctccacagacaaaccaaccaacaacaacatttccgttgcttcgcccaatggagaagccg

SEQ ID NO: 69533 - DNA, 201 bp, Homo sapiens
catttctccactttttgctttcccatacaaagactggactcctcctcaaagccttgctcctttccaaagtttcctcgtggttgtccagagtccaccactcyccagaatggggcaacaagagctcctttccttcccctttcctccttctccccttcgccacccacaccatgcccagccccaagccctctgacaaagtcatgt

SEQ ID NO: 69534 - DNA, 201 bp, Homo sapiens
tcctcttgcattttcaggaagagtgtttgggactgaaaaatccttgtctggatctagtcctcagccactcagaagctggcatgccatgactcaaagagccrcccgtctggaatgaagacagtgacccgtaactcccacctgaagagcaggtgcttggaaaatgctgccagtccgcaggaaaaagttgttactgctgctgtc

SEQ ID NO: 69535 - DNA, 201 bp, Homo sapiens
tgaggtaggagaatggtgtaaacccaggaggcggagcttgcagtgagcagagatagcaccactgcactccagcctgggcaacagtgcaagactctgactcaaaaaaaaaaagagaaaaaaagaaattcagagtggtgataccaacatgtgtagctcaaaaagtctctatagagaggaagggtactcgggccagatcttgat

SEQ ID NO: 69536 - DNA, 201 bp, Homo sapiens
tggttacctaatacttgtaagggtttctggttagataggatggtgaagagggataaacaattcaggctgatagagactctccaattttcttttttttttcttttttttctttttttttttgagacggagtctgagtctggctctgtcgcccaggctggagtgcagtggtacaatctcggctcactgcaagctccgcctccc

SEQ ID NO: 69537 - DNA, 201 bp, Homo sapiens
catcctctccttattttcccttcattcctatctcttgccctagttcccctcccaccagtcaaatatatgactgttttggggagttttttggtttaatttcwctctttcttccccaccttggtcttgctgctgcctgccacctcctcagactgggtttgtccctttttcttcccccacccacagagtgtcagctcctagtgg

SEQ ID NO: 69538 - DNA, 201 bp, Homo sapiens
ctcctcttgcattttcaggaagagtgtttgggactgaaaaatccttgtctggatctagtcctcagccactcagaagctggcatgccatgactcaaagagcygcccgtctggaatgaagacagtgacccgtaactcccacctgaagagcaggtgcttggaaaatgctgccagtccgcaggaaaaagttgttactgctgctgt

SEQ ID NO: 69539 - DNA, 201 bp, Homo sapiens
cctaatacttgtaagggtttctggttagataggatggtgaagagggataaacaattcaggctgatagagactctccaattttcttttttttttcttttttytctttttttttttgagacggagtctgagtctggctctgtcgcccaggctggagtgcagtggtacaatctcggctcactgcaagctccgcctcccaggttc

SEQ ID NO: 69540 - DNA, 201 bp, Homo sapiens
cctagttcccctcccaccagtcaaatatatgactgttttggggagttttttggtttaatttcactctttcttccccaccttggtcttgctgctgcctgccwcctcctcagactgggtttgtccctttttcttcccccacccacagagtgtcagctcctagtggcctgattcagaccttttatattaggttggtgcaaaagt

SEQ ID NO: 69541 - DNA, 201 bp, Homo sapiens
taatacttgtaagggtttctggttagataggatggtgaagagggataaacaattcaggctgatagagactctccaattttcttttttttttcttttttttytttttttttttgagacggagtctgagtctggctctgtcgcccaggctggagtgcagtggtacaatctcggctcactgcaagctccgcctcccaggttcat

SEQ ID NO: 69542 - DNA, 201 bp, Homo sapiens
agataggatggtgaagagggataaacaattcaggctgatagagactctccaattttcttttttttttcttttttttctttttttttttgagacggagtctragtctggctctgtcgcccaggctggagtgcagtggtacaatctcggctcactgcaagctccgcctcccaggttcatgccattctcctgcctcagcctcct

SEQ ID NO: 69543 - DNA, 201 bp, Homo sapiens
tggacaattttagatttgcataggactatgccttgattccttagagtatcattgtgagatggttgtatattctgactagaaataacaccattttctctttrcagcacctgagagtttattcagtgacgataatactcacaagaccctttttggatttgtggcccaacccacaagttatagttccttctctgaatatttcat

SEQ ID NO: 69544 - DNA, 201 bp, Homo sapiens
ctttctactagtggctttgtacatgtattataaaaatatgtatattacttttgaattgagcaatattattttaaaaacattaagattcagtaaacatcacmcacacacacacacacacacacacacacatgttgagtggctctgagatcacctctatggaaacacccttgtcctgaggacagttttcaacacatgctaggt

SEQ ID NO: 69545 - DNA, 201 bp, Homo sapiens
tggctttagccccagttatgcctaagtctgactttctcagaagtaaccaatgtcctctgtcccagtccagatggagctataccaatggtggttgctggtaytctccaagtcattgcttgcccttgttcatggatggaaaacttcctccattctcacctagtgttgtgggtcaggggacatccagcatgggggagtcatgtc

SEQ ID NO: 69546 - DNA, 201 bp, Homo sapiens
caatgtcacttaactacatttggccatttctccactttttgctttcccatacaaagactggactcctcctcaaagccttgctcctttccaaagtttcctcrtggttgtccagagtccaccactccccagaatggggcaacaagagctcctttccttcccctttcctccttctccccttcgccacccacaccatgcccagcc

SEQ ID NO: 69547 - DNA, 201 bp, Homo sapiens
taaggcctagagtccaccaaaatccttccctccctgaaatccttccaagttcgtccatcttatacagtctaacatattctaagcctaggctttggagctcrgtggagctgggtttccatccagcactgctcctggctatgtgaatgccagcaagtcacttaacgtctctaagcatcagttttcctcctgtcaaacaggcct

SEQ ID NO: 69548 - DNA, 201 bp, Homo sapiens
atggagagagaagccacccatgcaagagttcacttatgctggccacaggggacaggtagtgtgggagagccacgtatagcttccaaagtcctccagacacrtaatgaattgaaggagcataagcattggagtctaacatgggaggatgttagataatgcggaaatcccaactccaccactggatcctggggcaagtcatgc

SEQ ID NO: 69549 - DNA, 201 bp, Homo sapiens
tgggatgtgggaaactggaaaggaaacttgaattgatttgagttgacacgagattacactatttgggaagaatccagaattcaatcagcagccttggaccragaaagtccaggtctgagcattggctttcccccttatcagaggatgacttaacctctgggagtttcggtaatcccagccacaaaacaagggtaatcagac

SEQ ID NO: 69550 - DNA, 201 bp, Homo sapiens
ggctgcagtttttattcgaggttgaaaacagtgacctaagacggagggagggagcgagcgaaggacacacccaagcaaggggggctgtgactaagcagccmgcagaggttttaagaagtagcagccctcccgggcgggcccctctgcccccgccccgtgctctgctgaggctgtaaataatcggggctgccagggacgtgg

SEQ ID NO: 69551 - DNA, 201 bp, Homo sapiens
cagtgacatcctatttggggtgactggttcagggagacttgagtgcaaacagagcattactcactctggcagactagggttctttgctgaaatattggggmctgatggcttctgactggtagtaataaatcctgttcctctcgagcaaagaaaagccaaatctaaaccaaatgtgagcaggagtgtgaaatggaaagctgg

SEQ ID NO: 69552 - DNA, 201 bp, Homo sapiens
cccattctacccaaagaatacagttctctctccttcgttgtgatagaaactagacatctctgatactttgcctacagttgtatgtcaatccaaatgagtgrcaggtcttccgagtcccatcctcccagatcttctccagagagcccctgtctgcctgaacatgcctcacagtctattttcaaagggcaaaacctttcatct

SEQ ID NO: 69553 - DNA, 201 bp, Homo sapiens
tgtatgtcaatccaaatgagtggcaggtcttccgagtcccatcctcccagatcttctccagagagcccctgtctgcctgaacatgcctcacagtctatttkcaaagggcaaaacctttcatctggcagatggtaacagctgcttctctttaaaacacccaaagggtagaaattctgggctctaacgtacaggcataaggct

SEQ ID NO: 69554 - DNA, 201 bp, Homo sapiens
cctgccaagtcctgactgggcttagcatcaaatcctgtagaaaaggaataggtacagaacatggatgtgaggccaggccaaaacgcattttattgctggcyactgtttcccagccacagaagaatgctgctgtagaaggcatggcgtgggtgagaaagagacttgttgaactgaactttaatgggagaggatgtggggagg

SEQ ID NO: 69555 - DNA, 201 bp, Homo sapiens
gactatgatctagatcagagttggcagatcagttgccttcattagtttaagaactattttgtatgcacctctatattccaggcactactctaaattccaaraatacaacagcacaaaaagacagactggcattttattatcatcgaggaagtgggtggagggtgcaggcaattttaataaggtagactaggaaggtctggg

SEQ ID NO: 69556 - DNA, 201 bp, Homo sapiens
aaggaagcttgtaatgcactgggtaaggagtagtaaataataaagaaattcagaggccaggtgtggtggcttatgcctgtaatctcagcactttggcaggytgaggcaggcagatcatgaggtcaggagatggagaccatcctggctaacacggtgaaaccccgtctctactaaaaatacaaaaaaaattagctgggcatg

SEQ ID NO: 69557 - DNA, 201 bp, Homo sapiens
ggaatacctgaattagttgatgctagccccaacagagatgaagctttgcctctttgctccttcacatgggaaaacacagctaaagttctaactcccagcarggggcggagtctctaatgctcaattagagagaagggagcagaaaggtgtgtgccagccctaagacccagggctctcagacgctctcctctttctcaacac

SEQ ID NO: 69558 - DNA, 201 bp, Homo sapiens
tttccaaagtttcctcgtggttgtccagagtccaccactccccagaatggggcaacaagagctcctttccttcccctttcctccttctccccttcgccacycacaccatgcccagccccaagccctctgacaaagtcatgtctcctttccaagtcccagttcctgccaaacaactttacaagcacatgaaagcgagggccg

SEQ ID NO: 69559 - DNA, 201 bp, Homo sapiens
atttgcataggactatgccttgattccttagagtatcattgtgagatggttgtatattctgactagaaataacaccattttctctttgcagcacctgagartttattcagtgacgataatactcacaagaccctttttggatttgtggcccaacccacaagttatagttccttctctgaatatttcatccagattgtgaag

SEQ ID NO: 69560 - DNA, 201 bp, Homo sapiens
ctgtttggatgagatattggagccctagctccagggtccctgatgttgccctggtatcaaggctcttctctctgctctgaggctgccaggcagggaatatragccaccttactgttgagatttccccacactgattggcagaagcaggaggtggtgaggaccaagcagctggtccagtggttgcctctcatattcatgctc

SEQ ID NO: 69561 - DNA, 201 bp, Homo sapiens
acgtcttgagagagcttatgaaggtgaaagaaggcaaaagacacagatgtgactccatgatgaagcaatggaaaataaaagtcttttaatcatccaatggraatttaatggacaccttctgtatgcactacatggattcgccacagaggacaagccacagatgaggaggacctgccctctctcttcagagactatgatcta

SEQ ID NO: 69562 - DNA, 201 bp, Homo sapiens
ggaattgtgatcccttctgtgaccaccttgataacagccactcgccctgttccagccccagtctctgccccgcccagctctgccctgcctagacacagccyggtggggcttggcgagcccttgggcacaggagcctgttagtccagacaacgactgtgcgcatccgggagaacggttactttctgccatgtgctgcagctc

SEQ ID NO: 69563 - DNA, 201 bp, Homo sapiens
cccaaaactgcgcgccggcagcctgcccaacaaactttcttctctttctctttttctttcaaccaaatggtgcttccacagacacattctccaacggtttrgcgcaaatcccagccctgctttccggagcccaatgcacttcgcagacagctcacttgactccagtcccccagggccgactcagccggaggggctgccgcc

SEQ ID NO: 69564 - DNA, 201 bp, Homo sapiens
gggagcagaaaggtgtgtgccagccctaagacccagggctctcagacgctctcctctttctcaacaccaggcatgcaattcccaagcaaagatcccctcayccagtctatcattgttggacatttgggttggttccaagtctttgctattgtgaataatgccacaataaacatacatgtgcatgtgtctttatagcagcat

SEQ ID NO: 69565 - DNA, 201 bp, Homo sapiens
ctgcgggtctctgggagaacctcaagggttaggacagtgccaaatatttggaagtggggccttttagaaggaacggggagacaggttggaaggagtcaggrgtcagaatgcccaaagacaaagcagaagatggcactggtaggtaacatacaaataaacttccctagagactatagggaaaccaccagggccctcttcttt

SEQ ID NO: 69566 - DNA, 201 bp, Homo sapiens
atttttgtattttttgtaaagatggggtttcaccatgttggccaaggctggtctcaaactcctgaccttgggtaatttgctgcctcagcctcccaaagtcmtaggattacaggcatgggccaccatgacaggctgtgttgttgctatcattattattattatttcagcttcagtagtataaatcctagatccccaaatccc

SEQ ID NO: 69567 - DNA, 201 bp, Homo sapiens
cgcggcctccgctagggccaagacccgcacacctgccgggccggggagaagccgggggccgcgcgcaggcgaggacccgccgcccggcccggggaagatcycaggacgcggaccgggcagctcgggtccgaggtgagcccgggcggaggacgcgcccaccggaggtgcggcctcggagctccagacccagcccactcgggg

SEQ ID NO: 69568 - DNA, 201 bp, Homo sapiens
tggacacccccatctcccaccccatcttttgctacagccagggttagctcagcaggtgaaaaccccgagggtgggtgaaacccctctggggctcagacatrcaaaccttgggcatctctctgtcccagctggccccgccagccggtaggaagtttcccctgagttctcagttttttcttctgaaaaatgaggggttgtatg

SEQ ID NO: 69569 - DNA, 201 bp, Homo sapiens
atggatgagttttggtgacacaggcttagtggtagtggaggggggcaggcagaagagataaggggtggctgccctggagccttgatggggtgagagacccyggggtccagggcaaaggggtcactcctcggccgggctgctctatctccagatcccctcacccggcacatggccaggcacctggggcagtgtcagctgaat

SEQ ID NO: 69570 - DNA, 201 bp, Homo sapiens
ccctcctgggcctcagaggcagggggtgagggcttccttggcacttcagcacccctcgctcccgaaaccacgtagcccactttctcccagggagctctaarggaagcccgggctggcaccctggcctccaccctcagcttctgcactgccttcaggaggtggagcctcctggcctggcttctggatgctgcaggggtaggg

SEQ ID NO: 69571 - DNA, 201 bp, Homo sapiens
tgtggggaggctaggggccagggctgtggctggttgaggtgtgtgacctcagcaaagccacccaggtgggtctgtttccctcctgagtacctgaagtgtgrtgtactgttttaagaacaatggccaccatttgttggcctttctcaggaaatccacaagcgcctcaagtgggtgtgtctttacagaggaggaaatttgggt

SEQ ID NO: 69572 - DNA, 201 bp, Homo sapiens
cccatctatgcccagggtagctctccctgagccatctcgcctgccacctcatgacatcccttcccacaccaccctgccttgctcacccctgaaaagcaacstctgttgtcccgtactctgaccctgagccaggcaggaaacctggctgaacagcaggagcaggatgagaggagagagaggcaaaaggcctgcttttcccaa

SEQ ID NO: 69573 - DNA, 201 bp, Homo sapiens
tggccttcacccccatctgctccctagacctcagtccatctggcaaacacttcaccatcgccctctccatgaagccttccggcccaccttccaggatgacrtgagctggtgcccttgctgcgaggctgtcttcccccatcagcacaagtgtgagattccctcagggcagacccacatgctacttgggcctggtacaagtgt

SEQ ID NO: 69574 - DNA, 201 bp, Homo sapiens
gggcatctagtgacagcagctttaaggggctctgcccaggggtgcactggcctgagtggcccagaagcctcggcaggtgacagctaagaagacaaggctcytccccaccactctcagcgggaagatgctgagggggagagagagaaatcgagagagaggtggaggggtgggctgagcctggtggtcaggaggcggcaatgg

SEQ ID NO: 69575 - DNA, 201 bp, Homo sapiens
tggacacttccccctcctgggcctcagaggcagggggtgagggcttccttggcacttcagcacccctcgctcccgaaaccacgtagcccactttctcccarggagctctaagggaagcccgggctggcaccctggcctccaccctcagcttctgcactgccttcaggaggtggagcctcctggcctggcttctggatgctg

SEQ ID NO: 69576 - DNA, 201 bp, Homo sapiens
actctgcctcccgggttcacgccattctcctgcctcagcctcctgagtagctgggactacaggcgcccgccaccacgcctggctaatttttttgtattttyagtagagacagggtttcaccatattagccaggatggtctcgatctcctgacctcatgatccgtccacctcggcctcccaaagtgctgggattacaggcgt

SEQ ID NO: 69577 - DNA, 201 bp, Homo sapiens
ggtgtatttttctacataattgtaatcattctatacatacaaattcatgtcttgaccatcatattaatatttggtaagtttctctctctttagagactccmcaataaagttttcaacatggtaaggttttccacctgggcatttggatactttggtttttgctgttgtggccaagacggcacaggccacatgcgcctgtgc

SEQ ID NO: 69578 - DNA, 201 bp, Homo sapiens
gctctctcagggtccacctggggttccagctgctccaagacacagcacatttagccataaacatggaagggctgggacctacaggaggctcctttgtgtaraggccagggcaggcgtgtgaccttgaaccaggtggacatgaggtcccttgaactcccttctctctctggcttgttcccctgaagcactggccccccagtg

SEQ ID NO: 69579 - DNA, 201 bp, Homo sapiens
caggggtgcactggcctgagtggcccagaagcctcggcaggtgacagctaagaagacaaggctcttccccaccactctcagcgggaagatgctgagggggrgagagagaaatcgagagagaggtggaggggtgggctgagcctggtggtcaggaggcggcaatggcagtgccaccacccagcttaacaatcatctgctggc

SEQ ID NO: 69580 - DNA, 201 bp, Homo sapiens
tatcacgcaggctggagtgcaacgatgggtccccagctaattgcagcctgggctcaagcaatctttctgcttcagcctcctgagtaggtgggactacaggkgctccaccttgcccagctaattttttttttttttttttttttgagacagagtctcgctctgtcgcctaggctggagtgcagtgacgcaatttcggctcac

SEQ ID NO: 69581 - DNA, 201 bp, Homo sapiens
gcgggtcccggtacctaaggaccaatagcaagaccgaggtcaccgtgtgaagcggggccgcggtgccctcgaggcatgggctggggtcctgtctgcccgtyggagcctcaggccacagggagaggagcgcctgccgtaaggccagctcttctgtctgcctcaacggcagtggtgtcttggagcctgcaggccgcgggttcg

SEQ ID NO: 69582 - DNA, 201 bp, Homo sapiens
tcagccaggtgccacccctccccaccctgcattgggcttcatttgacggaggactgcccctccagaggagtcttctaggggagggagggaaggctgtgacygagtacggagcctctaccccctctgcctgcagccccagagcccctggacaaggtcatcattctgtctccgggaatctctgatgccacagctcctgcctgg

SEQ ID NO: 69583 - DNA, 201 bp, Homo sapiens
atgctccctcctccctcccagcatcccctgtggcagtggccatgcctgcccccagagcagctcaggctcccctttcatctctccaagccttagcccctgcmgccctccgcctggagtgtttgcctccccctcgctgctgctcagggtctccctctgcccccaggctccctccccagcccctgagtttctcctctcactgtg

SEQ ID NO: 69584 - DNA, 201 bp, Homo sapiens
gctggagaatcacttgaaccggggaggtggaggttgcagtgagccaagattgcgccattgcactccagcctggacaacagagcgagactctgcttcaaaarataaaaaaattaaaaaaaaggattcctggaggaggccgctgatggggtctgaagaatgagtagcagttttttgggagaagaggcaggaaagcagagaaag

SEQ ID NO: 69585 - DNA, 201 bp, Homo sapiens
aggcaggaaacctggctgaacagcaggagcaggatgagaggagagagaggcaaaaggcctgcttttcccaactggtgacaagaaagccctggacgcacctygtggggctggtagacaagtgccctgggtgaagccccaaggccctggaggctgcctgcagtttgacaaaaggacaggtgtgacagggacagaggggtgagg

SEQ ID NO: 69586 - DNA, 201 bp, Homo sapiens
agatgtgtgtcacaaccgagaatctaccatgaagttggtgcagttccttggcgttacctggactcattcactgaacgctcacatccatcctgggaggtggrgtctgctgccccacccaatccacggaaaagaagtgaacttgtccagcctctcacggccagcccgtggtggggctgagatgggcccacatgacctggctcg

SEQ ID NO: 69587 - DNA, 201 bp, Homo sapiens
cgcgcgcggcgcacagtgaccaggtgagcacgcgccgcccagggacccccgcctgctcctcggactgctctccctgcccgctgatccttcccgccgctctmgaagcgctggttctcccagcaggccccttctctgggttttcctgtctccttctccccccgccgcccccccaacacttcatcagggagacacctgacaccg

SEQ ID NO: 69588 - DNA, 201 bp, Homo sapiens
ttctttcattctcagagaggcgagaggtgtgctgggcaccaatgccagatgtgggagctgggctggcccctcttctcctctcttcctagggcgcagggccyggcccagcctgtgagctggggaggggtggactcaccgtgcttggtgctctgcgtggtgcgccgccgcaggctgtgttccagcagctggtgggtgcgggtg

SEQ ID NO: 69589 - DNA, 201 bp, Homo sapiens
gagacgagtcttgctctgtcgccaggctggagtacagtggcgcgatctcgcctcactgtaacctccgactccttggttcaagtgattctcctgcctcagcytcccgaatagctgggattacaggcacgcaccaccacagccagctaatttttgtatttttagtagagacgggatttcaccatgttggccaggatggtctcg

SEQ ID NO: 69590 - DNA, 201 bp, Homo sapiens
cgctctgtcgcctaggctggagtgcagtgacgcaatttcggctcacttcaagctccgcctcctgggttcacaccattctcctgcctgagcctcctgagtarctgggactataggcgcccgccatcacgcccggctaattttttttgtatttttagtagagacggggtgtcaccgtattagccaggatggtctcgatctcct

SEQ ID NO: 69591 - DNA, 201 bp, Homo sapiens
aggtttggtgatgccgcaggaaagccatgcccacccttgctgtgctgtgtggtgtaggccagtcccttctcctttctgggcttcaggctcccatggccccractcccttttctctgctggggagacctggaatgggacgtaggcttgtgtgtgggtgtgtcctgagtccctgtcctcccctcgagtctcacccttcattct

SEQ ID NO: 69592 - DNA, 201 bp, Homo sapiens
tgctcggcctcccaaagtgctgggattacaggcatgagccaccatgcccggccttgttttgtgttttggttttttttgagacagggtcttgctgtatcacscaggctggagtgcaacgatgggtccccagctaattgcagcctgggctcaagcaatctttctgcttcagcctcctgagtaggtgggactacaggtgctcca

SEQ ID NO: 69593 - DNA, 201 bp, Homo sapiens
atcctaggaggcggggagtgggaaggaacaggacaattaaataagataccatttattttttaaaaaattaaaaaataatgccaacattatttcatgcatcygcaggcctgccccctgcctcccaccagcctcccagggctgggcccccctcctcccctggctgtcctgtgtaataaagggaaaaacaatgagcaggctcag

SEQ ID NO: 69594 - DNA, 201 bp, Homo sapiens
taagcccttttatgtggttcctgcccctgagaataaagaagccccagcgtggctgcgaggcaccattggtcactgactgtacagatggcagtgcaggcagwgggcacggcgagtgcaaggttggaggactgctccagtgcaccggccagagccagggggaagtggctggagaggggggccagggttgaatgtcagggttaa

SEQ ID NO: 69595 - DNA, 201 bp, Homo sapiens
gtaaggccagctcttctgtctgcctcaacggcagtggtgtcttggagcctgcaggccgcgggttcgtcttgtaaataagcccttttatgtggttcctgccyctgagaataaagaagccccagcgtggctgcgaggcaccattggtcactgactgtacagatggcagtgcaggcagagggcacggcgagtgcaaggttggag

SEQ ID NO: 69596 - DNA, 201 bp, Homo sapiens
tcctgacctcgtgatccgccctgctcggcctcccaaagtgctgggattacaggcatgagccaccatgcccggccttgttttgtgttttggttttttttgaracagggtcttgctgtatcacgcaggctggagtgcaacgatgggtccccagctaattgcagcctgggctcaagcaatctttctgcttcagcctcctgagta

SEQ ID NO: 69597 - DNA, 201 bp, Homo sapiens
tggtagcccagctcctgttcctgtgccttcaaaaggctggggcactatgagtaaaagaccgcttttaaaatggggaaggcaccattaagccaaaatgaatytgaaaaaagaccaagtgggaggatgcctaatttgtagttgggtggttttttgtgtttgtttgattttttttttttttttttttttttttttttgagacga

SEQ ID NO: 69598 - DNA, 201 bp, Homo sapiens
cgagcttctgcttctatgcctgcacctgtgctgggacgccaccccaaccctccttccctgatcacagcatgacccatgaccaccccaacccctgcaacccrccaagggcggcctcgggcttctttcattctcagagaggcgagaggtgtgctgggcaccaatgccagatgtgggagctgggctggcccctcttctcctctc

SEQ ID NO: 69599 - DNA, 201 bp, Homo sapiens
gctggaaaggggttccaggaagagagggcagcctgcgtgaccagacagggggcaaatgagcctgggtcaggtgttggcaagggccctgtcgtggggtaggrgtgcctcccgggtgtgctgaactggccagaatgtggattcgggactcatagtgcaggttccaggccagaccctgcccttcctggctgtgtgccagtcaca

SEQ ID NO: 69600 - DNA, 201 bp, Homo sapiens
cgacctctgcgccctcgggagtccgggtcctcacgcgcatcccgagccctgggggcctggatgcggcccacggccccgactcaagggcgaggctcaggggrgagggcgcaagacgcctccgcacagaactgtgaccgaggagcaggggggctgccggggagggcgcacctgtccccgtgcacgcgctgtggcctccgtgga

SEQ ID NO: 69601 - DNA, 201 bp, Homo sapiens
cacctggggacccagaaaagtaggactttttctcctaggacccgcatcgaggcaggggacctcattcctagtgcccaccataggcaaccctctgcccactytgaaaagaggggcttgccgctggggagggattaggggttggtccctgccatcctggtttatttattttcagctcaagaattaattaggtttaaatatata

SEQ ID NO: 69602 - DNA, 201 bp, Homo sapiens
gccttcataccctggcaggccagatgtggacacttccccctcctgggcctcagaggcagggggtgagggcttccttggcacttcagcacccctcgctcccraaaccacgtagcccactttctcccagggagctctaagggaagcccgggctggcaccctggcctccaccctcagcttctgcactgccttcaggaggtggag

SEQ ID NO: 69603 - DNA, 201 bp, Homo sapiens
tcctgggctgccaccagggggtctcccaacatccccattccgtcacccatctgtccttcatgcccgtgatggcagctttatcccaggtcccagcagaagcygcggctgcaggggcagttaggcaggcaggtaaataaggcatcctgggccgggcgcggtggctcacacctgtcatctcagcactttgggaggccgagaccg

SEQ ID NO: 69604 - DNA, 201 bp, Homo sapiens
ggggttggtccctgccatcctggtttatttattttcagctcaagaattaattaggtttaaatatatacagatatgcctcaacttaccatggggttacttcytgataaacccatcataaatgaaaatatcctaagtcacaaattcatttaataccccaacagaccaattgtaaagttgaaacatggtttaagttgaaccact

SEQ ID NO: 69605 - DNA, 201 bp, Homo sapiens
gctgcccaaatttgggggtcccccatgatgggtgagggtagcttggaagaggcctggatatgtctttgacaggggcggggaaaaaggaacttagggctgcratggtgaggggtggctgcagcagcccagctgacatgttcatcctgaactccctgcacctgctggggatggggcagcaggtttggtgatgccgcaggaaag

SEQ ID NO: 69606 - DNA, 201 bp, Homo sapiens
tgtgctggggctcctgcccaccctctgctccaaccagcctgaggatgaggcacagggaggcagggcccatcactcaggaggccatgggagaaacagtctcygggaggtgctgcacctggggacccagaaaagtaggactttttctcctaggacccgcatcgaggcaggggacctcattcctagtgcccaccataggcaacc

SEQ ID NO: 69607 - DNA, 201 bp, Homo sapiens
gctccccaactccctgccctgccagctccccactggccaggcctctggactcagggtcagccaggtgccacccctccccaccctgcattgggcttcatttracggaggactgcccctccagaggagtcttctaggggagggagggaaggctgtgactgagtacggagcctctaccccctctgcctgcagccccagagcccc

SEQ ID NO: 69608 - DNA, 201 bp, Homo sapiens
cttgaaccggggaggtggaggttgcagtgagccaagattgcgccattgcactccagcctggacaacagagcgagactctgcttcaaaagataaaaaaattwaaaaaaaggattcctggaggaggccgctgatggggtctgaagaatgagtagcagttttttgggagaagaggcaggaaagcagagaaagctcgcattggga

SEQ ID NO: 69609 - DNA, 201 bp, Homo sapiens
cagggtagctctccctgagccatctcgcctgccacctcatgacatcccttcccacaccaccctgccttgctcacccctgaaaagcaacctctgttgtcccrtactctgaccctgagccaggcaggaaacctggctgaacagcaggagcaggatgagaggagagagaggcaaaaggcctgcttttcccaactggtgacaaga

SEQ ID NO: 69610 - DNA, 201 bp, Homo sapiens
cccctcttctcctctcttcctagggcgcagggcctggcccagcctgtgagctggggaggggtggactcaccgtgcttggtgctctgcgtggtgcgccgcckcaggctgtgttccagcagctggtgggtgcgggtggggctggctcctgccatcaggcgcacggtggcttcatgcaggaacacctggggaggtgccggggtg

SEQ ID NO: 69611 - DNA, 201 bp, Homo sapiens
gagctgtgcacgggaccagctgcaattgggcctcaccgggctgctctggtctcagggtagcctgctgtgactacccttcagagaaggatgtggctcatagmtgagggattcagccacatgctcagtcacatcctgactcctcttgcgacgaggcccagcactcccatcccagtctgtggtcctgtcccctggtgtgtctta

SEQ ID NO: 69612 - DNA, 201 bp, Homo sapiens
tgttaagttggggacagtctgtactgtggaggtaggagatggggtagggggaggagggaacctagaagccatgctgaaggcccctggtccccagtccccaygggtggcttcatttctcccagccccctgggcctaccctgagcttgggctaacatcctaggaggcggggagtgggaaggaacaggacaattaaataagata

SEQ ID NO: 69613 - DNA, 201 bp, Homo sapiens
gtccagtttgcagataggaaaagagaggccctgtgaggtaatgggatccggcccaagatacaacaggtgggtggtggagctgggcgaaccctgggctcctrcgcttggcggccatgcctgcccagcagaatgtcattggcccggaccccctccttgggagcggagaactcggggactgatgccaggccccactccctggtt

SEQ ID NO: 69614 - DNA, 201 bp, Homo sapiens
tgacaggctggtatttaaaagtgaccatagagaagccttcataccctggcaggccagatgtggacacttccccctcctgggcctcagaggcagggggtgasggcttccttggcacttcagcacccctcgctcccgaaaccacgtagcccactttctcccagggagctctaagggaagcccgggctggcaccctggcctcca

SEQ ID NO: 69615 - DNA, 201 bp, Homo sapiens
atccacccggtcccagcaccctttgggcctgtgggctgctgacaccgaatgtgacaggctggtatttaaaagtgaccatagagaagccttcataccctggyaggccagatgtggacacttccccctcctgggcctcagaggcagggggtgagggcttccttggcacttcagcacccctcgctcccgaaaccacgtagccca

SEQ ID NO: 69616 - DNA, 201 bp, Homo sapiens
cggtggcgggcggggctgagcggcggcggagcacgcggaggggcgtgagaggccgagaggcggtccctcggctggggcatagaggcttccccggtggaaawgagccgcggcctctgcgggtgaggggcccgaccggccagccagctcgccagggtggaaagggaccccccacgggtcctgcggcctcgagtctggggggct

SEQ ID NO: 69617 - DNA, 201 bp, Homo sapiens
gatggtctcgatctcctgacctcgtgatccgcccgcctcagcctcccaaagtgctaggattacaggcgtgagccaccgtggctggccttttttttttttttaaagacagggtctcggtatgttgcccaggccagtctcaaactcctggcctcaggcagtcctccccgaagggctgggattataggcaggaggcgccgggcc

SEQ ID NO: 69618 - DNA, 201 bp, Homo sapiens
gggtcagaacctcctgacctggacttcgccctgggcagcttccttggaacttgttgcagcttagcatctttggaagggagcactggactaggagtcagaargtggagttctgggtgctgttttcccactcttgggccctgggcatgttctgttctgtgcatcagatgttttctgcctgcctccccctgagctgccaccaga

SEQ ID NO: 69619 - DNA, 201 bp, Homo sapiens
gccaggatggtctcgatctcctgacctcgtgatccgccctgctcggcctcccaaagtgctgggattacaggcatgagccaccatgcccggccttgttttgkgttttggttttttttgagacagggtcttgctgtatcacgcaggctggagtgcaacgatgggtccccagctaattgcagcctgggctcaagcaatctttct

SEQ ID NO: 69620 - DNA, 201 bp, Homo sapiens
ttttttttttttttttttgagacgagtcttgctctgtcgccaggctggagtacagtggcgcgatctcgcctcactgtaacctccgactccttggttcaagkgattctcctgcctcagcctcccgaatagctgggattacaggcacgcaccaccacagccagctaatttttgtatttttagtagagacgggatttcaccatg

SEQ ID NO: 69621 - DNA, 201 bp, Homo sapiens
aatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcagc

SEQ ID NO: 69622 - DNA, 201 bp, Homo sapiens
aaatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcag

SEQ ID NO: 69623 - DNA, 201 bp, Homo sapiens
agagagggacccttgcaggtacagctcagaatctccctcctacccagacacccccaggttctgtactgccccgggactggtgccctgcccatccgcagccyggatgctccctcctccctcccagcatcccctgtggcagtggccatgcctgcccccagagcagctcaggctcccctttcatctctccaagccttagcccct

SEQ ID NO: 69624 - DNA, 201 bp, Homo sapiens
gctagccccagacatgcacactcttgctgtcacccaaacacgcgcagacacccgcacactcgagctgccagcattgggagctgggggcggggcgggtgccyttcaggagcagggactcggctcctctgcccgccccgcggggcttgctgcagatgccaggggttattttaagcctggatcaatggatgagttttggtgaca

SEQ ID NO: 69625 - DNA, 201 bp, Homo sapiens
cgccatcacgcccggctaattttttttgtatttttagtagagacggggtgtcaccgtattagccaggatggtctcgatctcctgacctcgtgatccgcccrcctcagcctcccaaagtgctaggattacaggcgtgagccaccgtggctggccttttttttttttttaaagacagggtctcggtatgttgcccaggccagt

SEQ ID NO: 69626 - DNA, 201 bp, Homo sapiens
tggattctggtcctggtaggcaatggggagccgctgatgggctctcagcagggagcagcagaatggaaatggtatttaagaggaggcctttggaccaggcraggtggctcacacctgtaatcccagcactttgggaggccgaggcaggaggacagcttgaggctaggggtttgagaccagcctgggccacatagcaagacc

SEQ ID NO: 69627 - DNA, 201 bp, Homo sapiens
aaactcccgacctcaggtgatctgcccgccttggcctcccaaagtgctgggattacaggcatgagccaccgcgcccagccagccttgacctttttgttttktttttttttttgagacggagtctcgctctgtcgcccaggttggggtgcagtggtgcaatctcggctcactgcaaactctgcctcccgggttcacgccatt

SEQ ID NO: 69628 - DNA, 201 bp, Homo sapiens
ggtgcagatgggggacggcctcccccggggctccccccacaacagcgcaggtgagtcggtggcgggcggggctgagcggcggcggagcacgcggaggggcstgagaggccgagaggcggtccctcggctggggcatagaggcttccccggtggaaatgagccgcggcctctgcgggtgaggggcccgaccggccagccagc

SEQ ID NO: 69629 - DNA, 201 bp, Homo sapiens
gttgcattctgagcttggtgtgaagtgggcactacagggtccaggtccccttcctcggttggaacgaggactctaggactctatgtgtcctgaccctggamctcccacccacatgccacacgtggcactcacatgcccccagcaacccccatgccctggggcctgtgccctcctcatccacccggtcccagcaccctttgg

SEQ ID NO: 69630 - DNA, 201 bp, Homo sapiens
cacctgtaatcccagcactttgggaggccgaggcaggaggacagcttgaggctaggggtttgagaccagcctgggccacatagcaagaccccatctattaygaaaaaaaggccactgatgccagccatgctgtgagcagaccagagagctgaccagagtgggctccaggaggcaggggtgccgctccaggcctggggtaca

SEQ ID NO: 69631 - DNA, 201 bp, Homo sapiens
cagggtcttgctgtatcacgcaggctggagtgcaacgatgggtccccagctaattgcagcctgggctcaagcaatctttctgcttcagcctcctgagtagstgggactacaggtgctccaccttgcccagctaattttttttttttttttttttttgagacagagtctcgctctgtcgcctaggctggagtgcagtgacgc

SEQ ID NO: 69632 - DNA, 201 bp, Homo sapiens
cctaaggaaaggaagcaggaaaggacgctccagaaagtagagctcagaagctctgagaagaatcacaaatgagaaggtttttttttgtttttttttttttktttgtttgtttgtttttttaagacggagtctcaatctgtttcccaggctggagggcaatggtgtgatctcagctcactgcaaactctgcctcccaggttc

SEQ ID NO: 69633 - DNA, 201 bp, Homo sapiens
ccctaaggaaaggaagcaggaaaggacgctccagaaagtagagctcagaagctctgagaagaatcacaaatgagaaggtttttttttgtttttttttttttgtttgtttgtttgtttttttaagacggagtctcaatctgtttcccaggctggagggcaatggtgtgatctcagctcactgcaaactctgcctcccaggtt

SEQ ID NO: 69634 - DNA, 201 bp, Homo sapiens
aggtgtggtggcaggcaccttataatcccagctactagggaagctgaggctggagaatcacttgaaccggggaggtggaggttgcagtgagccaagattgygccattgcactccagcctggacaacagagcgagactctgcttcaaaagataaaaaaattaaaaaaaaggattcctggaggaggccgctgatggggtctga

SEQ ID NO: 69635 - DNA, 201 bp, Homo sapiens
acatcacagctgggtgggggctgggtgttgggtccaaggaggtggctgtccaaggtcacacagcctgtgggtcctgggctgccaccagggggtctcccaamatccccattccgtcacccatctgtccttcatgcccgtgatggcagctttatcccaggtcccagcagaagccgcggctgcaggggcagttaggcaggcagg

SEQ ID NO: 69636 - DNA, 201 bp, Homo sapiens
ctactcagattttctccccaactgttctctcattttgataagagggatcccagacagactctggaagcgccgttttgcgggtgggaactgaagggaaaagkcctctctctgagcctgtgtttcgggccagcttttcctgaaggagggtctgattcccaccaggtccccagggccctggccggtgggggcaggcctggctga

SEQ ID NO: 69637 - DNA, 201 bp, Homo sapiens
tgagagggtggccctgcccgtcccggggcaattccgggctgctttgacctccgcgcctgtaaggtacaggtccccgcacctgtaagacagggacgctctastcgcgggccctagaactgatccccttcgagcgcccagttccgatgaatgtttcggggcagtctttgtggaggggggttccctgtggggcctcccggctcc

SEQ ID NO: 69638 - DNA, 201 bp, Homo sapiens
ctgctgtcccccagagaaagcctgataaaaactgaggaagcaaaaaggagagagtagggttcaggagagagaaactcaggaaggctggaggcaggggcttrgcagcttgggagctccccctgctgctatcaagtcagggctgcccagtttctgccctgccacctatcctctcacgcccaccaggccctggaccatgggcat

SEQ ID NO: 69639 - DNA, 201 bp, Homo sapiens
ggcccctgccctccctctggacccccagccaggggcttggaaatcaaattcagctcttcactccagcatgcacatgccctctttctgggaccaggctaacyctgcagaagcacagacactacagaccacagcattcagcccccatggagtttggtgtgcttgcctttggcttcagacctcaccatctttgacagcccttga

SEQ ID NO: 69640 - DNA, 201 bp, Homo sapiens; identical to SEQ ID NO: 64336

SEQ ID NO: 69641 - DNA, 201 bp, Homo sapiens; identical to SEQ ID NO: 64451

SEQ ID NO: 69642 - DNA, 201 bp, Homo sapiens; identical to SEQ ID NO: 64338

SEQ ID NO: 69643 - DNA, 201 bp, Homo sapiens; identical to SEQ ID NO: 64455

SEQ ID NO: 69644 - DNA, 201 bp, Homo sapiens; identical to SEQ ID NO: 64391

SEQ ID NO: 69645 - DNA, 201 bp, Homo sapiens; identical to SEQ ID NO: 64339

SEQ ID NO: 69646 - DNA, 201 bp, Homo sapiens
cctccttggtttatgccattctcctcagcctcagcctcctgagtagctgggattacaggtgcctgccaccacatctggctaattctttgtatttttagtaragacggtttcaccatgttattcaggatggtcttgatctcctgacctcatgatccacccatctcagcctcccaaagtgctgggattacaggcgtcagccac

SEQ ID NO: 69647 - DNA, 201 bp, Homo sapiens
gaatggcgtgaacccgggaggcggagcttgcagtgagccgagatcacaccactgcactccagcctgggcgacagagccagactctgtctcaaaaaaaaaaacaaaaaaactgaatatagaaagaaaagactagcatggttggggaaactagggctgcttcgtgttagaggcaagacttgaactgaactttgaggaatgggc

SEQ ID NO: 69648 - DNA, 201 bp, Homo sapiens; identical to SEQ ID NO: 64342

SEQ ID NO: 69649 - DNA, 201 bp, Homo sapiens; identical to SEQ ID NO: 64269

SEQ ID NO: 69650 - DNA, 201 bp, Homo sapiens; identical to SEQ ID NO: 64271

SEQ ID NO: 69651 - DNA, 201 bp, Homo sapiens; identical to SEQ ID NO: 64272

SEQ ID NO: 69652 - DNA, 201 bp, Homo sapiens; identical to SEQ ID NO: 64346

SEQ ID NO: 69653 - DNA, 201 bp, Homo sapiens
agactccatctcaaaaaacaaaacaaaaccaaaagaaaagacacgaaaaaaccagcattcaggggagtagatgaggagcatgggggtgggaagagaaggaygaagctggaggcaagggtgatggctggtgggtttatgggtgctcgcttcgtattatgctccataacttacatatatattttattagatatcatgtttatg

SEQ ID NO: 69654 - DNA, 201 bp, Homo sapiens; identical to SEQ ID NO: 64348

SEQ ID NO: 69655 - DNA, 201 bp, Homo sapiens; identical to SEQ ID NO: 64350

SEQ ID NO: 69656 - DNA, 201 bp, Homo sapiens; identical to SEQ ID NO: 64354

SEQ ID NO: 69657 - DNA, 201 bp, Homo sapiens; identical to SEQ ID NO: 12855

SEQ ID NO: 69658 - DNA, 201 bp, Homo sapiens; identical to SEQ ID NO: 64279

SEQ ID NO: 69659 - DNA, 201 bp, Homo sapiens; identical to SEQ ID NO: 64479

SEQ ID NO: 69660 - DNA, 201 bp, Homo sapiens; identical to SEQ ID NO: 64412

SEQ ID NO: 69661 - DNA, 201 bp, Homo sapiens; identical to SEQ ID NO: 64286

SEQ ID NO: 69662 - DNA, 201 bp, Homo sapiens
tggtggctcacgcctgtaatcccagcactttgggaggccgaggagggcgcatcacctgagatgccaatacaaaaattagccgggcgtggtggtgcacgcckgtagtcccagctactccggagggtgaggcacgagaatcgcctgaacccaggaggcggaggttgcagcgagacgagattgcgccactgcactccaggctgg

SEQ ID NO: 69663 - DNA, 201 bp, Homo sapiens; identical to SEQ ID NO: 64294

SEQ ID NO: 69664 - DNA, 201 bp, Homo sapiens
cctccttggcctcccaaagtgctgggattacaggtgtgagccatcgcaccaggtctaaacctcttttctttataaattaccctgtctaagatggttcttcrtagcagtgagaaaacagactaatacacatcgtaaccgaaaggtccactagacagcgctggtctagagtctaaacaaaccattctcacctccaagcaaccc

SEQ ID NO: 69665 - DNA, 201 bp, Homo sapiens; identical to SEQ ID NO: 64417

SEQ ID NO: 69666 - DNA, 201 bp, Homo sapiens; identical to SEQ ID NO: 64415

SEQ ID NO: 69667 - DNA, 201 bp, Homo sapiens; identical to SEQ ID NO: 64420

SEQ ID NO: 69668 - DNA, 201 bp, Homo sapiens; identical to SEQ ID NO: 64418

SEQ ID NO: 69669 - DNA, 201 bp, Homo sapiens; identical to SEQ ID NO: 64423

SEQ ID NO: 69670 - DNA, 201 bp, Homo sapiens; identical to SEQ ID NO: 64425

SEQ ID NO: 69671 - DNA, 201 bp, Homo sapiens
cccggattcacatttatttgttgtctgttgccacccagatgcgtgtgcagaatatggctctatgggagctggaccctggctgggtcatggcccaagccccracgtgcacatgcctggcggcaagggggctcaggaaatactgcagagttaacagaagcagccgggggcctgtgatgtggatggagagaactggggctatca

SEQ ID NO: 69672 - DNA, 201 bp, Homo sapiens; identical to SEQ ID NO: 64304

SEQ ID NO: 69673 - DNA, 201 bp, Homo sapiens
ttggtgcccacgtgaaaatgcagacagttaaaactgaatatagagctgggcgcggtggctcacgcctgtaatcccagcactttgggaggccgaggcgggcrgatcacgaggtcaggagatcaagaccatcccggctaacacgatgaaaccccatctctactaaaaatacaaaaaattagccgggcgtagtggcgggcgcct

SEQ ID NO: 69674 - DNA, 201 bp, Homo sapiens; identical to SEQ ID NO: 64310

SEQ ID NO: 69675 - DNA, 201 bp, Homo sapiens; identical to SEQ ID NO: 64443

SEQ ID NO: 69676 - DNA, 201 bp, Homo sapiens
cctcaccttccaccatgattgtgaggcctccccagccatgtggaactgtgagctcattaaacctttttttctttatgaattacccagtctcaggtatttcytcatagcagtatgaaaacggactaatacagacccctaggggtccaggatcccagctggaggtaaccattcctaggtgagccttaaagtactttgcaaagt

SEQ ID NO: 69677 - DNA, 201 bp, Homo sapiens
gtgaagattatcttgtatctgtcaggcttgtggactttggaaacattgaagactgtgtggacccaaaagcactctgggccattccttctgaacttctgtcrgttcccatgcaagcctttccatgttgcctctcagggtttaacatttcagaaggattatgttctcaagagggaaatgactatttctatgaaataataacag

SEQ ID NO: 69678 - DNA, 201 bp, Homo sapiens
ggtctcctgaacgtcccaacaagctccttgggcccttaggcgttaggccaaccccaggcctcggctggccccgcccactctccgcggccggaagtggcggygccgagtgaggtaaatgcgtgcccggaagcgcgacctcgggcggttggaggggctaccgggtcttaccagtccgtggcgggagtcccggaggaccctcga

SEQ ID NO: 69679 - DNA, 201 bp, Homo sapiens
gatctttcgtctttattgtcttacgtttctaattagttgggaggatttattttgctaaacagtttactaacacattacatttcaaaaactattttggtacmtttcaaatacagtgtttaaattaaaatagaaaaataagggctcatgacaagtacattatttgattctacttaggatagctttttagcaggatctccttca

SEQ ID NO: 69680 - DNA, 201 bp, Homo sapiens
ctagagaaatgagtatttgaagaatagaaaaagtacttgacatgattcctcattataaaatcagattgtcataattttgatagaaatacattttgttgttyacatcttttctggcttatctgtggttccatttctgatttgaattattttgtactcgtgataaagaatcaatagcaattcaaaggttccttttgttaggct

SEQ ID NO: 69681 - DNA, 201 bp, Homo sapiens
ggcccctttttctggtcacctagccagacagtatttttctctcagcctctgctccaccacacagttctgtttgcccgtaagagcgaagcagataaagagakaacaaaaacaatctcctattactattcttcagatgacagaaagctcttttcctggttccactggctagagagacgggtcatctctcacatttgtaggtgc

SEQ ID NO: 69682 - DNA, 201 bp, Homo sapiens
tactaaagctgtattaagatagacagctttgtcctgagattcatctggtttaggtcatgaaaaaaatagtttcttacctaaatgcttttgtaagaatgctratgaagctttgttgctaagatcaatagctgcatttgaatctatgtctccctttaatttgagcatgtgtccaattattttgccagttgcaaaagtgaagtc

SEQ ID NO: 69683 - DNA, 201 bp, Homo sapiens
ccaagcttcaatcacgattacagtatagcctacattttaaaatatgagtcctttgggaaaatacattaaaattctctctctctctctctctctctctctcwcacacacacacacacacacacacacataattttagacagttttgaaacaagacttttaaaaaacctattttaatcctaattgtatttctctattcctgaa

SEQ ID NO: 69684 - DNA, 201 bp, Homo sapiens
caaacttagtcactcaatatcaagactctgtgggaaataaaaatagtcaagtgtttccattaacaacagaaaagaaagaagaaatttctgctgagacaccyttgaaaacagcaagagtagaagctactctttcagagagaaaaataggagattcatgtgacaaagatttgcctctgaaattttgtgagttcccacagaaga

SEQ ID NO: 69685 - DNA, 201 bp, Homo sapiens
tctattctacacatgatatgaaaattggaagtgaagaattagtttatataacgcatattgatgacccttggacattttattgccagctggcaagaaatgcwaatattttagaagagttgtcatgtagtattacacaattaagtaaagttttgctgaatttaaaaacatctcccttgaaccctggaaccttgtgccttgcca

SEQ ID NO: 69686 - DNA, 201 bp, Homo sapiens
tatatatatatatgtatatgtgtgtatatatatatatatatatgtatatgtaatatatatgtatatatatgtgtgtatatatgtgtatatatatgtatatrtgtgtgtgtgtgtgtgtgtgtgtgtgtgtgtatatatatatatatatatattttttttttttttttttttttttttttgagacagggtctcactctgtca

SEQ ID NO: 69687 - DNA, 201 bp, Homo sapiens
aagacactgagatttacagttaggccagggtcatttgaagcactgccttgttgtatttgtatgtaatgacatttcgaaacgtggaatgaaaggaaaagtasaggcagactataagaagcttccacggatgtgtctaactttgcaaatgaacaaaaatctaatgtagacatatcctggaaacttctagtttgcctgcacttt

SEQ ID NO: 69688 - DNA, 201 bp, Homo sapiens
gggatataccatgactgttgtacacaatcaaaaccaggagcaaattgacattggtacaatccacagattccaaagtcactaatttataagcacacatttgkgtgtgtgtgtgtgtgtgtgtgtgtgtgtcattccatgcaatttcatcacctttgtgtagctttgataactatcactgcacacaagatacagaacagttca

SEQ ID NO: 69689 - DNA, 201 bp, Homo sapiens
gcatcgagaacataaaaataaatgagaagtgttcctgcttttaagatgttcctactgtggcaaacagagagctacaaaatataataatatagaagtatgtaaaaaaaaaaaaaaaaaggaataaccaattctgccaggttgaatagtagggtcacgaggaaacgacgtttgagctaggtcttgctagatgtttttaaataa

SEQ ID NO: 69690 - DNA, 201 bp, Homo sapiens
gatgcctttgttctctgaggaagaaagcagtgatggaagcaagcacaataatggtttaccagatcatatctcaggtatgtgaattttttttcctttttacttttttttttttttttttgagacagggtcttgctctgtcacctaggctggagtgcagtggtgtgatcttggctcactgcagcctctgcctcccaggctcta

SEQ ID NO: 69691 - DNA, 201 bp, Homo sapiens
gtaaaacttattagggagcctgttgatcgtgtttctcccgtgatttgaaaaccacctgttcgagagttacttggtatatatatatatatgtatatgtgtgtatatatatatatatatatgtatatgtaatatatatgtatatatatgtgtgtatatatgtgtatatatatgtatatatgtgtgtgtgtgtgtgtgtgtgtg

SEQ ID NO: 69692 - DNA, 201 bp, Homo sapiens
tgatgatgaatcaaaagaattcttagaactggaatctattgagttacagaattctctggtggtggatgaagaaaaaggggagctaagcccggtgccaccgratgtgccactctcccaagagtgtgtcacaaaaggcgccatggagctatttacactgcagcttcctctcagctgtgaagctgagaaacagccagaactaga

SEQ ID NO: 69693 - DNA, 201 bp, Homo sapiens
taaaacttattagggagcctgttgatcgtgtttctcccgtgatttgaaaaccacctgttcgagagttacttggtatatatatatatatgtatatgtgtgtatatatatatatatatatgtatatgtaatatatatgtatatatatgtgtgtatatatgtgtatatatatgtatatatgtgtgtgtgtgtgtgtgtgtgtgt

SEQ ID NO: 69694 - DNA, 201 bp, Homo sapiens
tgaatattttcgaatgccggtggtgacctacccttgtgctttgtatggactctgggacggtgggagaggctggtctcggtcacaggtcggtgacctgaagrcactgatactaggcaaggcagtgaatgcaaagattgaattttattgctcctttgagcatgtgtattatgtcagcctgtatggagaagatgggattaatct

SEQ ID NO: 69695 - DNA, 201 bp, Homo sapiens
tatatatatatatatatatgtatatgtaatatatatgtatatatatgtgtgtatatatgtgtatatatatgtatatatgtgtgtgtgtgtgtgtgtgtgtrtgtgtgtatatatatatatatatatattttttttttttttttttttttttttttgagacagggtctcactctgtcacccaggctggagtgcagtggcgcc

SEQ ID NO: 69696 - DNA, 201 bp, Homo sapiens
tatatatatatatatatgtatatgtaatatatatgtatatatatgtgtgtatatatgtgtatatatatgtatatatgtgtgtgtgtgtgtgtgtgtgtgtrtgtgtatatatatatatatatatattttttttttttttttttttttttttttgagacagggtctcactctgtcacccaggctggagtgcagtggcgccat

SEQ ID NO: 69697 - DNA, 201 bp, Homo sapiens
gtcctgagattcatctggtttaggtcatgaaaaaaatagtttcttacctaaatgcttttgtaagaatgctaatgaagctttgttgctaagatcaatagctrcatttgaatctatgtctccctttaatttgagcatgtgtccaattattttgccagttgcaaaagtgaagtcagcaaaattctggtggactgaacccctaaa

SEQ ID NO: 69698 - DNA, 201 bp, Homo sapiens
tatatatatatatatgtatatgtaatatatatgtatatatatgtgtgtatatatgtgtatatatatgtatatatgtgtgtgtgtgtgtgtgtgtgtgtgtrtgtatatatatatatatatatattttttttttttttttttttttttttttgagacagggtctcactctgtcacccaggctggagtgcagtggcgccatct

SEQ ID NO: 69699 - DNA, 201 bp, Homo sapiens
tgatgaaattaaactggttacatactagccaacattgaggacatcctaataatgctaggattggtggacacgcaccataccagtttattatgggttatctsattggaataaagaggtatcatacttcaatgtgggaaagggatatgattaactttgtaaagtagcagacctggaattttatataatcattttctttatatg

SEQ ID NO: 69700 - DNA, 201 bp, Homo sapiens
tatatatatatatgtatatgtaatatatatgtatatatatgtgtgtatatatgtgtatatatatgtatatatgtgtgtgtgtgtgtgtgtgtgtgtgtgtrtatatatatatatatatatattttttttttttttttttttttttttttgagacagggtctcactctgtcacccaggctggagtgcagtggcgccatcttg

SEQ ID NO: 69701 - DNA, 201 bp, Homo sapiens
tagaaaagcaataagagattatatgggggggcgggcactgtaagaattttaaacaaaattgagggagacagtcataccaatgtactaattacatgatattratgatatagaaataatgcagattaggaaaatgctttgcttgtgtatgttacattaaggaattaagagatatgcattgagtcttactcaattcaatttggc

SEQ ID NO: 69702 - DNA, 201 bp, Homo sapiens
ttcattattgtgtaaaacttattagggagcctgttgatcgtgtttctcccgtgatttgaaaaccacctgttcgagagttacttggtatatatatatatatrtatatgtgtgtatatatatatatatatatgtatatgtaatatatatgtatatatatgtgtgtatatatgtgtatatatatgtatatatgtgtgtgtgtgt

SEQ ID NO: 69703 - DNA, 201 bp, Homo sapiens
cggcgggtgcccgacagcctcttccgttcgctgctggagcgctatctcacagcggccactgctagcgtgggctccggggtcccggttctctcgcgagtccygctcaagcaaaagcagcctggtctggattacttctatccccagctgcagctgggcgtgacggaggccgtggtcataacccaagtgtgccatccccaccgc

SEQ ID NO: 69704 - DNA, 201 bp, Homo sapiens
gactcgccttcaggcggcgcggaggatttcgaggccctgaggcgcggcccttaatttccggaagtgggggccgcgccgcgccgtcaagatgtgctcgacgyccggaatgccggcgccgggggcctcgctggccctgcgggtgtccttcgtggacgtgcatcccgatgtgatcccggtgcagctgtgggggctggtgggcga

SEQ ID NO: 69705 - DNA, 201 bp, Homo sapiens
gaattaagagatatgcattgagtcttactcaattcaatttggcagctcaactacagaacacctacactctgaaagcctttactgttggatctaaatgtgtkgtgtggtcaagtctaagaaacacatggtctaaatgtgagattttagaaacagctgaagaaggaacaagggtaagtgatgtttaagtactttatctccaaa

SEQ ID NO: 69706 - DNA, 201 bp, Homo sapiens
aaacttattagggagcctgttgatcgtgtttctcccgtgatttgaaaaccacctgttcgagagttacttggtatatatatatatatgtatatgtgtgtatrtatatatatatatatgtatatgtaatatatatgtatatatatgtgtgtatatatgtgtatatatatgtatatatgtgtgtgtgtgtgtgtgtgtgtgtgt

SEQ ID NO: 69707 - DNA, 201 bp, Homo sapiens
cctctagtaaaggagagctggaagttggaagtacagtagaagtcagagtgtcttatgttgaaaaccctggctatttctggtgtcagctgaccaggaacatrcaaggacttaaaactctaatgtctgatattcagtactattgcaaaaatacagctgctcctcaccagagaaacacccttgcttgtttggctaagcgaacag

SEQ ID NO: 69708 - DNA, 201 bp, Homo sapiens
tagtccaagcttcaatcacgattacagtatagcctacattttaaaatatgagtcctttgggaaaatacattaaaattctctctctctctctctctctctcwctctcacacacacacacacacacacacacataattttagacagttttgaaacaagacttttaaaaaacctattttaatcctaattgtatttctctattcc

SEQ ID NO: 69709 - DNA, 201 bp, Homo sapiens
ttcggcattgatgcctttgttctctgaggaagaaagcagtgatggaagcaagcacaataatggtttaccagatcatatctcaggtatgtgaattttttttyctttttacttttttttttttttttttgagacagggtcttgctctgtcacctaggctggagtgcagtggtgtgatcttggctcactgcagcctctgcctcc

SEQ ID NO: 69710 - DNA, 201 bp, Homo sapiens
tatagtctttgcaacaaatggcagtataacaattggatatccatatataaaaataaaatcctcaacccttacctcactacaaaaagttaatttaaaatgamtcatagacctaaatacaagagccaaaattataaaacttctaaacaaaaacattgaaagtttgttttgtgggtttttgttttgtttttttaccttgggtta

SEQ ID NO: 69711 - DNA, 201 bp, Homo sapiens
gttgtagcaaaagatccagatggaacactgattatagaactatatggtgacaatattcaaattagtgctagtattaataagaagttggggctacttagttmcaaagatagaataagaaaaaaagaaagtgaagtcctctgttctacaactgaaactcttgaagaaaaaaatgagaatatgaagttgccatgtacagagtat

SEQ ID NO: 69712 - DNA, 201 bp, Homo sapiens
taaaatgtaaatttgattacttcattattgtgtaaaacttattagggagcctgttgatcgtgtttctcccgtgatttgaaaaccacctgttcgagagttayttggtatatatatatatatgtatatgtgtgtatatatatatatatatatgtatatgtaatatatatgtatatatatgtgtgtatatatgtgtatatatat

SEQ ID NO: 69713 - DNA, 201 bp, Homo sapiens
ttggtatatatatatatatgtatatgtgtgtatatatatatatatatatgtatatgtaatatatatgtatatatatgtgtgtatatatgtgtatatatatrtatatatgtgtgtgtgtgtgtgtgtgtgtgtgtgtgtatatatatatatatatatattttttttttttttttttttttttttttgagacagggtctcact

SEQ ID NO: 69714 - DNA, 201 bp, Homo sapiens
gcctgttgatcgtgtttctcccgtgatttgaaaaccacctgttcgagagttacttggtatatatatatatatgtatatgtgtgtatatatatatatatatrtgtatatgtaatatatatgtatatatatgtgtgtatatatgtgtatatatatgtatatatgtgtgtgtgtgtgtgtgtgtgtgtgtgtgtatatatatat

SEQ ID NO: 69715 - DNA, 201 bp, Homo sapiens
ctcccgtgatttgaaaaccacctgttcgagagttacttggtatatatatatatatgtatatgtgtgtatatatatatatatatatgtatatgtaatatatrtgtatatatatgtgtgtatatatgtgtatatatatgtatatatgtgtgtgtgtgtgtgtgtgtgtgtgtgtgtatatatatatatatatatatttttttt

SEQ ID NO: 69716 - DNA, 201 bp, Homo sapiens
aagcttcaatcacgattacagtatagcctacattttaaaatatgagtcctttgggaaaatacattaaaattctctctctctctctctctctctctctctcwcacacacacacacacacacacacataattttagacagttttgaaacaagacttttaaaaaacctattttaatcctaattgtatttctctattcctgaaga

SEQ ID NO: 69717 - DNA, 201 bp, Homo sapiens
cccgtgatttgaaaaccacctgttcgagagttacttggtatatatatatatatgtatatgtgtgtatatatatatatatatatgtatatgtaatatatatrtatatatatgtgtgtatatatgtgtatatatatgtatatatgtgtgtgtgtgtgtgtgtgtgtgtgtgtgtatatatatatatatatatatttttttttt

SEQ ID NO: 69718 - DNA, 201 bp, Homo sapiens
taatcacatttaaaatgtaatcacatttataatcaagagggcatgtgttggtaagttttataaaacatggtattcccttgccaaatttatggcactactayaggcattaatttacactaaggattatttcaacagggtcttttagacttaactgtatcatgcattgatcttgcaattcattagaaacccttaaagaaaaaa

SEQ ID NO: 69719 - DNA, 201 bp, Homo sapiens
aagaaatgattcttgctttttagtgaattggaatacttccagtttgaatactggaatgtgttctgtattgaagggtccctgaactcagagccagagcctgstacctgccctcaccactgaacgtggtatgtatttgatgctagtcactttaaatttaaatcactttagatttaagccttagaggaaacagatttcaaacac

SEQ ID NO: 69720 - DNA, 201 bp, Homo sapiens
atttgaaaaccacctgttcgagagttacttggtatatatatatatatgtatatgtgtgtatatatatatatatatatgtatatgtaatatatatgtatatrtatgtgtgtatatatgtgtatatatatgtatatatgtgtgtgtgtgtgtgtgtgtgtgtgtgtgtatatatatatatatatatatttttttttttttttt

SEQ ID NO: 69721 - DNA, 201 bp, Homo sapiens
ttgaaaaccacctgttcgagagttacttggtatatatatatatatgtatatgtgtgtatatatatatatatatatgtatatgtaatatatatgtatatatrtgtgtgtatatatgtgtatatatatgtatatatgtgtgtgtgtgtgtgtgtgtgtgtgtgtgtatatatatatatatatatatttttttttttttttttt

SEQ ID NO: 69722 - DNA, 201 bp, Homo sapiens
accacctgttcgagagttacttggtatatatatatatatgtatatgtgtgtatatatatatatatatatgtatatgtaatatatatgtatatatatgtgtrtatatatgtgtatatatatgtatatatgtgtgtgtgtgtgtgtgtgtgtgtgtgtgtatatatatatatatatatatttttttttttttttttttttttt

SEQ ID NO: 69723 - DNA, 201 bp, Homo sapiens
tgttcgagagttacttggtatatatatatatatgtatatgtgtgtatatatatatatatatatgtatatgtaatatatatgtatatatatgtgtgtatatrtgtgtatatatatgtatatatgtgtgtgtgtgtgtgtgtgtgtgtgtgtgtatatatatatatatatatattttttttttttttttttttttttttttga

SEQ ID NO: 69724 - DNA, 201 bp, Homo sapiens
cgagagttacttggtatatatatatatatgtatatgtgtgtatatatatatatatatatgtatatgtaatatatatgtatatatatgtgtgtatatatgtrtatatatatgtatatatgtgtgtgtgtgtgtgtgtgtgtgtgtgtgtatatatatatatatatatattttttttttttttttttttttttttttgagaca

SEQ ID NO: 69725 - DNA, 201 bp, Homo sapiens
acttggtatatatatatatatgtatatgtgtgtatatatatatatatatatgtatatgtaatatatatgtatatatatgtgtgtatatatgtgtatatatrtgtatatatgtgtgtgtgtgtgtgtgtgtgtgtgtgtgtatatatatatatatatatattttttttttttttttttttttttttttgagacagggtctca

SEQ ID NO: 69726 - DNA, 201 bp, Homo sapiens
caatcacgattacagtatagcctacattttaaaatatgagtcctttgggaaaatacattaaaattctctctctctctctctctctctctctctcacacacwcacacacacacacacacataattttagacagttttgaaacaagacttttaaaaaacctattttaatcctaattgtatttctctattcctgaagagttctg

SEQ ID NO: 69727 - DNA, 201 bp, Homo sapiens
aaaccacctgttcgagagttacttggtatatatatatatatgtatatgtgtgtatatatatatatatatatgtatatgtaatatatatgtatatatatgtrtgtatatatgtgtatatatatgtatatatgtgtgtgtgtgtgtgtgtgtgtgtgtgtgtatatatatatatatatatatttttttttttttttttttttt

SEQ ID NO: 69728 - DNA, 201 bp, Homo sapiens
ttaggatcagattataggaagccttcaatttcaagctgagtttaactccctattttaaaaaatttaatctgaatggctacagaagtaaaatttctcagaakgagtgactttgcacctgacaccactaagataggactagggtaccaaatgagtggtataaatttttatgtcccctgggaaataaaatcattttccatgatt

SEQ ID NO: 69729 - DNA, 201 bp, Homo sapiens
tgtatatgtgtgtatatatatatatatatatgtatatgtaatatatatgtatatatatgtgtgtatatatgtgtatatatatgtatatatgtgtgtgtgtrtgtgtgtgtgtgtgtgtgtatatatatatatatatatattttttttttttttttttttttttttttgagacagggtctcactctgtcacccaggctggag

SEQ ID NO: 69730 - DNA, 201 bp, Homo sapiens
tgatatgaaaattggaagtgaagaattagtttatataacgcatattgatgacccttggacattttattgccagctggcaagaaatgcaaatattttagaasagttgtcatgtagtattacacaattaagtaaagttttgctgaatttaaaaacatctcccttgaaccctggaaccttgtgccttgccaagtatactgatgg

SEQ ID NO: 69731 - DNA, 201 bp, Homo sapiens
ctcattaacatggcataggaaatcctctagggttaagtgtttatgtactctctttggccctaattctttatattttgtactttatattaaatggacatcamaattcttgacttctcttacatataccatctgcttgctctttcgatatatttaatattgcagttctattttacctatattccatcctgttaccaaactggt

SEQ ID NO: 69732 - DNA, 201 bp, Homo sapiens
agcaaccttcagggcaaggaggtgcacgggtgcgtcctggacgtgctgctgctccatcgcctggtcctcctggaggtgcctgatgtgttccaacagatgcrggagctgggcctggctcggcgggtgcccgacagcctcttccgttcgctgctggagcgctatctcacagcggccactgctagcgtgggctccggggtcccg

SEQ ID NO: 69733 - DNA, 201 bp, Homo sapiens
agctgggcgtgacggaggccgtggtcataacccaagtgtgccatccccaccgcattcactgccagctccgcagcgtctcgcaggagatccaccgcctctcygagagcatggcccaggtataccggggttccacggggacaggggatgagaactctaccagtgccacctgggaggagagggaggagagcccagataagccgg

SEQ ID NO: 69734 - DNA, 201 bp, Homo sapiens
actctaccagtgccacctgggaggagagggaggagagcccagataagccgggctctccgtgtgcatcctgtggcctggatggacattggtacagagcactsttgcttgagacttttcggccccagcgctgtgcccaggtgcttcatgtggactatggaaggaaggagttagtgagttgcagcagccttcggtacttgctgc

SEQ ID NO: 69735 - DNA, 201 bp, Homo sapiens
taatgcagtggttcttagaattgaggcacattgagaataaaatcagctaatggtagctttaatatcatgtgaaaaatatatactaatcaaaaaggaaaaakaactaattgattatcagccttgttcacaccattctctagcaaaatataaaatatgccaatttcataatttttagagaaacttgatttgatggtacagtgt

SEQ ID NO: 69736 - DNA, 201 bp, Homo sapiens
gccttcggtacttgctgcctgaatattttcgaatgccggtggtgacctacccttgtgctttgtatggactctgggacggtgggagaggctggtctcggtcmcaggtcggtgacctgaaggcactgatactaggcaaggcagtgaatgcaaagattgaattttattgctcctttgagcatgtgtattatgtcagcctgtatg

SEQ ID NO: 69737 - DNA, 201 bp, Homo sapiens
ttattcaattagtgaagaatttctgaaggttaaggcacaggcttttaggtgcagtctttataatttaattcaaccagttggccagaatccctttgtttggratgtaaaggcaatacaagctttcaatgaatttatagataatgcatggcaaaaaaatctagaattaaaatgtacaatatttgctctggcttcaattaatga

SEQ ID NO: 69738 - DNA, 201 bp, Homo sapiens
tcaacaggttagtatattgcaggtctcagtcgataatctgactttttctttaaagagttcctaccccagcctaatgatggaatacttccccctagctctamccccaaaaatctgtaggcatattctggtgtttagattgaagtagcatgtagtataatgctaattttaattaccagtgatatagtttggatctgtgtcccc

SEQ ID NO: 69739 - DNA, 201 bp, Homo sapiens
cccagggtagtcagggactttggtcagtggtttatatagtagttaagtgtcaaagactttgctgtgcttatttggctctgttctgcatgtgcatagctcargggcaatcctgagacttagagttcacatgtagcattaggagttaaacattttcaactcctttcctctctgagatgtcctccacattttctggctcccagg

SEQ ID NO: 69740 - DNA, 201 bp, Homo sapiens
ccagggatatgttctagagaaatgagtatttgaagaatagaaaaagtacttgacatgattcctcattataaaatcagattgtcataattttgatagaaatrcattttgttgtttacatcttttctggcttatctgtggttccatttctgatttgaattattttgtactcgtgataaagaatcaatagcaattcaaaggttc

SEQ ID NO: 69741 - DNA, 201 bp, Homo sapiens
gagatttcctacctatttcttactctctagcattcagggttcctttatccctagtccactggctataaataagaaatttctctcagagttttgctgtctaygctagctaggcagttttgatttggcccaccctcagatcaaaatcaggagacaaagaagtaaaaaaaaagaaaagaaaaggcctatgaaactcactcctgt

SEQ ID NO: 69742 - DNA, 201 bp, Homo sapiens
aaaatactcagtgtgcactatgttaggttatttctttttaaccttaacttattagatattttcaatagttattttctcctttcagcatcagcatgcgccaycaacaaaagactgtaaaaaacaaacaaacaaaaaagtgttgaatgggacatccatacagttggaatgcttatttctaaaatgaatagggaaaaggtttgc

SEQ ID NO: 69743 - DNA, 201 bp, Homo sapiens
gtccaacagcagagcatgacagaacaaactaatgctacctgctccagatacagaaaaggtaggacattggaaaatctgggtggatgggggtaaaggattcrgatcagcccataacggccacgtgatataccctgacgtcctaggattaaggccatgagccatggaaggaggttggaggacaaatgaaatacagaaagtcat

SEQ ID NO: 69744 - DNA, 201 bp, Homo sapiens
ctgttgatcgtgtttctcccgtgatttgaaaaccacctgttcgagagttacttggtatatatatatatatgtatatgtgtgtatatatatatatatatatrtatatgtaatatatatgtatatatatgtgtgtatatatgtgtatatatatgtatatatgtgtgtgtgtgtgtgtgtgtgtgtgtgtgtatatatatatat

SEQ ID NO: 69745 - DNA, 201 bp, Homo sapiens
tatatatatatattttttttttttttttttttttttttttgagacagggtctcactctgtcacccaggctggagtgcagtggcgccatcttggctcactgmaagctctgcctcccaggttcacaccattctcctgcctcagcctcccaagtagctgggactacaggcgcccaccacgacgcccagctaattttttgtattt

SEQ ID NO: 69746 - DNA, 201 bp, Homo sapiens
gaaaatctgggtggatgggggtaaaggattcggatcagcccataacggccacgtgatataccctgacgtcctaggattaaggccatgagccatggaaggakgttggaggacaaatgaaatacagaaagtcataatatctacaaccctgtggtctacaaaggagtttggttatactacatgaacctgaaatagatgatggat

SEQ ID NO: 69747 - DNA, 201 bp, Homo sapiens
tcttcagatgacagaaagctcttttcctggttccactggctagagagacgggtcatctctcacatttgtaggtgcctatgttgccatagctgtcaccaggmagtaactggggttagccaccctcagggcagggccagaaaaaaaaatagaaataaacataacaccacaatacagcaaagagatttcctacctatttcttac

SEQ ID NO: 69748 - DNA, 201 bp, Homo sapiens
tcctgcttttaagatgttcctactgtggcaaacagagagctacaaaatataataatatagaagtatgtaaaaaaaaaaaaaaaaaggaataaccaattctrccaggttgaatagtagggtcacgaggaaacgacgtttgagctaggtcttgctagatgtttttaaataaaatgtttttcttccataatgaatatgaaacaa

SEQ ID NO: 69749 - DNA, 201 bp, Homo sapiens; identical to SEQ ID NO: 21354

SEQ ID NO: 69750 - DNA, 201 bp, Homo sapiens; identical to SEQ ID NO: 21355

SEQ ID NO: 69751 - DNA, 201 bp, Homo sapiens; identical to SEQ ID NO: 21356

SEQ ID NO: 69752 - DNA, 201 bp, Homo sapiens; identical to SEQ ID NO: 21357

SEQ ID NO: 69753 - DNA, 201 bp, Homo sapiens; identical to SEQ ID NO: 21358

SEQ ID NO: 69754 - DNA, 201 bp, Homo sapiens; identical to SEQ ID NO: 21359

SEQ ID NO: 69755 - DNA, 201 bp, Homo sapiens; identical to SEQ ID NO: 21360

SEQ ID NO: 69756 - DNA, 201 bp, Homo sapiens; identical to SEQ ID NO: 2364

SEQ ID NO: 69757 - DNA, 201 bp, Homo sapiens; identical to SEQ ID NO: 2366

SEQ ID NO: 69758 - DNA, 201 bp, Homo sapiens; identical to SEQ ID NO: 21363

SEQ ID NO: 69759 - DNA, 201 bp, Homo sapiens; identical to SEQ ID NO: 21364

SEQ ID NO: 69760 - DNA, 201 bp, Homo sapiens; identical to SEQ ID NO: 21365

SEQ ID NO: 69761 - DNA, 201 bp, Homo sapiens; identical to SEQ ID NO: 21366

SEQ ID NO: 69762 - DNA, 201 bp, Homo sapiens; identical to SEQ ID NO: 21367

SEQ ID NO: 69763 - DNA, 201 bp, Homo sapiens; identical to SEQ ID NO: 21368

SEQ ID NO: 69764 - DNA, 201 bp, Homo sapiens; identical to SEQ ID NO: 2359

SEQ ID NO: 69765 - DNA, 201 bp, Homo sapiens; identical to SEQ ID NO: 21370

SEQ ID NO: 69766 - DNA, 201 bp, Homo sapiens; identical to SEQ ID NO: 21371

SEQ ID NO: 69767 - DNA, 201 bp, Homo sapiens; identical to SEQ ID NO: 2360

SEQ ID NO: 69768 - DNA, 201 bp, Homo sapiens; identical to SEQ ID NO: 21373

SEQ ID NO: 69769 - DNA, 201 bp, Homo sapiens; identical to SEQ ID NO: 21374

SEQ ID NO: 69770 - DNA, 201 bp, Homo sapiens; identical to SEQ ID NO: 2361

SEQ ID NO: 69771 - DNA, 201 bp, Homo sapiens; identical to SEQ ID NO: 2362

SEQ ID NO: 69772 - DNA, 201 bp, Homo sapiens; identical to SEQ ID NO: 21377

SEQ ID NO: 69773 - DNA, 201 bp, Homo sapiens; identical to SEQ ID NO: 2363

SEQ ID NO: 69774 - DNA, 201 bp, Homo sapiens; identical to SEQ ID NO: 2365

SEQ ID NO: 69775 - DNA, 201 bp, Homo sapiens; identical to SEQ ID NO: 21380

SEQ ID NO: 69776 - DNA, 201 bp, Homo sapiens
  misc_feature (1)...(201): n = A,T,C or G, or insertion/deletion polymorphism (see Tables 1-2)
catggtgccaggatgagctggggagagctggctcttggcctcatggcctcatgaccggcaagtggccaaggcagaaaggggtcagatattccacagcaccngcatcccagtgaatccctctcattcatgtcttcgttgagtcacttactcattcattcactggggaaaggggaaaaaccacctactggggatcggagtttg

SEQ ID NO: 69777 - DNA, 201 bp, Homo sapiens; identical to SEQ ID NO: 16647

SEQ ID NO: 69778 - DNA, 201 bp, Homo sapiens; identical to SEQ ID NO: 17052

SEQ ID NO: 69779 - DNA, 201 bp, Homo sapiens; identical to SEQ ID NO: 16925

SEQ ID NO: 69780 - DNA, 201 bp, Homo sapiens; identical to SEQ ID NO: 16928

SEQ ID NO: 69781 - DNA, 201 bp, Homo sapiens
tgcagacccctgactccagcacgtctgggctgccaggtaggcacacgccgccctcgggccagaagctgcggatgtcggcgtcccggtagccttggttcttsccagactgttccagaatgatcgccttggcggcggtgtccatgcccacatgcacgacgagctgtgtgaacgggtaacagcagagagaacccaggaaaacga

SEQ ID NO: 69782 - DNA, 201 bp, Homo sapiens
acgagctgtgtgaacgggtaacagcagagagaacccaggaaaacgaggcccaccctgctcaccaaatgtgcagaaggggccactccttttgagagcccggstctgtgcaaaacatctcaaaccccaaatccactgggaaaccccaggatcccccaccagtgtctcctaattaatatggctggaaagaaaaacagctggatt

SEQ ID NO: 69783 - DNA, 201 bp, Homo sapiens; identical to SEQ ID NO: 17064

SEQ ID NO: 69784 - DNA, 201 bp, Homo sapiens
ctggaaagaaatttgaatacataaattacgaaactctgtactgcagttccgactgatttgtagacttttttcctataccttccactaacaacagtcaggcyaaggcaagtctgatctgcatgaccccaaggcagaggacttcagttcttcacatttcccatgtgctttttggtctttcacagctgacatgcccacctcggg

SEQ ID NO: 69785 - DNA, 201 bp, Homo sapiens
tccaggtgtacttgcaaagggagtcccctaaaggctactccaaatgcaaaaagcgtgctggcggccttgactgcttcctttggttttcttgtgggtttttktttgtttttttttttttttttttttgagacacagttttgttcttattgaccaggctggagtgcaatagtgcaatctcggctcactgcaacctccgcctcc

SEQ ID NO: 69786 - DNA, 201 bp, Homo sapiens; identical to SEQ ID NO: 1565

SEQ ID NO: 69787 - DNA, 201 bp, Homo sapiens
gcaagtctgatctgcatgaccccaaggcagaggacttcagttcttcacatttcccatgtgctttttggtctttcacagctgacatgcccacctcggggggrtgctggtgagaacccagtgggcctcacgcagaatgtgggtcactggaggagctccaaagtcctagttactttctagctgctgctcagtgatctctgtctg

SEQ ID NO: 69788 - DNA, 201 bp, Homo sapiens
atcgccttggcggcggtgtccatgcccacatgcacgacgagctgtgtgaacgggtaacagcagagagaacccaggaaaacgaggcccaccctgctcaccaratgtgcagaaggggccactccttttgagagcccggctctgtgcaaaacatctcaaaccccaaatccactgggaaaccccaggatcccccaccagtgtctc

SEQ ID NO: 69789 - DNA, 201 bp, Homo sapiens; identical to SEQ ID NO: 16831

SEQ ID NO: 69790 - DNA, 201 bp, Homo sapiens; identical to SEQ ID NO: 16829

SEQ ID NO: 69791 - DNA, 201 bp, Homo sapiens
actgttccagaatgatcgccttggcggcggtgtccatgcccacatgcacgacgagctgtgtgaacgggtaacagcagagagaacccaggaaaacgaggccyaccctgctcaccaaatgtgcagaaggggccactccttttgagagcccggctctgtgcaaaacatctcaaaccccaaatccactgggaaaccccaggatcc

SEQ ID NO: 69792 - DNA, 201 bp, Homo sapiens
agtttctcaatgcacagttgagtgctacatacaggattgaaacattcaattttctctagaggagcaatcccccggtcagttccctttggctggaaggaccrtggttgagttttcttcgaactgggctctgtgcttgggctttcccacctcttccagcatttcctggatgatgactctcaaggctcttcccagcaggctggc

SEQ ID NO: 69793 - DNA, 201 bp, Homo sapiens; identical to SEQ ID NO: 17106

SEQ ID NO: 69794 - DNA, 201 bp, Homo sapiens; identical to SEQ ID NO: 1558

SEQ ID NO: 69795 - DNA, 201 bp, Homo sapiens; identical to SEQ ID NO: 16846

SEQ ID NO: 69796 - DNA, 201 bp, Homo sapiens; identical to SEQ ID NO: 16613

SEQ ID NO: 69797 - DNA, 201 bp, Homo sapiens; identical to SEQ ID NO: 16537

SEQ ID NO: 69798 - DNA, 201 bp, Homo sapiens
ttgccagactgttccagaatgatcgccttggcggcggtgtccatgcccacatgcacgacgagctgtgtgaacgggtaacagcagagagaacccaggaaaaygaggcccaccctgctcaccaaatgtgcagaaggggccactccttttgagagcccggctctgtgcaaaacatctcaaaccccaaatccactgggaaacccc

SEQ ID NO: 69799 - DNA, 201 bp, Homo sapiens; identical to SEQ ID NO: 17120

SEQ ID NO: 69800 - DNA, 201 bp, Homo sapiens; identical to SEQ ID NO: 16614

SEQ ID NO: 69801 - DNA, 201 bp, Homo sapiens; identical to SEQ ID NO: 1563

SEQ ID NO: 69802 - DNA, 201 bp, Homo sapiens; identical to SEQ ID NO: 16671

SEQ ID NO: 69803 - DNA, 201 bp, Homo sapiens; identical to SEQ ID NO: 16673

SEQ ID NO: 69804 - DNA, 201 bp, Homo sapiens; identical to SEQ ID NO: 16675

SEQ ID NO: 69805 - DNA, 201 bp, Homo sapiens; identical to SEQ ID NO: 16676

SEQ ID NO: 69806 - DNA, 201 bp, Homo sapiens; identical to SEQ ID NO: 16678

SEQ ID NO: 69807 - DNA, 201 bp, Homo sapiens; identical to SEQ ID NO: 17142

SEQ ID NO: 69808 - DNA, 201 bp, Homo sapiens
ggccagaagctgcggatgtcggcgtcccggtagccttggttcttgccagactgttccagaatgatcgccttggcggcggtgtccatgcccacatgcacgaygagctgtgtgaacgggtaacagcagagagaacccaggaaaacgaggcccaccctgctcaccaaatgtgcagaaggggccactccttttgagagcccggct

SEQ ID NO: 69809 - DNA, 201 bp, Homo sapiens; identical to SEQ ID NO: 16417

SEQ ID NO: 69810 - DNA, 201 bp, Homo sapiens; identical to SEQ ID NO: 16769

SEQ ID NO: 69811 - DNA, 201 bp, Homo sapiens; identical to SEQ ID NO: 16620

SEQ ID NO: 69812 - DNA, 201 bp, Homo sapiens; identical to SEQ ID NO: 1557

SEQ ID NO: 69813 - DNA, 201 bp, Homo sapiens; identical to SEQ ID NO: 16691

SEQ ID NO: 69814 - DNA, 201 bp, Homo sapiens; identical to SEQ ID NO: 16621

SEQ ID NO: 69815 - DNA, 201 bp, Homo sapiens; identical to SEQ ID NO: 16692

SEQ ID NO: 69816 - DNA, 201 bp, Homo sapiens; identical to SEQ ID NO: 17173

SEQ ID NO: 69817 - DNA, 201 bp, Homo sapiens; identical to SEQ ID NO: 1561

SEQ ID NO: 69818 - DNA, 201 bp, Homo sapiens; identical to SEQ ID NO: 16623

SEQ ID NO: 69819 - DNA, 201 bp, Homo sapiens; identical to SEQ ID NO: 16448

SEQ ID NO: 69820 - DNA, 201 bp, Homo sapiens; identical to SEQ ID NO: 16624

SEQ ID NO: 69821 - DNA, 201 bp, Homo sapiens
ggctgaaataatacgccagatgtagaaggaccagcgccgcatgactccctcatatgagctacctacagtcagattcatagggatggagggtggagtggtgrgcaccaagtgctgggaggaagaaggaatagggagttaataggtacagagtttcagtttgggatgaggagaaagttctggagatggatggtggtgatggtt

SEQ ID NO: 69822 - DNA, 201 bp, Homo sapiens; identical to SEQ ID NO: 17005

SEQ ID NO: 69823 - DNA, 201 bp, Homo sapiens; identical to SEQ ID NO: 16697

SEQ ID NO: 69824 - DNA, 201 bp, Homo sapiens; identical to SEQ ID NO: 16699

SEQ ID NO: 69825 - DNA, 201 bp, Homo sapiens; identical to SEQ ID NO: 16702

SEQ ID NO: 69826 - DNA, 201 bp, Homo sapiens; identical to SEQ ID NO: 16705

SEQ ID NO: 69827 - DNA, 201 bp, Homo sapiens; identical to SEQ ID NO: 16464

SEQ ID NO: 69828 - DNA, 201 bp, Homo sapiens; identical to SEQ ID NO: 16711

SEQ ID NO: 69829 - DNA, 201 bp, Homo sapiens; identical to SEQ ID NO: 16468

SEQ ID NO: 69830 - DNA, 201 bp, Homo sapiens
gctgagctatgtggggcacgtgtgttcacgcatgttgcctggaagcgttctccagaaaagcattgcctcttctctgacagctgagctttctcagcatgcarattgccagtaaagacgacagggaagctatctgtttctccctccattaaatcatctggaaagaaatttgaatacataaattacgaaactctgtactgcagt

SEQ ID NO: 69831 - DNA, 201 bp, Homo sapiens; identical to SEQ ID NO: 1552

SEQ ID NO: 69832 - DNA, 201 bp, Homo sapiens; identical to SEQ ID NO: 17215

SEQ ID NO: 69833 - DNA, 201 bp, Homo sapiens; identical to SEQ ID NO: 17216

SEQ ID NO: 69834 - DNA, 201 bp, Homo sapiens
aagggagtcccctaaaggctactccaaatgcaaaaagcgtgctggcggccttgactgcttcctttggttttcttgtgggtttttgtttgtttttttttttktttttttttgagacacagttttgttcttattgaccaggctggagtgcaatagtgcaatctcggctcactgcaacctccgcctcctgggttcaagcgattc

SEQ ID NO: 69835 - DNA, 201 bp, Homo sapiens; identical to SEQ ID NO: 16713

SEQ ID NO: 69836 - DNA, 201 bp, Homo sapiens; identical to SEQ ID NO: 16633

SEQ ID NO: 69837 - DNA, 201 bp, Homo sapiens; identical to SEQ ID NO: 17029

SEQ ID NO: 69838 - DNA, 201 bp, Homo sapiens
atgttatggcatgctgccaggcagtctgaaatataacactggagcccagtcctgggggccccttgcttgccagtgtcctgggacagaattgcccatagcasagacagatctccacattagcaaccatgcagccagacctgtgcacaccgcccagcaccacctccccccatcccccaatatgtgggctttgatctgttttct

SEQ ID NO: 69839 - DNA, 201 bp, Homo sapiens
tcccacctcttccagcatttcctggatgatgactctcaaggctcttcccagcaggctggccgggagcccgcgcgatagtggagggacatggatgagtgccrcgcagccctttccatgatgcagagacaggtaataggtataatcacagacgtatctgcaaccacaggaaatgccacattaattctcggaccagcctctaac

SEQ ID NO: 69840 - DNA, 201 bp, Homo sapiens; identical to SEQ ID NO: 1560

SEQ ID NO: 69841 - DNA, 201 bp, Homo sapiens
aaattattcttacagggtaatgtattctctttttgtggggggagggttggagggaggagaggcaagctagtaagtggtgaggctaccacagcagagtcttygtgttttggtggaatcctgaatctttttattttatattttatttatgtatttatttatttttatgagacagagtctggctgtatcacccaggctggagtg

SEQ ID NO: 69842 - DNA, 201 bp, Homo sapiens
ttctagcaaatgatccaggtgtacttgcaaagggagtcccctaaaggctactccaaatgcaaaaagcgtgctggcggccttgactgcttcctttggttttyttgtgggtttttgtttgtttttttttttttttttttttgagacacagttttgttcttattgaccaggctggagtgcaatagtgcaatctcggctcactgc

SEQ ID NO: 69843 - DNA, 201 bp, Homo sapiens; identical to SEQ ID NO: 16501

SEQ ID NO: 69844 - DNA, 201 bp, Homo sapiens; identical to SEQ ID NO: 1564

SEQ ID NO: 69845 - DNA, 201 bp, Homo sapiens; identical to SEQ ID NO: 1566

SEQ ID NO: 69846 - DNA, 201 bp, Homo sapiens
ggtcagttccctttggctggaaggaccatggttgagttttcttcgaactgggctctgtgcttgggctttcccacctcttccagcatttcctggatgatgactctcaaggctcttcccagcaggctggccgggagcccgcgcgatagtggagggacatggatgagtgccgcgcagccctttccatgatgcagagacaggtaa

SEQ ID NO: 69847 - DNA, 201 bp, Homo sapiens; identical to SEQ ID NO: 16638

SEQ ID NO: 69848 - DNA, 201 bp, Homo sapiens
gagcaatcccccggtcagttccctttggctggaaggaccatggttgagttttcttcgaactgggctctgtgcttgggctttcccacctcttccagcatttsctggatgatgactctcaaggctcttcccagcaggctggccgggagcccgcgcgatagtggagggacatggatgagtgccgcgcagccctttccatgatgc

SEQ ID NO: 69849 - DNA, 201 bp, Homo sapiens
atgaattttttaaatgtagtcaagtgaaaaatggtagttgtaagcacaccaacgtaacaagaaatttcccagagctcacctaccttcactcacttcctccaaaaaaaaaaaaaaaagcgatgttaccaatgggactcccaaaggaaatctgcccctagaaaacactgaacaggtagaatcttgctgggagaagcttggcac

SEQ ID NO: 69850 - DNA, 201 bp, Homo sapiens; identical to SEQ ID NO: 17036

SEQ ID NO: 69851 - DNA, 201 bp, Homo sapiens; identical to SEQ ID NO: 16641

SEQ ID NO: 69852 - DNA, 201 bp, Homo sapiens
tgtgactgtaaaatggtgcagcccctgtgcaaaacaaaatggcagttccttaaaaaattaaacacagaattagcattgaatccaggaattcacctctggakattgacctgaaagcaaggactcggatacatatttgcacgccagtgtttgtagcagcatgatttgcaagaaccaaaaggagcaagtaacgtaagtgttcat

SEQ ID NO: 69853 - DNA, 201 bp, Homo sapiens
ggaggacatgaggctgaaataatacgccagatgtagaaggaccagcgccgcatgactccctcatatgagctacctacagtcagattcatagggatggaggstggagtggtgagcaccaagtgctgggaggaagaaggaatagggagttaataggtacagagtttcagtttgggatgaggagaaagttctggagatggatgg

SEQ ID NO: 69854 - DNA, 201 bp, Homo sapiens; identical to SEQ ID NO: 1573

SEQ ID NO: 69855 - DNA, 201 bp, Homo sapiens
aacaatgcataattgcaaaatcttcccccagcaatgttcagccatcatgcacttgactttgcttaacagtcagacctcgttctggtgctgagccatcctayggggcttcatggagcttgtttcttgatacacatgagggtcgtaatccctcccttctaacttaatttttttttttatttttatttttcagagacagggtct

SEQ ID NO: 69856 - DNA, 201 bp, Homo sapiens
tttccacttaaaaaatctagcagcccccacctaactgatggatacttgtaggtaaatgactctatctgagcaatgatgcgctgactgggcctataaattaygacccattgtggttagttcaaataaaaggaggttccgataaaggaaaactgacactcggaattttctctctcaaaaaggatgatgtctagggatgcaaaa

SEQ ID NO: 69857 - DNA, 201 bp, Homo sapiens
aaataaaaggaggttccgataaaggaaaactgacactcggaattttctctctcaaaaaggatgatgtctagggatgcaaaattcaggaatataaagagagwccttgcaaatgtatcaggctcttctaaaatacaagggattggtataaaattgtcctggtgaaatcaaggggaagcacacaggactaaggaaagagaggca

SEQ ID NO: 69858 - DNA, 201 bp, Homo sapiens
gaatcatgggatttctcaaaggtgcacatattatacagaacaatgttcaaatacctgcatgagcttgctatgagtcaaggaggaagacgtttcactttggrcctaagacaatttcttatattgaaacatattcataaaaaacagacttgacaacagttaatgccttggatagaattgtgtagctctgacatgcatttctga

SEQ ID NO: 69859 - DNA, 201 bp, Homo sapiens
aattttctctctcaaaaaggatgatgtctagggatgcaaaattcaggaatataaagagagaccttgcaaatgtatcaggctcttctaaaatacaagggatkggtataaaattgtcctggtgaaatcaaggggaagcacacaggactaaggaaagagaggcaagaaatatatttcttctcctttgcagggaaaacactgcat

SEQ ID NO: 69860 - DNA, 201 bp, Homo sapiens
tgtgaagggtctacacgttcaacctcttccttgtaagttaatgagttagctaccaagttttgaggaagctagcagaaaacaggagacccaggatcagatayagaggacttcgttactcatggcagagcaaacagcatgagctttatttctgcactgattcccattgccctggcccctagtcccacagggaggatgtggaac

SEQ ID NO: 69861 - DNA, 201 bp, Homo sapiens
aaagagaggcaagaaatatatttcttctcctttgcagggaaaacactgcattgggaagaagcttgctctttccaaatacattccattaaattgacaaccayagccaccactgccaccacaacaaaaatcaggccaacctagatcaaattactaggaataggtctaatgttacttttatgaccatgaggtcctggccctcat

SEQ ID NO: 69862 - DNA, 201 bp, Homo sapiens
tccgttattcattctcaccctgaactcttccttctggaaccacttctctacggtgttggtaacagagttagcacactgattctaagcacacagtccagcakcctcttttttctatatttccaagacatcaatgtagtcttgacaatgcagcagcagcagcagcagcaggagcaacagcaactgccaaggtctgcaagtggc

SEQ ID NO: 69863 - DNA, 201 bp, Homo sapiens
gccaggttcccactgcaaagccactccgttattcattctcaccctgaactcttccttctggaaccacttctctacggtgttggtaacagagttagcacacwgattctaagcacacagtccagcagcctcttttttctatatttccaagacatcaatgtagtcttgacaatgcagcagcagcagcagcagcaggagcaacag

SEQ ID NO: 69864 - DNA, 201 bp, Homo sapiens
gattttttttttttaactctgctccacttaatttaagagttacacaaaatcaatttgtggtctatctcccttcacctagtctctatcatgtaggagggaaytggaaaattccatctggtgtgtttcaatgtttcctcaagcgcaacttcctttatctcaccaagatcttgttaaattgcacatgactttagtcctggacgc

SEQ ID NO: 69865 - DNA, 201 bp, Homo sapiens
gtgctgggattacagagtgtgccaccgcacccagccttcatgtccaaatgtaatccctaacgttggaggtggggcctggtggaaggtgattagatcatgcrgacagatttctcatgcatggtttagcacgtatgctgtgtggtgagttggctctcctgagatctggttgttgaaaagtgttttgcacctgcccccttgctc

SEQ ID NO: 69866 - DNA, 201 bp, Homo sapiens
aaaaacgtccatgtaaatacgttttctaaaggaggagagccacaggaaaccaggaataaatgccacattcatcctatgtgagttaaagaaaactgtatccrttttcaaattgtagcagtaaggccagcaaggaaacaacctacccagctgtgtataatatatttactcaattaaaaaaggaagacattagcacagcatcct

SEQ ID NO: 69867 - DNA, 201 bp, Homo sapiens
gcacgtatgctgtgtggtgagttggctctcctgagatctggttgttgaaaagtgttttgcacctgcccccttgctccctctcttgctcctgtttgcaccaygtgagatgctttccttcccctttgccttccaccatgattgtaagtttcctgaggcctccccagaagccaagcagatgctagcatcatgcttcctgtacag

SEQ ID NO: 69868 - DNA, 201 bp, Homo sapiens
gctcctgtttgcaccatgtgagatgctttccttcccctttgccttccaccatgattgtaagtttcctgaggcctccccagaagccaagcagatgctagcakcatgcttcctgtacagcctgtggaactgtgagccaattaaaggtgtcttttaaataaattacccagtctcaggtatttctttatagcagtgcaagaatga

SEQ ID NO: 69869 - DNA, 201 bp, Homo sapiens
ctcctgtttgcaccatgtgagatgctttccttcccctttgccttccaccatgattgtaagtttcctgaggcctccccagaagccaagcagatgctagcatyatgcttcctgtacagcctgtggaactgtgagccaattaaaggtgtcttttaaataaattacccagtctcaggtatttctttatagcagtgcaagaatgaa

SEQ ID NO: 69870 - DNA, 201 bp, Homo sapiens
ggaactgtgagccaattaaaggtgtcttttaaataaattacccagtctcaggtatttctttatagcagtgcaagaatgaactaatacacacatagaggatrgagcactctgcccagctcatgccaacactccatcaatgttagtacttagcatcagcattatgttgcatagctgatgattcatatacacattactccctgc

SEQ ID NO: 69871 - DNA, 201 bp, Homo sapiens
agtctctttcaaaaaacaatagattaaaaagtgcaatatttttaccccctcttaaattggaatcatggtatagcaggcaggatacaaacttctcatttccrttacacattttcagtgccatcattaatctgaatgacatcaacaaaatgcccaatgcacataaatcagtcagactttgaatcattcctgcagcctctgaac

SEQ ID NO: 69872 - DNA, 201 bp, Homo sapiens
tatttttaccccctcttaaattggaatcatggtatagcaggcaggatacaaacttctcatttccattacacattttcagtgccatcattaatctgaatgayatcaacaaaatgcccaatgcacataaatcagtcagactttgaatcattcctgcagcctctgaacatttaccatggagctcaataagccaggcaagaacac

SEQ ID NO: 69873 - DNA, 201 bp, Homo sapiens
gactcagctgacgaaactccagttgcctggtgagaacagagtgattttgatgacttttgcagaggatcagaaagaggggaaacggattcatttgattcatytgtggtttcctgttttccataaggagatagttacaggattaaatttctcctcccttttccctatgcactcacacctgggtcccaggacagcaggaccaat

SEQ ID NO: 69874 - DNA, 201 bp, Homo sapiens
gtatagcaggcaggatacaaacttctcatttccattacacattttcagtgccatcattaatctgaatgacatcaacaaaatgcccaatgcacataaatcartcagactttgaatcattcctgcagcctctgaacatttaccatggagctcaataagccaggcaagaacacagatttttttttttttttttttttttgagac

SEQ ID NO: 69875 - DNA, 201 bp, Homo sapiens
gctagcctctggaatgaggctggactgggcagggcagttcccggccctgcattccaaacaggatgctcacctgcttgctgctcccacatgcctttcccaartacaccaaataataacaaaagaagatgttcaaataaatagagctcccatgattatgtaccatggtagcaaataaatagagctaccaggatgttaacatgc

SEQ ID NO: 69876 - DNA, 201 bp, Homo sapiens
tacacttccctgtccttttgaatttggggatggccattgacttgctttcgccaatgcaaattgtttcctctgaggttacatctattcctaccagcctagaytgatcagcctctgccctcagagaagaaatcaatccccccttttccatggagtgagctttccttctgtgacagcactagactgccaaagaagcagagagct

SEQ ID NO: 69877 - DNA, 201 bp, Homo sapiens
cctgccccagtggctgggaggcgcagactctggaacacaggttacacctctcatttcagtgcttagaagagcagaggcagctgtacaggggaggcgcgggycacagcgtgacatgctcacaccccggacaggtctggagacagcctcctgaaaccgccctgggggccccagaagccctcaggtctccagggcttgtcactc

SEQ ID NO: 69878 - DNA, 201 bp, Homo sapiens
agcgaccacagagctgacagcagcagacttcgattgtgcacagaatgccagccactgttgcttggtggtttatcatctaaactctcacaaaagccctaagrggtaggaacaattacaaaccaaccaccttttacagatgagataattgaagttcagagaggttcagtacttggctagtgatcgcacaggtaggaattagct

SEQ ID NO: 69879 - DNA, 201 bp, Homo sapiens
gagggctgaggtccaggaagagacttcgggaggagatcagacttggaggatgacaggggtgggagtgcagacagcgaccacagagctgacagcagcagacwtcgattgtgcacagaatgccagccactgttgcttggtggtttatcatctaaactctcacaaaagccctaagaggtaggaacaattacaaaccaaccacct

SEQ ID NO: 69880 - DNA, 201 bp, Homo sapiens
ctatgaagatactacccgagactgggtaatgtataaaggaaagaggtttattgactcacagttccgcatggctagggaggcctcaggaaacttacaatcayggcagaaggcaaagcagaagcaagcaccttcttcgcaaagcagcaggaaagagaatgaaggccaggggaaacttccatttataaaactatcagatctcac

SEQ ID NO: 69881 - DNA, 201 bp, Homo sapiens
tttaattgacaagaatcagaaacaaattgagatggaatggtccacacagggcccatgctgagacaggcagtgtggctgacggatgagaccattggttagcsatgtgtttgtgtctctgttgtgccccttattcactgtcctgccaggagccagttagtggctcatctgtgaaatgggaataagaacagtcccaatatctca

SEQ ID NO: 69882 - DNA, 201 bp, Homo sapiens
agaaaaaaaaaagcaggagaagagtcctggtaaaatgtgaccacaaaagaaagacagagagatgcaatcttgctggctttgaaaaatgaagaggccatagmagaggaatgtgtcagcctctacgtcatgggaaaaggccaaggaacgaccttcccccagagcctccagaaagaaatgccaacaactacattttagcccaag

SEQ ID NO: 69883 - DNA, 201 bp, Homo sapiens
ggactgcttaaacccaggagtttgagcccagcctgggaaacatggcaaaatcccatttctacaaatatatatatataaacacacatgcacatacataaatrtaagtataaatcagccaggtatggtgacacacatctgcagtacaagctactcgggaggctgaggcaggaggatcgcttcagtctgggagttacaggctgc

SEQ ID NO: 69884 - DNA, 201 bp, Homo sapiens
tgtatctttaacaaacaaaagtggcagtttaaaaacaattagactcaaaaactctaatgaataaaaatcactgtccctacagatagcacgtaaacttacaygcgcaccgaagcgtgcttccacactgcacggcgcacactggccagggacattctgaaccagaaagggccctggccccaaagtcgtgctttccctactttg

SEQ ID NO: 69885 - DNA, 201 bp, Homo sapiens
atcctggttctccctgtggcttttgggccaagggtagtggggaaaacagcttcttgtcactgggggaacaagccaagatgggacagtgctcgtctgccagyggcagccccattcggagagaattttccctttgaagaatataacccataaaagatcatcaaaactaagggaataaataaagaggggacctcgatgacatat

SEQ ID NO: 69886 - DNA, 201 bp, Homo sapiens
tcttccttgtaagttaatgagttagctaccaagttttgaggaagctagcagaaaacaggagacccaggatcagatacagaggacttcgttactcatggcasagcaaacagcatgagctttatttctgcactgattcccattgccctggcccctagtcccacagggaggatgtggaacagcccggtagatgccgtgctcata

SEQ ID NO: 69887 - DNA, 201 bp, Homo sapiens
agatgggacagtgctcgtctgccagtggcagccccattcggagagaattttccctttgaagaatataacccataaaagatcatcaaaactaagggaataartaaagaggggacctcgatgacatatttaagctctgaataaagctagactctaagcaggggttggcaaactataaccgctgggccaaacacggctgtgttc

SEQ ID NO: 69888 - DNA, 201 bp, Homo sapiens
tagactctaagcaggggttggcaaactataaccgctgggccaaacacggctgtgttcttatacagcacacaggctaaaaatgcttcacatttttaaatggytgggggcgggggggaaagaataatattttgtgacacatgaaaatgtatatgaaattcaaattccagtatccataaataaagtttctcgcagccatgcctg

SEQ ID NO: 69889 - DNA, 201 bp, Homo sapiens
tcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactgtgcccggctggctttcat

SEQ ID NO: 69890 - DNA, 201 bp, Homo sapiens
taatgtcctctacatggctattatgattggaaaaggcataccttgaacagagatgaataaatctgcatatctgtgaaatgtcagttcagcatgttgatcgycagtaatcttttcagaacatttcagatatatgaaaatagcaccaatgtctgagtttgaacctgaactggtttcagctaaagtgatcatcttcagccaaaa

SEQ ID NO: 69891 - DNA, 201 bp, Homo sapiens
gagcaaacagcatgagctttatttctgcactgattcccattgccctggcccctagtcccacagggaggatgtggaacagcccggtagatgccgtgctcatrgtacgtttcagtcatggctgaggagccccaagcttacaaaccccaacctttatcaagcaaatctgccaaaccgttgtcctggaaggaggcactgtcttta

SEQ ID NO: 69892 - DNA, 201 bp, Homo sapiens
ttaaagatattgcttaatgtccataaataaaaaactcataacctacgactttttctccattgtccagagattagtagatggcgcaaattaacaagaagagyaaaacactcaatgttcatctagattcatattaacatattaactaacttccttggagtaatctaacataggccaacttcaaatccagtgattttttttttt

SEQ ID NO: 69893 - DNA, 201 bp, Homo sapiens
actgtggggttgcatcaatttaaagtcatgttacattaaagagaaaaatgtctgggagagtctcttcctgtcactttagattagatttgttgttgttatcyggctgtgcattttgtcggcttcattttacattttaaagatattgcttaatgtccataaataaaaaactcataacctacgactttttctccattgtccaga

SEQ ID NO: 69894 - DNA, 201 bp, Homo sapiens
gtgagccaccgggcccagccgtaggaacacagatattatcatcatgggacaagtcatccattcccagattccatgaccctctctggtgtccactgtggatwtcagcacatgtttaactatgaaactctagtcacgctttttgatatacaggttcatggttactagtgtcttatcctgcttgagccaagaatatgcactaac

SEQ ID NO: 69895 - DNA, 201 bp, Homo sapiens
ggcgctccacagcgagcgggaagatcttttgtgagattacttatctggagcgcgtgtcacttcttcagcaccataaaactgaaatacttgaaatagatgtyactacatttgtcatgaactgacatggccaattaatattacaaattcaccatggagaaacgcttccagctcccaaggtataaactgctgaacatcacaatt

SEQ ID NO: 69896 - DNA, 201 bp, Homo sapiens
ttcccaataggaattgacaaaaccacccacattttaaacacactccttccattcccattcttctttccccagatgctgcacttaatataatttggaaagawctaaaaaaaataaataaataaataaaaagctgtaagacaatttttaattgtcagagatggagcacttagaatttatagtaattaactagtcattatttca

SEQ ID NO: 69897 - DNA, 201 bp, Homo sapiens
aaggaaagataaagttgatgccacctttggtctcttcctttctactgacaaatcatgtgtacttcagcagtcacttactccatctgggcctctgtttcctyatctataaaacaggaataatgacaacttccccaccttagacatatggattctatgaatatagtcttgacatgtaaatggctattttgttgtgctgctgtt

SEQ ID NO: 69898 - DNA, 201 bp, Homo sapiens
tcctcaatgaatttaatgatttcaaagtcaaacataggcacgttcaaccagtaagacatatgagtcaatataatgttaccatggagaaggatttttaaagsgtaacaattaaaagcagagatcatagaagacaggctgatagatttggttgcaatagaattaaaattaaaagacaaaagtaaaacaaaaattaaaaactta

SEQ ID NO: 69899 - DNA, 201 bp, Homo sapiens
aaaaatacaattagtactagaactatttttaaagtcctgagtgaaaacagacaatgcactatttagatgtagaatagaagggagtcaaattataaaaacasagaacagaatataattcaaagagaggtgctgcttggaaataaggaaaaaatactaaaacatgggatgccatgttttttccatgttaacctaatatttcat

SEQ ID NO: 69900 - DNA, 201 bp, Homo sapiens
gaaaggcaaggggtgcatttactggaagcgctatgaatctatctggatgaaatccttaggctgggagcagccctcagcaggtagggaaggctgggggaaaygtacttcctgcgtacgacacacttatcatgcacctgtaatagtgtgcccatcagcaggaaccacagcatagccatgccggcgtctattacctatccagtg

SEQ ID NO: 69901 - DNA, 201 bp, Homo sapiens
gaaacacctctttgtgtccaaagtaatttctttttcaactttgaaaggcaaggggtgcatttactggaagcgctatgaatctatctggatgaaatccttasgctgggagcagccctcagcaggtagggaaggctgggggaaacgtacttcctgcgtacgacacacttatcatgcacctgtaatagtgtgcccatcagcagg

SEQ ID NO: 69902 - DNA, 201 bp, Homo sapiens
tgaagtccagtggacacatacatttaaccacaaatcgaaacaaatgcttcccagtatacagtatgcaagaaaagagcagcattgattggaagaatgagagrtattttcagagatgaaaacattctttattccctcggtccccatgtgttccaatggaaaggaactacatcctatgggcggagagtctcaggtaacacatga

SEQ ID NO: 69903 - DNA, 201 bp, Homo sapiens
ggacattcttcaaatctgatgcctgttatgtaaaatttccagatttcaaaatgtatcctttttcctgcatttatctcgctttccttcacacccggggggartttgttaaactgcagtgaccactggcagagtcccaagccaagccaaaccgtgcaaacatgaaacggccccacaaatcatgcaaaccctacacgctgtccc

SEQ ID NO: 69904 - DNA, 201 bp, Homo sapiens
gggtttcaccatgttggccaggctggtctcaaactccaggcctcaagtgatccacccgcctaggcctcccaaagtgctgggattacaggtgtgagccaccrcatccggcccttgtatgtttctacctgaacaacttctcctgcggtccttcaaagggtggatactgaagtccagtggacacatacatttaaccacaaatcg

SEQ ID NO: 69905 - DNA, 201 bp, Homo sapiens
ccgaatttaacaaggttcgcaaatgaactagagtaagtttcccacagtgacacattaataataagttccttatcccatccatcccaagccatgaatatgtwatgttataaaatgagtccttttcacacaacggaatctcagacgtgaataaataaaaactatccatcacaagcctgtgaaaaattaatgagagttcggaga

SEQ ID NO: 69906 - DNA, 201 bp, Homo sapiens
caagcctgtgaaaaattaatgagagttcggagatgcaaagaaaaatggggacaaggagagatggcccagttcataaaagcctccctaaaactttcagacaktaaatatcctagcccccgtccctcaccaaattgccaggtgtgggtggaaagcaacagattttatttttaatgggctaaaattttacagtcttaaagcaca

SEQ ID NO: 69907 - DNA, 201 bp, Homo sapiens
gacagataataaatacccctcatcagctgatcaattgctcgcacttccaggcaagcacccatcactccccaccaaacacaccgccccacgccacctgaacraggttaaaagaacggactcatgactgatggtcggggggaactggcttcagaagaggaagttgaaaatattaagaaatcaacacgggcatttaaaagcaaa

SEQ ID NO: 69908 - DNA, 201 bp, Homo sapiens
ctggggtccaaggatttatttcctctctcgggagtcagggacagataataaatacccctcatcagctgatcaattgctcgcacttccaggcaagcacccakcactccccaccaaacacaccgccccacgccacctgaacaaggttaaaagaacggactcatgactgatggtcggggggaactggcttcagaagaggaagtt

SEQ ID NO: 69909 - DNA, 201 bp, Homo sapiens
gtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaa

SEQ ID NO: 69910 - DNA, 201 bp, Homo sapiens
ttgctgaagaataaacaactgaacagtatatgctttcattcaccaagtgagccaacatgccaagttttcgttgttttgttttgtttttttaagatgcagargtaccagtaaaaggaatagcagtattagaataaaaatacaattagtactagaactatttttaaagtcctgagtgaaaacagacaatgcactatttagatg

SEQ ID NO: 69911 - DNA, 201 bp, Homo sapiens
tgaagttcagagaggttcagtacttggctagtgatcgcacaggtaggaattagcttgaactaggacccctcggtctgatcttgaaagcactcaagaggagytgcggtgactttgggtgacaaagcactgacagggagatagggatcctgagacgtgagggtccagggggtcagtctgcaatgtggagctgatgtggaccca

SEQ ID NO: 69912 - DNA, 201 bp, Homo sapiens
aactgcagcacgctaatactgtcagtctgtctcagaaacccctgccagccagaaggcttaactttgagatgaatgcaaagcagaatgaagcccaggaactytgggggtctgggctaaggctgatgctgggcagcagattagaggcagagcagagcccagaagtccagcctcccctcccagtgcactcctcgacaagaggct

SEQ ID NO: 69913 - DNA, 201 bp, Homo sapiens
tgtcaaggcctccaaaagggtttgttttgttttttaaagcagagccctggcagacacaccataaacttagcacagattacccctcgtagcatccgagtggkaatctagttttccaaaggaaaagatcatcgctgaaggcattttagttttcacaccaatgcaatatgttaataccaaaaaagaacatgttggcattaaatc

SEQ ID NO: 69914 - DNA, 201 bp, Homo sapiens
ggacctacccaccattgcacaggcagaaaacaggagagccaagactgacacccccagcaggaggtgttccagccaccttggacaccttccaccacaggctragccgcagtgaagggctttcagaggggcagtccacactggacatcaaacggtagagtggagattgggtcaaggacaggagcttcattatcttaaatgaat

SEQ ID NO: 69915 - DNA, 201 bp, Homo sapiens
caggcaggaggatcgcttgagcctgggaggttaagactgcagtgagccatgatcacgccactgcactctagcctgagtgacagaacaactcattgtctcaraaaaaaaaaagaagaattcttcacgaaagacattaaaaaagaccatcacacagagacctctcaaaagttatgctagctaagccactacaccagattttct

SEQ ID NO: 69916 - DNA, 201 bp, Homo sapiens
atggctgcactggggttcaatagaaccagatctcccggtatgtttctttttgtttgttttttgagacagagtttcgctctgtcacccaggctggagtgcaytgacacgactcgactcactgcaacctccgcctcccgagttcaagcgattctcctgcctcagcctcccaagtagctgggattacaggtttgcgccaccgca

SEQ ID NO: 69917 - DNA, 201 bp, Homo sapiens
gccaaggtgggaggatcgcttgagcccgggagtttgagacctgcctgggcaatgtggtgaaaccctgtctctacaaaaaatacaaaagttagttgggcatrgtggcaagcacctgtggtcccagctgctcaggaggctgaggtgggaggatctcttgaacccaggaggtcaaggctgcagtgagctgagatcacaccactg

SEQ ID NO: 69918 - DNA, 201 bp, Homo sapiens
gccttattcacaggtacatccttggaacttagtaaagggcttaacctccatagcaggcagtcaagacttactgaatgattaaataaaaacactgaattccrtattgtgcaggaaaaaaaaatcaagattagacctcagaaaaaattgacatgtctagtagaacttactatctgggcaaacttgaagagaagtgcaatggga

SEQ ID NO: 69919 - DNA, 201 bp, Homo sapiens
acccaggtagagtatttccacacctccaggaaggagagagtggtaaatgaagggtcttccagcagactctgaaatgaagaaggatgaaacttcaatgacayatctgtcaactaatgatgttcaccagaaagtttcaattttaaaagttctacaaggtgaatttttaagtcatctgaaatgtttcagtgaagagaatatgat

SEQ ID NO: 69920 - DNA, 201 bp, Homo sapiens
tcacccaggtagagtatttccacacctccaggaaggagagagtggtaaatgaagggtcttccagcagactctgaaatgaagaaggatgaaacttcaatgayatatctgtcaactaatgatgttcaccagaaagtttcaattttaaaagttctacaaggtgaatttttaagtcatctgaaatgtttcagtgaagagaatatg

SEQ ID NO: 69921 - DNA, 201 bp, Homo sapiens
gaagtttacggacacttggcacaaaaagccacgagagcctcacccaggtagagtatttccacacctccaggaaggagagagtggtaaatgaagggtcttcyagcagactctgaaatgaagaaggatgaaacttcaatgacatatctgtcaactaatgatgttcaccagaaagtttcaattttaaaagttctacaaggtgaa

SEQ ID NO: 69922 - DNA, 201 bp, Homo sapiens
ttattctttttatttattcctgttttttttttcatttcttgtatatacttcaaaaaggcaaaatatttataaagtccttctgagtatgaacactatgattygtaacctcatctttgcaatggaaaattcactagtatattaaattcaaccaatgggagaggttaggtagatgtatgatcacatgctggaagaagctacaga

SEQ ID NO: 69923 - DNA, 201 bp, Homo sapiens
tccctccaggtgaaggtaatgattaagaacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccccttccaggccccc

SEQ ID NO: 69924 - DNA, 201 bp, Homo sapiens
attgctagagcccaggagatcgagaccagcctaggcaacatggtaaaaccccatctctacaaaaaatataaaaattagctgggtgtggtggcatgcacctrtagtcccagctactagggaggctgttgcagaaggatcgcttgagccccagaggtcgaggctgcagtgagccatggtcatgccactgcactccagcctggg

SEQ ID NO: 69925 - DNA, 201 bp, Homo sapiens
tcacgcctgtaatcccaacactttgggaggccgaggtgggaggattgctagagcccaggagatcgagaccagcctaggcaacatggtaaaaccccatctcyacaaaaaatataaaaattagctgggtgtggtggcatgcacctgtagtcccagctactagggaggctgttgcagaaggatcgcttgagccccagaggtcga

SEQ ID NO: 69926 - DNA, 201 bp, Homo sapiens
ctaacatggtgaaaccccatctctactaaaattacaaaaaattagctgggcttggtggcgggtgcctgtagtcccagctacttgggaggctgaggcaggaraatggtgtgaacccaggagacggagcttgcaatgagctgagatcaccccactgcattcctgcctgggcaacagagcaagactccagtctcaaaaaaaaga

SEQ ID NO: 69927 - DNA, 201 bp, Homo sapiens
tgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagaga

SEQ ID NO: 69928 - DNA, 201 bp, Homo sapiens
tctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagc

SEQ ID NO: 69929 - DNA, 201 bp, Homo sapiens
atgttacctgtccatttccatcagagacatcatggacacagctgaaatactaggcctggccttttgtaagttcattagagcatcacaaacataactgcagmtattctcactgtttgtgactctgtgattcaaatgttttcacaaaccttccctggcactgcgtattagatggattgaaagatgctgaaacgtaaggccggg

SEQ ID NO: 69930 - DNA, 201 bp, Homo sapiens
cttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggcacatgccaccatgcccgactaatttatgtatttttaatagagatggggt

SEQ ID NO: 69931 - DNA, 201 bp, Homo sapiens
ttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctca

SEQ ID NO: 69932 - DNA, 201 bp, Homo sapiens
ggagacccaggatcagatacagaggacttcgttactcatggcagagcaaacagcatgagctttatttctgcactgattcccattgccctggcccctagtcmcacagggaggatgtggaacagcccggtagatgccgtgctcatagtacgtttcagtcatggctgaggagccccaagcttacaaaccccaacctttatcaag

SEQ ID NO: 69933 - DNA, 201 bp, Homo sapiens
ctggggccactcactaccactcatgagttaaggtgtatgaaaacggctttggtaacctccttcttgccatcatgaaactgcagcacgctaatactgtcagwctgtctcagaaacccctgccagccagaaggcttaactttgagatgaatgcaaagcagaatgaagcccaggaactttgggggtctgggctaaggctgatgc

SEQ ID NO: 69934 - DNA, 201 bp, Homo sapiens
cccttctccaccatccattccatgtgggcagaacacgtgactcatgggattactgggagcctgccatgctgttctgttttcaactcactacttttgtctgygctattctttcattcaggataccgccccaacctctccacctggctaaatcactcatcctttgagatgcagaagccaaagagatcctcagcacatacctcc

SEQ ID NO: 69935 - DNA, 201 bp, Homo sapiens
tttgaaaactaaaagggcatatcagaatagaaatctggctgttgaataacttgtaagctctgcagagacgtacaaaaacatggccactttagccagcagtrtggcgaaagtctggggcccacactacacacacacatatgaacttctcatgaccctcaagtatattcacatgatatatcacaaataccataaagcagcatt

SEQ ID NO: 69936 - DNA, 201 bp, Homo sapiens
caagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatcct

SEQ ID NO: 69937 - DNA, 201 bp, Homo sapiens
caatgataaaaaggaacttgccttattcacaggtacatccttggaacttagtaaagggcttaacctccatagcaggcagtcaagacttactgaatgattamataaaaacactgaattccatattgtgcaggaaaaaaaaatcaagattagacctcagaaaaaattgacatgtctagtagaacttactatctgggcaaactt

SEQ ID NO: 69938 - DNA, 201 bp, Homo sapiens
gggtgaaaggtaagggaacaagtggaactccatatccaaggtaggcacagtgtggaccagaagagcatccctaggacagtgaggtgatccacggactgacytgccccaaggccagagacgcaggagtggaaagtcacatggaaccatgagcttttataaggggcagggggcaggtgttgggaaattgcagaactagtgttt

SEQ ID NO: 69939 - DNA, 201 bp, Homo sapiens
acatcttctctttaggatccttaaagcataaaggcaagagccaagtctcagtaaactctgcatgggccacagctcggaaaagaaaaaaacctgttatatcrtgggagctcagtgcttgctgaactgaactgattcacatcatgacttgggattcatgaaccagaagcacaggaaattaataaaaactgaaaacgagccaaa

SEQ ID NO: 69940 - DNA, 201 bp, Homo sapiens
ttattgagtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttggggaaacttagaaagttcaaccacctggggataaagtttggaaaact

SEQ ID NO: 69941 - DNA, 201 bp, Homo sapiens
ctaatgacaagcactcctaaaccttcaacatagctgctgttaaggatgttgtcttgtgggggtgaaaggcagaccaaaatgatactaccaccctactcctyaccgatgagtcctttctgattttaagcaaatggcatacagtgtggtgaattaaaaacagcattatcctgattttattactagtatcattactattagcat

SEQ ID NO: 69942 - DNA, 201 bp, Homo sapiens
accaaaatgatactaccaccctactccttaccgatgagtcctttctgattttaagcaaatggcatacagtgtggtgaattaaaaacagcattatcctgatyttattactagtatcattactattagcattattgctactgctgttataggtaaaaatgggaacgttgtgaacatttcccattgcctatccaaggtgcttgg

SEQ ID NO: 69943 - DNA, 201 bp, Homo sapiens
catacagtgtggtgaattaaaaacagcattatcctgattttattactagtatcattactattagcattattgctactgctgttataggtaaaaatgggaaygttgtgaacatttcccattgcctatccaaggtgcttggtactttacatgatatctcacttaatcatcagaaagtttggagttattctataggtaatgagg

SEQ ID NO: 69944 - DNA, 201 bp, Homo sapiens
aagagcatcctgagtgcacctccactccctgccaccaggggtcagatgagccggcctggcaggcttgtttccctccaccagacaacagcaaggaccaagaytggcaaagtgacacatcctctccaaaagaagaacatgcagaacaaatcaaagaacacaaaccacgactgacaaacacagccacactcgattttaaagtac

SEQ ID NO: 69945 - DNA, 201 bp, Homo sapiens
ctaagtcctagaaatacatctgaggttgcaaacagtccatttcattcattattatatatatatatatatatctctatatagatatagataaatatatatayagatatacatatagagagagagagataaaacagaaaaaatctaaatgtctaaaggaccagatataagttaatcataaaacgatgacaacaaaaacaaagg

SEQ ID NO: 69946 - DNA, 201 bp, Homo sapiens
gtcccagtcttcctgctctcttggcattgccaataaaatccagaaacaccagggatgactcagtaccacagtcagtgcgtaaataagggataaagataccygttaaatccattgcctcaaagcaatcatgggagtttcttaagaatactgaacctcctctccgttttctgcactaaagagataaggagtggcatggagaat

SEQ ID NO: 69947 - DNA, 201 bp, Homo sapiens
agcaaggatggctgcccgctccttcctctgggagtctctgtcctcaagaggcatcgagctgattccagcagaaacgctcctgtgtaagttctctggcaacscctgctgggaggtctcacccagtcagaaggcacgggatctaggattcatttaacgaagcacttagtttacatttctgtaaactgcataggattttatcct

SEQ ID NO: 69948 - DNA, 201 bp, Homo sapiens
ctactccgatgccacgttaacaatgaaaaacaccataaagacaaaaagaaactgaatttaagcatttggattctgcagaggagtttattgaacagattaaytaaggaaaggcaaagctacacaattatggaaaacaggtagcaacactcaggctgactattttcgatggccacctgagagcggatttccaatgccctcatt

SEQ ID NO: 69949 - DNA, 201 bp, Homo sapiens
agagaggcaattgataataattatgttttctgccttctcttgggttatgaatttatcatgatgcaaaagtcgagctactccgatgccacgttaacaatgawaaacaccataaagacaaaaagaaactgaatttaagcatttggattctgcagaggagtttattgaacagattaactaaggaaaggcaaagctacacaatta

SEQ ID NO: 69950 - DNA, 201 bp, Homo sapiens
gacccgttcctaccctggatttctctgaatcagctactccttaagttcgtattttgttccactcagccaatggcaattccaggagagaggcaattgataayaattatgttttctgccttctcttgggttatgaatttatcatgatgcaaaagtcgagctactccgatgccacgttaacaatgaaaaacaccataaagacaa

SEQ ID NO: 69951 - DNA, 201 bp, Homo sapiens
tgggacccgttcctaccctggatttctctgaatcagctactccttaagttcgtattttgttccactcagccaatggcaattccaggagagaggcaattgayaataattatgttttctgccttctcttgggttatgaatttatcatgatgcaaaagtcgagctactccgatgccacgttaacaatgaaaaacaccataaaga

SEQ ID NO: 69952 - DNA, 201 bp, Homo sapiens
actgcactccagcccggtgacagagcgagactccatcttaaaaaaaaagaaaagaaaagaaaagaaagaaaaagaaaaacagctacagatattcattcctktttaatttcttgataaataatagaccagtaagaatcacataagaagcagtctacatttttcaaagagtttttacagatcccatttgatcttcaaaagggc

SEQ ID NO: 69953 - DNA, 201 bp, Homo sapiens
tccttttagaaacaaacaattacaaattagctgggcatggtggcgcacgcctgtagtcccagcaacttgggaggctgaggcaggagaattgcttgaacccrggaggcagagattgcagttagccgaaatagcaccactgcactccagcccggtgacagagcgagactccatcttaaaaaaaaagaaaagaaaagaaaagaa

SEQ ID NO: 69954 - DNA, 201 bp, Homo sapiens
cttttgacttggaagaattattagcattttgatttgatgggttcttagctcttcaaattcaaaaataccttattcaagtctaggagttttgcaaatacttyggttctaaagattaccctttttcgatgctttgaaaactaaaagggcatatcagaatagaaatctggctgttgaataacttgtaagctctgcagagacgta

SEQ ID NO: 69955 - DNA, 201 bp, Homo sapiens
ttccttctacagacttctaaaagacagtggaagcactgaatatccttttagaaacaaacaattacaaattagctgggcatggtggcgcacgcctgtagtcycagcaacttgggaggctgaggcaggagaattgcttgaacccgggaggcagagattgcagttagccgaaatagcaccactgcactccagcccggtgacaga

SEQ ID NO: 69956 - DNA, 201 bp, Homo sapiens
tggctcacgcctgtaatcctagcactttgggaggccaagacaggcggatcaccaggtcaggagatctagaccatcctggctaacacggtgaaaccccatcyctactaaaactacaaaaaaattagccaggtgtagtggcaggcgcctgtagtcccagctactcgggaggctgaggcagaagaatggcatgaacccgggagg

SEQ ID NO: 69957 - DNA, 201 bp, Homo sapiens
gatgatttgctataatcctataaataatacaaagcttgtcactgtaaatatgtattgtgttatctagaggtatattcagtggctaaaacaataaaagctcrtctacgtctcctggcaatctcaaggcataattaatcgctggtaagatgtattctagaacgtgagagcccttaagtagaaggaaaaataaaggccattgtc

SEQ ID NO: 69958 - DNA, 201 bp, Homo sapiens
gtgtcttcttcagctcttgaacctggtgcctttcctattgaggttaataggggttcagcatgacagcacctccacctcccatggcacagcatatgtacccrataagcagtccttacaataccaatagtttctatctgttgggcactgccaattagccaggcatgtcaaatggaagatctcacttaatcttgccaaaaaaaa

SEQ ID NO: 69959 - DNA, 201 bp, Homo sapiens
cggcgtctattacctatccagtgtgacaataaatgaggccaggtgcacacctctgttacctattattctccacaagaatggcagcaaagcagtgagacctragctatacaagaaaataatacaggaagaaagaaataaaggaagaaaggaagaagaaggaaaggaaaagaaaagaaaaggagaggaggaggaggagaagga

SEQ ID NO: 69960 - DNA, 201 bp, Homo sapiens
ctcagccctctgattactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggct

SEQ ID NO: 69961 - DNA, 201 bp, Homo sapiens
aaatttaacttacacagtcaatttcttaatgcaagttatcagaattggtggagaaaaatgtgaattacaactgtgattcgagaacccaccacattataactatatatatatatatatatatatatatatatatatatatatatacatagatagatagatagacagacacacacacacacatggcaaatgggcccacataca

SEQ ID NO: 69962 - DNA, 201 bp, Homo sapiens
aagtgaagaaactgcatctccaagatcctgctatatcaacttcagttttttgaagttaaatttgatttttaaatcccttggctgatgagacctgtgtgggttttttttttgttgtttttttgttttgttttgttttgttttatcattgtacctctattttaaaaatagagacttgtggttctttttccaaaagcagtccaa

SEQ ID NO: 69963 - DNA, 201 bp, Homo sapiens
aatttaacttacacagtcaatttcttaatgcaagttatcagaattggtggagaaaaatgtgaattacaactgtgattcgagaacccaccacattataactatatatatatatatatatatatatatatatatatatatatatacatagatagatagatagacagacacacacacacacatggcaaatgggcccacatacaa

SEQ ID NO: 69964 - DNA, 201 bp, Homo sapiens
atatatatatatatatatatatatatatatatacatagatagatagatagacagacacacacacacacatggcaaatgggcccacatacaacatgttttaraaattgtgatattgcaagtggagcctcaagctgagatctgagattgttcttccatagtctccctgattcccaaacacgtagttgcaatcagacttttttt

SEQ ID NO: 69965 - DNA, 201 bp, Homo sapiens
atttataaaggctgtatattaacattcacaaaggtttttaaagatggaatagctatgtacacagtgaatttattctaaaatccagactcaaaaaaaaaaawgaatatgaactcctccccaccgtgttctggactaaaatcaataagttccctttaggtaattaaaatgctggtcccacgacctgccatcctattcccaggc

SEQ ID NO: 69966 - DNA, 201 bp, Homo sapiens
cttcacatcatatttgattaaaaccaaatatttatgaatcaataaaaatttcatactttcattattacttgtaatttatatttaaattttaatcaataacttttttttttttttttttttgagatggagtcttactctgtttcccaagctggagtgcagtggtgtgatctcggctcactgcaacctccacctcccgggttc

SEQ ID NO: 69967 - DNA, 201 bp, Homo sapiens
tttgggaggccaagacaggcggatcaccaggtcaggagatctagaccatcctggctaacacggtgaaaccccatccctactaaaactacaaaaaaattagmcaggtgtagtggcaggcgcctgtagtcccagctactcgggaggctgaggcagaagaatggcatgaacccgggaggcggagcttgcaatgagccgagatcg

SEQ ID NO: 69968 - DNA, 201 bp, Homo sapiens
gtagtttgctgggggtctactccagaccctgttcacctgggtccctcccacaccaggaggtgtcacctgtggaggctgcagcacagcaaggatggctgccygctccttcctctgggagtctctgtcctcaagaggcatcgagctgattccagcagaaacgctcctgtgtaagttctctggcaacccctgctgggaggtctc

SEQ ID NO: 69969 - DNA, 201 bp, Homo sapiens
gcaggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataaga

SEQ ID NO: 69970 - DNA, 201 bp, Homo sapiens
ttctcaaccttgtgtattaatagtttaaacctaagttaattttacatttataaaaatggggtcgaacatggtggctcatgcctgtaatcccagcactttgsgaagccaaggtgggtggatcacttgagcccaggagttcaaaaccagcctggccaacatggtgaaactccatctctacaaaaattagctgggcatagtggc

SEQ ID NO: 69971 - DNA, 201 bp, Homo sapiens
caggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaa

SEQ ID NO: 69972 - DNA, 201 bp, Homo sapiens
ctacaaaaattagctgggcatagtggcgtgtgcctgtagtcccagctagtcggcagactgaggcaggagaattgcttgaacccgggaggcagaggttgcaktcagccgagattgtgccactgcactccaacctgggtgacagagcaagactctgtctcaaaaataaatataaataaaaataaaatggaatacagtctctct

SEQ ID NO: 69973 - DNA, 201 bp, Homo sapiens
aggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaag

SEQ ID NO: 69974 - DNA, 201 bp, Homo sapiens
tatttgtttgttttatttgagcttggtgatttgaaagagctgtttacttattaagcagatgaactatatgaacagacagttttttaaaactctatttctamctcaaacacatacttacagaactaattcaaaatggtgcttcttttattaacgtggtgctaaattactttatgagttcttaaagattcttatttttggcac

SEQ ID NO: 69975 - DNA, 201 bp, Homo sapiens
gagacatgaagtctcatggtgtggtagacaggccacacaagactggaagtctgaagtgtgctcacttcatggagtaaatgtgtagccttgaatgagttacttttttttttttttttttttttttgagatggagtcttgctctgtcgcccaggatggagtacaatggtgcagtctaggctcactgcaacctctgcctcccgg

SEQ ID NO: 69976 - DNA, 201 bp, Homo sapiens
ccatcgcctcaagctaatcactctaagtcctagaaatacatctgaggttgcaaacagtccatttcattcattattatatatatatatatatatctctatayagatatagataaatatatatatagatatacatatagagagagagagataaaacagaaaaaatctaaatgtctaaaggaccagatataagttaatcataaa

SEQ ID NO: 69977 - DNA, 201 bp, Homo sapiens
tgatgcctctggggccaaacacaggggatacattttcccagtagaagaaatcagccctgatcctcaagaagaagaacatattggcatattttagtgagackgaggcatactgcatcttggggtaaaaactgaatcatcaggccaggcacggtggctcacgcctgtaatcctagcactttgggaggccaagacaggcggatc

SEQ ID NO: 69978 - DNA, 201 bp, Homo sapiens
caaaatgaatagtcataaaagtataataacctagactggaaaatttagggattagagcattttgaacattatacctcaaatttataaaggctgtatattarcattcacaaaggtttttaaagatggaatagctatgtacacagtgaatttattctaaaatccagactcaaaaaaaaaaaagaatatgaactcctccccacc

SEQ ID NO: 69979 - DNA, 201 bp, Homo sapiens
tgatatttccctccattaacatcacgaacatcattacgtgtgtgtgtgtatttttctcattttaaaaccagcagatgagagtaaaggatttctttttcctytcccccacctctttacaggacctactgttaagttttcaagaccacccagaaagaaatttgaagttgggtttatatccttaatccctcagttagaaaaaaa

SEQ ID NO: 69980 - DNA, 201 bp, Homo sapiens
gtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctccca

SEQ ID NO: 69981 - DNA, 201 bp, Homo sapiens
tcccatctcggcctcccaaagtgctgggattacaggtgtgagccaccgggcccagccgtaggaacacagatattatcatcatgggacaagtcatccattcycagattccatgaccctctctggtgtccactgtggatttcagcacatgtttaactatgaaactctagtcacgctttttgatatacaggttcatggttacta

SEQ ID NO: 69982 - DNA, 201 bp, Homo sapiens
ttgtcacccaggctggagtgcagtggtgcaatctcggctcactgcaacctccacctcccaggttcaagtgattctcctgcctcagcctcccaagtaggtgrgattacaggcacctgccaccatgcccagctaatttcttttgtatttttagtggagacagggttttaccatgttggccaggctggtctcaaactcctggcc

SEQ ID NO: 69983 - DNA, 201 bp, Homo sapiens
cctgggttcaagtgattctcctgcctcagcctcctgagtagctgggattacaggcatgcaccaccacaccggctaacttttgtatttttagtagagatagsgtttcaccatattgatcaaggtggtcttcaactcctgacctcgtgatcctcccatctcggcctcccaaagtgctgggattacaggtgtgagccaccgggc

SEQ ID NO: 69984 - DNA, 201 bp, Homo sapiens
ctcggctcactgcaacctccgcctcctgggttcaagtgattctcctgcctcagcctcctgagtagctgggattacaggcatgcaccaccacaccggctaayttttgtatttttagtagagatagggtttcaccatattgatcaaggtggtcttcaactcctgacctcgtgatcctcccatctcggcctcccaaagtgctgg

SEQ ID NO: 69985 - DNA, 201 bp, Homo sapiens
tgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaa

SEQ ID NO: 69986 - DNA, 201 bp, Homo sapiens
gggtcattaattagcaacctcggttccagataccaaaatatgaggaaggctatagtactcgggtcctgcttcaatattgtgatttgtttttcttatctacktctctttttcttcccttattttgctcacaatgccttctgaggaaagacaagacctttcttataaaaggaaaaatatccatgtctctacccacagagtcca

SEQ ID NO: 69987 - DNA, 201 bp, Homo sapiens
tttatgacactgaaatcagaattccatatcattttcctccttcaagaaataatattctcctctttattcttttttgcagatgattgaaaatgtaagaactrttctgagcctgcaggccatagccaaagaggtaccggctgtattttgtccatgggcaggagcttgtgactgctggtctaggtcattccaggtcaaccaggg

SEQ ID NO: 69988 - DNA, 201 bp, Homo sapiens
atcgctgactgccataggtcagccaggccctggtctcagtcaggaccaactctgctgtacaattcaccctccagagcttcccgtgggatcaagctgaagcwgatcttcagctaagccacatccttcctggacattttccctgtccttttttttttttttttttttttgagatggagtgttgctcttgtcactcaggctgga

SEQ ID NO: 69989 - DNA, 201 bp, Homo sapiens
tggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatacagaggacttcgttactcatgg

SEQ ID NO: 69990 - DNA, 201 bp, Homo sapiens
gttcattagagcatcacaaacataactgcagctattctcactgtttgtgactctgtgattcaaatgttttcacaaaccttccctggcactgcgtattagayggattgaaagatgctgaaacgtaaggccgggcacggtagctcacgcctgtaatcccaacactttgggaggccgaggtgggaggattgctagagcccagga

SEQ ID NO: 69991 - DNA, 201 bp, Homo sapiens
agccctggcataattcaggataacaaacaacacaaggtgcaaaaatagaagtaagtacacatcaagtggacatggagcttcctgttagatttgaccttccrcataatcaccacaaaggatttaaaacaattaagttgaagtttacggacacttggcacaaaaagccacgagagcctcacccaggtagagtatttccacacc

SEQ ID NO: 69992 - DNA, 201 bp, Homo sapiens
ggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaagc

SEQ ID NO: 69993 - DNA, 201 bp, Homo sapiens
gagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaagca

SEQ ID NO: 69994 - DNA, 201 bp, Homo sapiens
ctgcagctattctcactgtttgtgactctgtgattcaaatgttttcacaaaccttccctggcactgcgtattagatggattgaaagatgctgaaacgtaasgccgggcacggtagctcacgcctgtaatcccaacactttgggaggccgaggtgggaggattgctagagcccaggagatcgagaccagcctaggcaacatg

SEQ ID NO: 69995 - DNA, 201 bp, Homo sapiens
taatagaattcagaaagaaaaggaggtactcatcaaggcactctgctaaggtttgactaatgggattccacatggtctgcatgtttatggcttaaatgagstaccaacactgaaactgtccacttaattagcccccaaaacaagaagtacagactgtgagtctgagacctacagagactccaaaaacagaaactaccatcg

SEQ ID NO: 69996 - DNA, 201 bp, Homo sapiens
atctgtgccccatgcctgtcccgtggaacacaggccaaacagaggattgaggtcctgagtttggagttaaatgaagattgccaggtagaggttgttagggsgagggtgttaagtgaaggtgtgatataaaccacatgacatttgcaggtggttatggttttcctgcccagcccaccgccaccactggactgtagggaggtg

SEQ ID NO: 69997 - DNA, 201 bp, Homo sapiens
atatgattaagtatcaaatactgtcatatcagtagaactaaaatataccaagtagtatccctagtttccagcccagctccaaatttttaaacgacaaacctttttttttttttggtaatatttattcattgactattgatatttaactgttttcacaatgataaagtagctcattaagaaacaaataaagacataaaatca

SEQ ID NO: 69998 - DNA, 201 bp, Homo sapiens
agaagtatccatcacataactggcctttaaaccatgtaaaactcattgatacccacatgggaggccaaagaaacgcaatttccaactcaagaaactatcamacaaaatcccaacatgttctagacaccactggataagaaatttgagggagtaccccgaataaacaaacattcacaatcattcacaatcattcagcattac

SEQ ID NO: 69999 - DNA, 201 bp, Homo sapiens
agccccttacctcccatctgtggtcagatatcacgaatgggaaatgaattcaccatgctaagccactgagatccgggcgtgtttgttacagcagcacactccagtgcagctggcctgagaaaagccattttaagcagttcaagttccatcctgtgttccatgtctttctcaagaggttggcttttactttgccttccagca

SEQ ID NO: 70000 - DNA, 201 bp, Homo sapiens
tgactaagcagtgtgtcattagccctctggtgagaaaacgcaggatttagttccttatgagagacagagaaagagagagagacagagaaagagagagagastgtgtgtctgtgtgtgtgcacgcgcgtgtgtgtgtcaggtttcaactgtgggtaaattagcacttgccttccaaagagaccagcagcaactacaaaagtt

SEQ ID NO: 70001 - DNA, 201 bp, Homo sapiens
ttctgcactgattcccattgccctggcccctagtcccacagggaggatgtggaacagcccggtagatgccgtgctcatagtacgtttcagtcatggctgargagccccaagcttacaaaccccaacctttatcaagcaaatctgccaaaccgttgtcctggaaggaggcactgtctttattatactggaaagaaagccatc

SEQ ID NO: 70002 - DNA, 201 bp, Homo sapiens
cataaaatccttatctaccaagatttacctctgcaaacctctacagtccctggttgtgagcccctgatggaagaagctagcataaagaagttcacaactastggggagggaacgacctgacaagttgcaagcaagaaaggagtgaaaaactgagttaattgtacaagaatttgtgtatttataaatgcaggataaataaga

SEQ ID NO: 70003 - DNA, 201 bp, Homo sapiens
acaaggcttagctcttgggtcattaattagcaacctcggttccagataccaaaatatgaggaaggctatagtactcgggtcctgcttcaatattgtgattygtttttcttatctacgtctctttttcttcccttattttgctcacaatgccttctgaggaaagacaagacctttcttataaaaggaaaaatatccatgtct

SEQ ID NO: 70004 - DNA, 201 bp, Homo sapiens
ctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggt

SEQ ID NO: 70005 - DNA, 201 bp, Homo sapiens
tacaaaattagccgggtgtggtggcacatgtctgtaatcccagctactcgggaggctgcggcaggagaatcgcttgaacctgggaggtagagatcacggcragccaagatcacaccactgcactccagcctgggcaacaagagcgaaactccatctcaacaacaacaaaaaaagtaatttagcacatatactgcatattac

SEQ ID NO: 70006 - DNA, 201 bp, Homo sapiens
ggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatata

SEQ ID NO: 70007 - DNA, 201 bp, Homo sapiens
agccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagcaacaggaggaagcagaccaaggagggagagaaaggaaggcagaga

SEQ ID NO: 70008 - DNA, 201 bp, Homo sapiens
tgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatgg

SEQ ID NO: 70009 - DNA, 201 bp, Homo sapiens
aacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctgagccgcagtgaagggctttcagaggggc

SEQ ID NO: 70010 - DNA, 201 bp, Homo sapiens
ttagatttgaccttccgcataatcaccacaaaggatttaaaacaattaagttgaagtttacggacacttggcacaaaaagccacgagagcctcacccaggyagagtatttccacacctccaggaaggagagagtggtaaatgaagggtcttccagcagactctgaaatgaagaaggatgaaacttcaatgacatatctgtc

SEQ ID NO: 70011 - DNA, 201 bp, Homo sapiens
aaatactaaaacatgggatgccatgttttttccatgttaacctaatatttcatgcattaaggtggaataattacattgaagcacagttttcttaattagcycaggtatatttcctggggaaggaataacttattgcaataactggtgttgggacaatgaactactcatctggagaaaatcagctggatccttacccaattc

SEQ ID NO: 70012 - DNA, 201 bp, Homo sapiens
aagggatttttgttcaggtggtgaagaagtgtgtgtgtctgtatgtatatacatacccacgtagtttttaataaattataaatcaagatgtttaccaagcyaacttgtcaattttaactcatttctgttatttgtttacacacacctccatctgacaaatatatacaaaacaatgtatgtgtatgcacatatacatacata

SEQ ID NO: 70013 - DNA, 201 bp, Homo sapiens
actaggtgcaagtaataacgggtgcattgttcgctaaggacttaaaagtattaataaaagtgaccaaagtttaactgctttttatcatcaccatgcttggygattccaaacaatgtcagtgaaaacagattcctcctgctggcaggggggcggccacacccatcacaccccctcttggcaccgccatgattttacacactg

SEQ ID NO: 70014 - DNA, 201 bp, Homo sapiens
tacccctcatcagctgatcaattgctcgcacttccaggcaagcacccatcactccccaccaaacacaccgccccacgccacctgaacaaggttaaaagaayggactcatgactgatggtcggggggaactggcttcagaagaggaagttgaaaatattaagaaatcaacacgggcatttaaaagcaaagccttttccatgc

SEQ ID NO: 70015 - DNA, 201 bp, Homo sapiens
tatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgt

SEQ ID NO: 70016 - DNA, 201 bp, Homo sapiens
acagaagacgttttgctattcatcttgttccctgactctgcttcaccaacttgatggaagatggtttaactgacataaaaaccagctatacatgaacagcrgtgattgatggaaccattccaaacatcagccaaaaatggcactgaaagatgccttgggcttcctgttaactgttttatgaggggaccaacaggtttcccc

SEQ ID NO: 70017 - DNA, 201 bp, Homo sapiens
aataaatgcaagcttctcagtggatatccttaatcctgattttagaatgagtccaaaaagaaattgccagagtgaataccaggtaacagaagaaatgatgrgcatgtttctctgtagaacaacctcccttccctagccgctaactatggtggtacttactcatcacattctagctcagaactgccattctggtcctttcat

SEQ ID NO: 70018 - DNA, 201 bp, Homo sapiens
ataaatacctgaaattcttcaattgtaagttttcctactctggcaattttaaggaaagtgattcttgaggctgtgggtgaaataccacattcatttttttwaaaaaaataaggtatacttacttgtactttctaccattttatatatattctctgtttaaattgtgtagcccctaatagactgcaaagacaatgataaaaa

SEQ ID NO: 70019 - DNA, 201 bp, Homo sapiens
taagtattacttagcaaaacagctatgacccaaaatagcatctgttatatgtttgttattcacttcagtaatgactgaaagtgaataaataaaacttgctyggaaaaataaggttttgaaggaagataaaaactgtacatttaagtgtatgaaatcagaaagacataaggtaatagaagtatccatcacataactggcctt

SEQ ID NO: 70020 - DNA, 201 bp, Homo sapiens
ttgattcatttgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaag

SEQ ID NO: 70021 - DNA, 201 bp, Homo sapiens
gaaacagaaggggaaaaaaaaggtaggaggtcttttgcatgttagtatatgtatgaagggagttaggacctggcaaactgggttatatgaggctttttccrtacacagctctttggtttcacggtacatgatttaaataggttgtatttaattccatgtaataacaaactgtgccattaagtagttctcctgtacaaatgc

SEQ ID NO: 70022 - DNA, 201 bp, Homo sapiens
tccttttttttttttttttttttttgagatggagtgttgctcttgtcactcaggctggagtgcaacggcacgatctcggctcactacaacctccacctccsaggttcaagcgattctcctggctcagcctcctgagtaactgggactacaggcgaacaccaccactcccggctaattttttgtatttttagtagacatggg

SEQ ID NO: 70023 - DNA, 201 bp, Homo sapiens
ccacggcaattcactaaaaacgccttaaaaaatcattagctctcatttattcaacttgaacatcagcatggcctgaagctcgggaagaaacagactggcawagtgacgctgccagcaccaagtaaagttttacctcccagcgctccaggttcccagcaagacttccagccagggctgccttccactccatttcagcctggc

SEQ ID NO: 70024 - DNA, 201 bp, Homo sapiens
cattctaacccatctgctatttgttcacttgcacacactcactgtgcaataaaccctttcaatgtgggagacaagtgcaagatgcccctctttccccaaarggcacctctgtgtgctccctcagatcatagctgatgacatgtcaatgaaacggtgcttgctctcatcccagagatcaaaatgagggcttaacctgcaatt

SEQ ID NO: 70025 - DNA, 201 bp, Homo sapiens
aatcgtgtgacatctcagagatgatagcatatactgttgttttgcttgatgacgataacacaattctttttgaactaagtatctctctagactacaactgsgtcaaaattatagatattttttgtggccctggatgaattttctatttgccaaaactcaaaggattcaaaaccaggttgatgtctagttaaagatgatgct

SEQ ID NO: 70026 - DNA, 201 bp, Homo sapiens
ttctcctgcctcagcctcccaagtagctgggattacaggtttgcgccaccgcacctggctaatttttgtatttttagtagagacagggtttcaccatgttrgccaggctggtctcaaactccaggcctcaagtgatccacccgcctaggcctcccaaagtgctgggattacaggtgtgagccaccgcatccggcccttgta

SEQ ID NO: 70027 - DNA, 201 bp, Homo sapiens
tgctcctatgagaattcactggataagggctgtacatttcgggcccgcctacttcattccacaggaattagtaactgcaggtgcaagtgttgctactgctmgaaggctaagccctgataaggcctggggaggcccagagactaacaaatgggtttcttccaggactttgctgctgattgatcactgcacttaatcctttcc

SEQ ID NO: 70028 - DNA, 201 bp, Homo sapiens
taaaaccgtttcaaagaaaagaaaaaacaacaacaacaaaaaagttatgccataggaagcatgaagcctcatttactaaagtggagaaatgtattttattytattgtccttatggcgttgattgccagttctgacacatattacaaatttcacattgtttttctgaatgctgaggtcagacctaccataagcttgtcccgt

SEQ ID NO: 70029 - DNA, 201 bp, Homo sapiens
cctcgttctggtgctgagccatcctacggggcttcatggagcttgtttcttgatacacatgagggtcgtaatccctcccttctaacttaattttttttttwatttttatttttcagagacagggtctcactctgttacccagctggagtacagtggctcactataatgttgaacttctgggctcaagtgatcctcctgcct

SEQ ID NO: 70030 - DNA, 201 bp, Homo sapiens
ctcgttctggtgctgagccatcctacggggcttcatggagcttgtttcttgatacacatgagggtcgtaatccctcccttctaacttaatttttttttttrtttttatttttcagagacagggtctcactctgttacccagctggagtacagtggctcactataatgttgaacttctgggctcaagtgatcctcctgcctc

SEQ ID NO: 70031 - DNA, 201 bp, Homo sapiens
aaagtctggggcccacactacacacacacatatgaacttctcatgaccctcaagtatattcacatgatatatcacaaataccataaagcagcattgtaatwacagggaggaattgattttaaaaggcctacatcaaaatgaatagtcataaaagtataataacctagactggaaaatttagggattagagcattttgaaca

SEQ ID NO: 70032 - DNA, 201 bp, Homo sapiens
ttaatgcctgcagagtgtgtgtggctagtatgatgatttctctgctcaagtttgttgattgattttgtagaaatgtccacaggagataaaatctgcaaacwcctcaaagatgagactgtgtccaagaaaagagtaatgatactttataaaacaagaagtaagtgacatttgaaacgatggttcatctcaaacaacacattt

SEQ ID NO: 70033 - DNA, 201 bp, Homo sapiens
ggagggaacgacctgacaagttgcaagcaagaaaggagtgaaaaactgagttaattgtacaagaatttgtgtatttataaatgcaggataaataagatcaygtagaaactctctttagacttccatccttactgctgtaattgaacgaacagacgaatgtgtttgaccgcaattgccctaatactatttttcccataaata

SEQ ID NO: 70034 - DNA, 201 bp, Homo sapiens
gatactttataaaacaagaagtaagtgacatttgaaacgatggttcatctcaaacaacacatttcctctgagctccatgtttatgttaacatgtaagtttrggaatgctgatgtaatagacaaagataactcttgccacttcaaagtagcaggcatgcctaggtgggcaagaggttcagaaagccagcacttaaggtgttg

SEQ ID NO: 70035 - DNA, 201 bp, Homo sapiens
ttctcactgtttgtgactctgtgattcaaatgttttcacaaaccttccctggcactgcgtattagatggattgaaagatgctgaaacgtaaggccgggcayggtagctcacgcctgtaatcccaacactttgggaggccgaggtgggaggattgctagagcccaggagatcgagaccagcctaggcaacatggtaaaaccc

SEQ ID NO: 70036 - DNA, 201 bp, Homo sapiens
gctatgtccacgccgccctcttccccagcagacactggctcatcgctgactgccataggtcagccaggccctggtctcagtcaggaccaactctgctgtasaattcaccctccagagcttcccgtgggatcaagctgaagctgatcttcagctaagccacatccttcctggacattttccctgtccttttttttttttttt

SEQ ID NO: 70037 - DNA, 201 bp, Homo sapiens
acattcttcaaatctgatgcctgttatgtaaaatttccagatttcaaaatgtatcctttttcctgcatttatctcgctttccttcacacccggggggagtytgttaaactgcagtgaccactggcagagtcccaagccaagccaaaccgtgcaaacatgaaacggccccacaaatcatgcaaaccctacacgctgtccctg

SEQ ID NO: 70038 - DNA, 201 bp, Homo sapiens
tcccatgacacttgccagatctgaagacttcattctaatcttccctgttgaaaaaataatcaaatactccaacaaagatgtattgacaactcttaattaamcatgctaatggagggaagagatagcatggataaatgaaatccacacataacccaaaaccttccttccccattaatttccaacttcttgactaaaccttac

SEQ ID NO: 70039 - DNA, 201 bp, Homo sapiens
tggacattttccctgtccttttttttttttttttttttttgagatggagtgttgctcttgtcactcaggctggagtgcaacggcacgatctcggctcactrcaacctccacctcccaggttcaagcgattctcctggctcagcctcctgagtaactgggactacaggcgaacaccaccactcccggctaattttttgtatt

SEQ ID NO: 70040 - DNA, 201 bp, Homo sapiens
ctcatgaccctcaagtatattcacatgatatatcacaaataccataaagcagcattgtaataacagggaggaattgattttaaaaggcctacatcaaaatkaatagtcataaaagtataataacctagactggaaaatttagggattagagcattttgaacattatacctcaaatttataaaggctgtatattaacattca

SEQ ID NO: 70041 - DNA, 201 bp, Homo sapiens
attctcctggctcagcctcctgagtaactgggactacaggcgaacaccaccactcccggctaattttttgtatttttagtagacatggggtctcacatcayattggccagcctggcctcaatcgcctgacctcgtaatctgcgcacctaggcctcccaaagtgctgagattacaggcgtgagccactgcgcccggccacat

SEQ ID NO: 70042 - DNA, 201 bp, Homo sapiens
gtaactgggactacaggcgaacaccaccactcccggctaattttttgtatttttagtagacatggggtctcacatcatattggccagcctggcctcaatckcctgacctcgtaatctgcgcacctaggcctcccaaagtgctgagattacaggcgtgagccactgcgcccggccacattttccctgttctaagccactctt

SEQ ID NO: 70043 - DNA, 201 bp, Homo sapiens
caacaataataataaattatatatttaaaaatttgttaaaagggtaggtctcatgttaagtgtttttaccacaataaaatatttgtttaatgtcctctacrtggctattatgattggaaaaggcataccttgaacagagatgaataaatctgcatatctgtgaaatgtcagttcagcatgttgatcgtcagtaatcttttc

SEQ ID NO: 70044 - DNA, 201 bp, Homo sapiens
actacaggcgaacaccaccactcccggctaattttttgtatttttagtagacatggggtctcacatcatattggccagcctggcctcaatcgcctgacctygtaatctgcgcacctaggcctcccaaagtgctgagattacaggcgtgagccactgcgcccggccacattttccctgttctaagccactcttctcatttcc

SEQ ID NO: 70045 - DNA, 201 bp, Homo sapiens
accaccactcccggctaattttttgtatttttagtagacatggggtctcacatcatattggccagcctggcctcaatcgcctgacctcgtaatctgcgcayctaggcctcccaaagtgctgagattacaggcgtgagccactgcgcccggccacattttccctgttctaagccactcttctcatttcctttctgaaagcat

SEQ ID NO: 70046 - DNA, 201 bp, Homo sapiens
atcaatgagatggaaacaggaatgctcttaatgcagtgcaatttacaaaagaactgttctttgctgaccactagtaagagaccatccaacaggctcctttytgaagccacatcccgaaaagatcccctcctgatgtctctagaaacatgcaaaaataaaactgcaacgtcagaaccataaaaggatcatagcagattgacg

SEQ ID NO: 70047 - DNA, 201 bp, Homo sapiens
ggttgggggcgggggggaaagaataatattttgtgacacatgaaaatgtatatgaaattcaaattccagtatccataaataaagtttctcgcagccatgcytgctcctttacatatcgtttatgcctgtttttgcactatgagggcagagttgagtagttggcaacaaacactacaaggccccaaaatatttattaaatat

SEQ ID NO: 70048 - DNA, 201 bp, Homo sapiens
atttgaatcactggggcggagccctcatggcttggcgctgtcttcaccacagtgagtgagatctctggagatctggtcattttaacccttttcccatttgmcccaagaatacttactggtgtgcagtgtttaccctgagatcgctttgccatgaaatatctcgcttttattatttttttcacatcactctagcatatcgac

SEQ ID NO: 70049 - DNA, 201 bp, Homo sapiens
gtgcagtgtttaccctgagatcgctttgccatgaaatatctcgcttttattatttttttcacatcactctagcatatcgactttggaaacgaaggatatcrttctatttatagccttctgtttttagtagtggtatttccatttacaaaatataatagttctccatcactgaaaatgtcaaatccgagaaaatgtagcatt

SEQ ID NO: 70050 - DNA, 201 bp, Homo sapiens
ttttagtagtggtatttccatttacaaaatataatagttctccatcactgaaaatgtcaaatccgagaaaatgtagcattcctgcatgtgatgttaacatmattctcgaacagttgttggctgaagattcatttgatgaatccgatttttccaaaatacacaattctgatgattcagatgattctgatgttagttctgttc

SEQ ID NO: 70051 - DNA, 201 bp, Homo sapiens
aagttctggctcaggcattcttctcatcagtaattacaaacctaaaaattacgatctacatttgagtggaacaaaatggactggtggcacttctttctttyctttctctctctctctctctgttgacagccccatcacaaagtctctgcaaagctatgataacctcacggtaagtaacaaatcaactgcagccagcaaggg

SEQ ID NO: 70052 - DNA, 201 bp, Homo sapiens
cattgccctggcccctagtcccacagggaggatgtggaacagcccggtagatgccgtgctcatagtacgtttcagtcatggctgaggagccccaagcttasaaaccccaacctttatcaagcaaatctgccaaaccgttgtcctggaaggaggcactgtctttattatactggaaagaaagccatcctgtcctctgctcct

SEQ ID NO: 70053 - DNA, 201 bp, Homo sapiens
agggcaggtctgtaagtctaaatatcccctcctcctgagttcctgtcctgtcccctttgcctgaccttctccaactgttctcattagattatacttcatgsaaaggggcatatatgccttatatgctggatggtaagctggggacaggggcctgtcatctctggtgtccacaggaagtcaactgaatggctgcatctgccc

SEQ ID NO: 70054 - DNA, 201 bp, Homo sapiens
aaagagattgctccaaacagactgaaggtcccttgagagcaaatgtagacttctgtaaatctgatcttctaacaggaagatcagaatagcagaatactttrtatctaccagagattctctgtatctaacagaatgctctgtatctaacagagatacactgtatctaacagagaccgaaatatatttgttgaatgaagacag

SEQ ID NO: 70055 - DNA, 201 bp, Homo sapiens
aacagttgttggctgaagattcatttgatgaatccgatttttccaaaatacacaattctgatgattcagatgattctgatgttagttctgttcagaaatawttccaagaactgtttttatattttattatcactttgaaaatcggtcacatttgcttcagcttcaaagagcatgtttatgtaaaattaaatgagcgctggc

SEQ ID NO: 70056 - DNA, 201 bp, Homo sapiens
tgagagttaccttttgacttggaagaattattagcattttgatttgatgggttcttagctcttcaaattcaaaaataccttattcaagtctaggagttttscaaatacttcggttctaaagattaccctttttcgatgctttgaaaactaaaagggcatatcagaatagaaatctggctgttgaataacttgtaagctctg

SEQ ID NO: 70057 - DNA, 201 bp, Homo sapiens
ggatgacttccacttgggtgccccacaggcgtcatgaattcagtatgactgaaaaggactcctcctatcttcagcgatggttccactacacaatacactgkccaagccagaagtcccaaactagccttctgtccttccttctccattcaccacgcctgtcatccccttcagagctgttggccaaatcttgttgattttacc

SEQ ID NO: 70058 - DNA, 201 bp, Homo sapiens
tgctttgaaaactaaaagggcatatcagaatagaaatctggctgttgaataacttgtaagctctgcagagacgtacaaaaacatggccactttagccagcrgtgtggcgaaagtctggggcccacactacacacacacatatgaacttctcatgaccctcaagtatattcacatgatatatcacaaataccataaagcagc

SEQ ID NO: 70059 - DNA, 201 bp, Homo sapiens
gaggtcaggctcgcacagaagcatacttatggtcagagttagtcaataaaaaaagtgatctattctgagttccataccaccccaaaacactgatcagcttsgggaaacttagaaagttcaaccacctggggataaagtttggaaaactaggctagggccaattcagggtacaggtggaggctaggaagtttggcataggat

SEQ ID NO: 70060 - DNA, 201 bp, Homo sapiens
agacaaaatgatgcccatttcccaaccaaagatgtccaggtcctaatccctgaaacccgtgaatatggtagactgcgtggcaaaggagaattcaggttacyggtgaaattaaggttgttaattacctcgcattaaaatagggagaggggctgggtgtggtggctcacacctgtaatcccggcagtttaggaggccaaggca

SEQ ID NO: 70061 - DNA, 201 bp, Homo sapiens
gaacttgagattcccagtgatattccaatgctgaaacagcccagcaaggtgatgcaggtaagcacgcttgtaggatgtaacaatgtgaaacctcagcacaytgtggttatgtttcaaagcacgaggtgacggaagcaagagcgagtttacatgggcttgtgatttcctttgacaagatacacgcactcattccttcaacct

SEQ ID NO: 70062 - DNA, 201 bp, Homo sapiens
gccgtaaaaaaaatttgatgattttgaggcttaacatcaaataccagtgagatcacaagttagatatgacatcatacacatcatttctgctgaaaaagtayctttagttaaaaacagaaaccaatttgtaaatgtgaattaaatgcatactccacaaaaaaatacctggtgaaagtaaaaaaaaaaaaaaaaaaaaaaaaa

SEQ ID NO: 70063 - DNA, 201 bp, Homo sapiens
tgtatagatatgtttcctgacagatgtaaatgaaaactaatacggtgacatttttcaaattagccactggaaaactgtgtgtgtgtgttttcaaacagccygagcaattttcagttatgtcggcctcggaaagtatttatgaaaaggataataaataattaattctactggccagaagctgcaactcctttctgcttcgac

SEQ ID NO: 70064 - DNA, 201 bp, Homo sapiens
agagtaaacagctttagaatccaccaggcctggagagaaattctgcctctacccacttgcaacctatgcagctttggaccatgctctcgatgtcttccaaraataaaataattgtaagagctacagcaaatgcaggtagtgactctacaatttcatccacaaaggttagctcttttcctgtgcacaccaggatctcagtat

SEQ ID NO: 70065 - DNA, 201 bp, Homo sapiens
caaatgtagacttctgtaaatctgatcttctaacaggaagatcagaatagcagaatactttgtatctaccagagattctctgtatctaacagaatgctctstatctaacagagatacactgtatctaacagagaccgaaatatatttgttgaatgaagacagatgccccattagcagtaaaaagtaattttaaatccactt

SEQ ID NO: 70066 - DNA, 201 bp, Homo sapiens
caactcactgcaacctccgcttcccaggttcaagcgattctttcttgctttcttaaagccctactcagatataatgaggccttggcctgtactaggtcttscaatttgcattattgatctaaaatttaacttacacagtcaatttcttaatgcaagttatcagaattggtggagaaaaatgtgaattacaactgtgattcg

SEQ ID NO: 70067 - DNA, 201 bp, Homo sapiens
tctttcttgctttcttaaagccctactcagatataatgaggccttggcctgtactaggtcttccaatttgcattattgatctaaaatttaacttacacagkcaatttcttaatgcaagttatcagaattggtggagaaaaatgtgaattacaactgtgattcgagaacccaccacattataactatatatatatatatata

SEQ ID NO: 70068 - DNA, 201 bp, Homo sapiens
atatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccag

SEQ ID NO: 70069 - DNA, 201 bp, Homo sapiens
aaaatttaacttacacagtcaatttcttaatgcaagttatcagaattggtggagaaaaatgtgaattacaactgtgattcgagaacccaccacattataastatatatatatatatatatatatatatatatatatatatatatacatagatagatagatagacagacacacacacacacatggcaaatgggcccacatac

SEQ ID NO: 70070 - DNA, 201 bp, Homo sapiens
ctgcaggacatttttttaaaataaaggataaattaactatgaatatattgagtggttatgaaactaatatatcttagcataacagagtagagacagctttaaacttttctatgatactcatatagttatattttatgatggtctaataggtatggggtacataatgaagaagaagctgtttgtggattcattgtattttat

SEQ ID NO: 70071 - DNA, 201 bp, Homo sapiens
cctaggctagaatgcagtggtgcaatcatagcttaccatacattaaaagtatcctcttacctaattttatatgtatgtatgtatgtatgtatgtatgtatstatgtatgtatctatctatctaccttaccatacattaaaatcttacatttctacacgtgcaggactagaatgaacacacataaagcatgataccaatctg

SEQ ID NO: 70072 - DNA, 201 bp, Homo sapiens
gaatatattgagtggttatgaaactaatatatcttagcataacagagtagagacagctttaaacttttctatgatactcatatagttatattttatgatgstctaataggtatggggtacataatgaagaagaagctgtttgtggattcattgtattttattttattttattttttactgctttgagtatgaagagtctgc

SEQ ID NO: 70073 - DNA, 201 bp, Homo sapiens
cttaccatacattaaaagtatcctcttacctaattttatatgtatgtatgtatgtatgtatgtatgtatgtatgtatgtatctatctatctaccttaccayacattaaaatcttacatttctacacgtgcaggactagaatgaacacacataaagcatgataccaatctgcttttttggccaccatataaacattctatgc

SEQ ID NO: 70074 - DNA, 201 bp, Homo sapiens
ggttatgaaactaatatatcttagcataacagagtagagacagctttaaacttttctatgatactcatatagttatattttatgatggtctaataggtatrgggtacataatgaagaagaagctgtttgtggattcattgtattttattttattttattttttactgctttgagtatgaagagtctgcccaaatatactac

SEQ ID NO: 70075 - DNA, 201 bp, Homo sapiens
acctcccgggttcgagtgattctcctgcctcagcctccccaatagctgggattacaggcacgccaccacacccagctaatttttgtatgtttgctacagayggggtttcaccatgttgcccaggctaggttcaaactcctgacctcaagtgatccacctgcctcagcctcccaaagggcagagataactaatttttttttt

SEQ ID NO: 70076 - DNA, 201 bp, Homo sapiens
attaaatactcagtgggtgaggaacattacaggcctgacaaagaagagaaagggaagggctcttgaagtaagcaacctactttgtcctcagctatttaggygcaaaggttgctgcacatatgggccgattactgttttaagatccctccataaaaccaagcatccgagagtccgtcagaatggtaccactgtccttaccta

SEQ ID NO: 70077 - DNA, 201 bp, Homo sapiens
atatttgtccccgctcaaatctcatgttgaaacatgtccgtaatgggaggtatttgaatcactggggcggagccctcatggcttggcgctgtcttcaccayagtgagtgagatctctggagatctggtcattttaacccttttcccatttgccccaagaatacttactggtgtgcagtgtttaccctgagatcgctttgcc

SEQ ID NO: 70078 - DNA, 201 bp, Homo sapiens
tgcttatcacccctctgcagtgctgcaagtaggaatctcatatacgtgatggaagtgatttgtgctttcagctgagagtagcactgtatccattccaaagyttcagttagcctcagtccctgatgatctgcaggaatttctccttctctcttaaaaaagaaggaacatgatatgccacttgcaagattaggatattctgtt

SEQ ID NO: 70079 - DNA, 201 bp, Homo sapiens
acccagtctgctgggatcctgatatagtttggatatttgtccccgctcaaatctcatgttgaaacatgtccgtaatgggaggtatttgaatcactggggcrgagccctcatggcttggcgctgtcttcaccacagtgagtgagatctctggagatctggtcattttaacccttttcccatttgccccaagaatacttactg

SEQ ID NO: 70080 - DNA, 201 bp, Homo sapiens
tccccgctcaaatctcatgttgaaacatgtccgtaatgggaggtatttgaatcactggggcggagccctcatggcttggcgctgtcttcaccacagtgagkgagatctctggagatctggtcattttaacccttttcccatttgccccaagaatacttactggtgtgcagtgtttaccctgagatcgctttgccatgaaat

SEQ ID NO: 70081 - DNA, 201 bp, Homo sapiens
ccagtaacactgctgtagtttgctgggggtctactccagaccctgttcacctgggtccctcccacaccaggaggtgtcacctgtggaggctgcagcacagyaaggatggctgcccgctccttcctctgggagtctctgtcctcaagaggcatcgagctgattccagcagaaacgctcctgtgtaagttctctggcaacccc

SEQ ID NO: 70082 - DNA, 201 bp, Homo sapiens
tggaaaaactctgctttgtgcattgttccttgacatcgctgtggacacacagtgcctgattaaattgtatgtgtcgcttgggttataattattatcattgycaaaaccacttgctggatgctcactctctgcccagcattacactagtgctatgccctgcataaactctgattctcaccctctatgaccccatttgacaaa

SEQ ID NO: 70083 - DNA, 201 bp, Homo sapiens
gcactgtatccattccaaagtttcagttagcctcagtccctgatgatctgcaggaatttctccttctctcttaaaaaagaaggaacatgatatgccacttscaagattaggatattctgtttaaaaagaggggataatttaagcagggctggcggtgggggcggggagacaatggaaaaggctgacatctcctgagcatgg

SEQ ID NO: 70084 - DNA, 201 bp, Homo sapiens
acctcgtaatctgcgcacctaggcctcccaaagtgctgagattacaggcgtgagccactgcgcccggccacattttccctgttctaagccactcttctcayttcctttctgaaagcatcctgacccccatcaaatcagtggaacaagaagactaccttgacctgtgcttccaggtaacagaacgcaaggcaggtatcaatg

SEQ ID NO: 70085 - DNA, 201 bp, Homo sapiens
atgtaaaatttccagatttcaaaatgtatcctttttcctgcatttatctcgctttccttcacacccggggggagtttgttaaactgcagtgaccactggchgagtcccaagccaagccaaaccgtgcaaacatgaaacggccccacaaatcatgcaaaccctacacgctgtccctgccagagagcagcgcctgtctttgca

SEQ ID NO: 70086 - DNA, 201 bp, Homo sapiens
tcaagcaggctagttccagagagtcttatggtcaccctatgctatcctgccttcagagggaagggacaaataagaagaacaaaggcagacgtggagatgayagtaggggttgccaagctttctggaaaggagcagagagtattttaggctttatgggccatacagtctccatcccaactactcaactttgctggcatagtg

SEQ ID NO: 70087 - DNA, 201 bp, Homo sapiens
tttaggctttatgggccatacagtctccatcccaactactcaactttgctggcatagtgcaaaagtagccacagatagcttataaatgaaggtgtgtaggrctgtgttccaataaaactacttcagatctctctggaacttcaataaaagtttttaaaatttagttatgaacactgaaatttgaatttcatacaattttta

SEQ ID NO: 70088 - DNA, 201 bp, Homo sapiens
gtgccctcatggagctgacaaaaaaagatattcgtgttttttgttgtttttttttttttgacatggagtttcgctcttgttgcccaggctggagtgcaacrgcacaatctcagctgactgcaacctccgcctcccagactcaagcaattctcctgcctcagcctcccaagtagctgggattacaggcatgcaccaccatgc

SEQ ID NO: 70089 - DNA, 201 bp, Homo sapiens
acggcacaatctcagctgactgcaacctccgcctcccagactcaagcaattctcctgcctcagcctcccaagtagctgggattacaggcatgcaccaccaygcccggctaattttgtatttttagtagagacggggtttctccatgttggtcaggctggtctcgaactcctgacctcatgatccacctgcctcagcctccc

SEQ ID NO: 70090 - DNA, 201 bp, Homo sapiens
aaaactttatgacactgaaatcagaattccatatcattttcctccttcaagaaataatattctcctctttattcttttttgcagatgattgaaaatgtaaraactattctgagcctgcaggccatagccaaagaggtaccggctgtattttgtccatgggcaggagcttgtgactgctggtctaggtcattccaggtcaac

SEQ ID NO: 70091 - DNA, 201 bp, Homo sapiens
ataaaatttactgaataaataaattaataaagagattgctccaaacagactgaaggtcccttgagagcaaatgtagacttctgtaaatctgatcttctaamaggaagatcagaatagcagaatactttgtatctaccagagattctctgtatctaacagaatgctctgtatctaacagagatacactgtatctaacagaga

SEQ ID NO: 70092 - DNA, 201 bp, Homo sapiens
agaagtgatcaccgttacaatattcagatacacttagggcaggtggccagaaacaaaccatccagagataaatgaacattttgcgctccacagcaaaaaamaaaaaaaaaaaaaaaaaaaaagatttcacagccaaacacatatttctttgttgcattaagggaaaagtcgtgagatggcaagcaggctgtatttttaaag

SEQ ID NO: 70093 - DNA, 201 bp, Homo sapiens
ggatggagtacaatggtgcagtctaggctcactgcaacctctgcctcccgggttcgagtgattctcctgcctcagcctcctgagcagctgggactacaggyacatgccaccatgcccgactaatttatgtatttttaatagagatggggtttcaccatgttggccaggctggtctcaaaccccttaccttgtgatccacct

SEQ ID NO: 70094 - DNA, 201 bp, Homo sapiens
agtctaggctcactgcaacctctgcctcccgggttcgagtgattctcctgcctcagcctcctgagcagctgggactacaggcacatgccaccatgcccgastaatttatgtatttttaatagagatggggtttcaccatgttggccaggctggtctcaaaccccttaccttgtgatccacctacctcagcctctcaaagtg

SEQ ID NO: 70095 - DNA, 201 bp, Homo sapiens
ctgcctcccgggttcgagtgattctcctgcctcagcctcctgagcagctgggactacaggcacatgccaccatgcccgactaatttatgtatttttaatasagatggggtttcaccatgttggccaggctggtctcaaaccccttaccttgtgatccacctacctcagcctctcaaagtgctgagattatgagattacagg

SEQ ID NO: 70096 - DNA, 201 bp, Homo sapiens
gctgggactacaggcacatgccaccatgcccgactaatttatgtatttttaatagagatggggtttcaccatgttggccaggctggtctcaaaccccttascttgtgatccacctacctcagcctctcaaagtgctgagattatgagattacaggcgcgagccactgtgcctggtcgtgatttactcctttctttgaactt

SEQ ID NO: 70097 - DNA, 201 bp, Homo sapiens
aaggatgagagaaaacctcccacctcagaggctccacctcactggggtgaacaagcactgaccttctatcatcctataaggaaaacaagaagaagagatgyttacttgaattactacataggctccctgcctacatccacatcttgaaaattctgagctgtgaagctcttgtggttggctcctgggaacttgagattccca

SEQ ID NO: 70098 - DNA, 201 bp, Homo sapiens
catcctataaggaaaacaagaagaagagatgtttacttgaattactacataggctccctgcctacatccacatcttgaaaattctgagctgtgaagctctygtggttggctcctgggaacttgagattcccagtgatattccaatgctgaaacagcccagcaaggtgatgcaggtaagcacgcttgtaggatgtaacaatg

SEQ ID NO: 70099 - DNA, 201 bp, Homo sapiens
gttcatgtttctgtacatcaaccattcattcagtcattcaacaagtattcactaaatgcaaatgaaatgtcagtctcatccaatccttcaaccaccttatwtggcagacactattcttcccattagtcccatttagcaaaggacagtttgctaatgaccctctcctggcctcagttaattgaggccaggagagggtcatta

SEQ ID NO: 70100 - DNA, 201 bp, Homo sapiens
ctattcttcccattagtcccatttagcaaaggacagtttgctaatgaccctctcctggcctcagttaattgaggccaggagagggtcattacattgcctasgagggtcacaaagctctgtcctccaagtctgagtccagtacatttctctcctggactgagctacccagtttattggagcaaaaatttcctttctcaccaa

SEQ ID NO: 70101 - DNA, 201 bp, Homo sapiens
acttctcctttttttttttttttttctattaagtcgtgtcacagccaaactctcacccctaatgaggcacagctgggcccttggccctgaagaaatacgcrttggaaatgaactggaaaacacttggcctccctcaaacttcccaggagacagcttagcccctcgtgccccctgggagttggcttcttttccagcggccat

SEQ ID NO: 70102 - DNA, 201 bp, Homo sapiens
acatcaggagagtaaacatgccccctatagtgccaagagagaaaaatgtaaattcttttggataaattagcttttgcagctacctctctctttgctatgayttctgtttctcctctgcttaagcaacaaagagagaagtaaccgcaaacgctaatttatccagcggaatttacatttctctttctcggcaatatagtttct

SEQ ID NO: 70103 - DNA, 201 bp, Homo sapiens
gcttccaacattttgctagttgttaaatatgtatcttgagaaaacgaaactaatactaaacataatggaagaaatacgtaagtttgaaagatcaaatatcrtatgactcttgaaacagataaaggaaaaagctgttaggaccaagctttgtaagtcaactcttaagccaacccttttctttactgcatctattgcatttaa

SEQ ID NO: 70104 - DNA, 201 bp, Homo sapiens
gtcctggctctttttattctttttatttattcctgttttttttttcatttcttgtatatacttcaaaaaggcaaaatatttataaagtccttctgagtatsaacactatgattcgtaacctcatctttgcaatggaaaattcactagtatattaaattcaaccaatgggagaggttaggtagatgtatgatcacatgctgg

SEQ ID NO: 70105 - DNA, 201 bp, Homo sapiens
ggggattataaagaccaaaaaattgtatctattatcattattactccccccattgtttttatgtatatatttattattttacttttcagctgttcttattkaattgacaagaatcagaaacaaattgagatggaatggtccacacagggcccatgctgagacaggcagtgtggctgacggatgagaccattggttagccat

SEQ ID NO: 70106 - DNA, 201 bp, Homo sapiens
caaaacaaacaaacaaaccaaaaaaacaaatagcaacagcaaccacaatcatcatcaccatcaaggctggaacaaggatgaggcaggcaggctctgatagyaacaggaggaagcagaccaaggagggagagaaaggaaggcagagaaggggaaaaaaaaacacaaatgataataatagatgctgacatttacggagcactt

SEQ ID NO: 70107 - DNA, 201 bp, Homo sapiens
aattgatgagactattcaagatcttttattttttccttcttttgctagtggaaaatttttattctgcacttttctggcggagggtggtattttgttttctktaagatacaaacaaaagacagttgtgtaaaattaagttatgagaacaacatagaactgtttcttgaagcattccaaagataagtttttgctaattaatta

SEQ ID NO: 70108 - DNA, 201 bp, Homo sapiens
agactattcaagatcttttattttttccttcttttgctagtggaaaatttttattctgcacttttctggcggagggtggtattttgttttctgtaagatamaaacaaaagacagttgtgtaaaattaagttatgagaacaacatagaactgtttcttgaagcattccaaagataagtttttgctaattaattaacaaattc

SEQ ID NO: 70109 - DNA, 201 bp, Homo sapiens
ccatcatcaacttcataagatcatcaccttggttatcaaaaagaaattcactttttttaaccccatggtgggccaagtcagcattaacaaattccatgttyaaaaatttccatggtgttagcaaaggttgtgctatgactcgtaatattttggacattcttcaaatctgatgcctgttatgtaaaatttccagatttcaaa

SEQ ID NO: 70110 - DNA, 201 bp, Homo sapiens
tcataagatcatcaccttggttatcaaaaagaaattcactttttttaaccccatggtgggccaagtcagcattaacaaattccatgtttaaaaatttccayggtgttagcaaaggttgtgctatgactcgtaatattttggacattcttcaaatctgatgcctgttatgtaaaatttccagatttcaaaatgtatcctttt

SEQ ID NO: 70111 - DNA, 201 bp, Homo sapiens
aaaagaaattcactttttttaaccccatggtgggccaagtcagcattaacaaattccatgtttaaaaatttccatggtgttagcaaaggttgtgctatgaytcgtaatattttggacattcttcaaatctgatgcctgttatgtaaaatttccagatttcaaaatgtatcctttttcctgcatttatctcgctttccttca

SEQ ID NO: 70112 - DNA, 201 bp, Homo sapiens
ggaaagcaacagattttatttttaatgggctaaaattttacagtcttaaagcacaattcatgcaagcaactgagagatcacagctacaaacactggacttkctattttctccatgcgatcccaatttcagctgcagagccagagtttatttctttaattattcataattcataaccaacctacttccagaaggatttgagg

SEQ ID NO: 70113 - DNA, 201 bp, Homo sapiens
gatttgaggttgctcacagcagttatgagaaaagggagaagagtggggctcgcgcagggctcaaacatcaggagactggaaaaactctgctttgtgcattkttccttgacatcgctgtggacacacagtgcctgattaaattgtatgtgtcgcttgggttataattattatcattgtcaaaaccacttgctggatgctcac

SEQ ID NO: 70114 - DNA, 201 bp, Homo sapiens
ctcaactttgctggcatagtgcaaaagtagccacagatagcttataaatgaaggtgtgtagggctgtgttccaataaaactacttcagatctctctggaayttcaataaaagtttttaaaatttagttatgaacactgaaatttgaatttcatacaatttttacatgtaataaaacattattctattggttttttccccca

SEQ ID NO: 70115 - DNA, 201 bp, Homo sapiens
gaaagccttgtccaaaaggcacaacagtgactacactgaacccatcccatgcatccttttgagagttagaaggaggcaattgcaagccggctgcaaaagamaaaagacaccagagacttagaaaccagtgaagccacgctgaagatgcagacagagagctagagacaaggtcaggggcctctgttgcactccagacccggt

SEQ ID NO: 70116 - DNA, 201 bp, Homo sapiens
gggacaaataagaagaacaaaggcagacgtggagatgatagtaggggttgccaagctttctggaaaggagcagagagtattttaggctttatgggccatayagtctccatcccaactactcaactttgctggcatagtgcaaaagtagccacagatagcttataaatgaaggtgtgtagggctgtgttccaataaaactac

SEQ ID NO: 70117 - DNA, 201 bp, Homo sapiens
gggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctaccta

SEQ ID NO: 70118 - DNA, 201 bp, Homo sapiens
ctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtacctttagttaaaaacagaaaccaatttgtaaatgtgaattaaatgcatactccaca

SEQ ID NO: 70119 - DNA, 201 bp, Homo sapiens
cgtacaaaaacatggccactttagccagcagtgtggcgaaagtctggggcccacactacacacacacatatgaacttctcatgaccctcaagtatattcayatgatatatcacaaataccataaagcagcattgtaataacagggaggaattgattttaaaaggcctacatcaaaatgaatagtcataaaagtataataac

SEQ ID NO: 70120 - DNA, 201 bp, Homo sapiens
tcgggaggctgaggcagaagaatggcatgaacccgggaggcggagcttgcaatgagccgagatcgcgatagtgcactccagcctgggcaaaagagcaagamtccatctcaaaaaaaaaaaaaaaaaatttaatcatcaaaggaaaatgtttcaaattctagggtaagctgacatggtacacatatacagcgaaatacaccc

SEQ ID NO: 70121 - DNA, 201 bp, Homo sapiens
ttagaatgatcctgtgtgggagatgcacctgaatgtgtggtccgggctggggaatccaggagtgaccaacccagagatttgtcccttatatataacagacmtctgtgccccatgcctgtcccgtggaacacaggccaaacagaggattgaggtcctgagtttggagttaaatgaagattgccaggtagaggttgttagggg

SEQ ID NO: 70122 - DNA, 201 bp, Homo sapiens
cctactctggcaattttaaggaaagtgattcttgaggctgtgggtgaaataccacattcattttttttaaaaaaataaggtatacttacttgtactttctmccattttatatatattctctgtttaaattgtgtagcccctaatagactgcaaagacaatgataaaaaggaacttgccttattcacaggtacatccttgga

SEQ ID NO: 70123 - DNA, 201 bp, Homo sapiens
attcattttttttaaaaaaataaggtatacttacttgtactttctaccattttatatatattctctgtttaaattgtgtagcccctaatagactgcaaagmcaatgataaaaaggaacttgccttattcacaggtacatccttggaacttagtaaagggcttaacctccatagcaggcagtcaagacttactgaatgatta

SEQ ID NO: 70124 - DNA, 201 bp, Homo sapiens
aaaatccagaaacaccagggatgactcagtaccacagtcagtgcgtaaataagggataaagatacctgttaaatccattgcctcaaagcaatcatgggagkttcttaagaatactgaacctcctctccgttttctgcactaaagagataaggagtggcatggagaatctaaatgtgtggaaaatatatatcattggtgtga

SEQ ID NO: 70125 - DNA, 201 bp, Homo sapiens
aatcatgggagtttcttaagaatactgaacctcctctccgttttctgcactaaagagataaggagtggcatggagaatctaaatgtgtggaaaatatataycattggtgtgagaacacatattgtgataggtgttcccctccatcagccccctagtctatactcctagctgctttatcttccagatcatgcctcccctgct

SEQ ID NO: 70126 - DNA, 201 bp, Homo sapiens
ttttggaaagttttatcaaccacttaagttaacttgaagacgcctaacagcaggatatggtcaagcaaacatgttcatcaattaattcaaatgcaattttrgtttacttttatatgatttcccatgcttaaaactactaattgctttcccaggctggctgcatgaacatggcccaatcaaaggatgcaacagtcaaatgct

SEQ ID NO: 70127 - DNA, 201 bp, Homo sapiens
acagagactccaaaaacagaaactaccatcgcctcaagctaatcactctaagtcctagaaatacatctgaggttgcaaacagtccatttcattcattattwtatatatatatatatatctctatatagatatagataaatatatatatagatatacatatagagagagagagataaaacagaaaaaatctaaatgtctaaa

SEQ ID NO: 70128 - DNA, 201 bp, Homo sapiens
tcaggagaccagaagtctgaaaccaaggtgttggcaggggtgactccttgtggaaaccgtgccaggtttctctcctcgtttctgggggctgcccatgaccrtggcatctcttggcttgtagacgcatcactccaatctctgcctctgacttcacagagccttctcctctgtgtcctctcctcctttttctgttttgtcttt

SEQ ID NO: 70129 - DNA, 201 bp, Homo sapiens
gaactgaactgattcacatcatgacttgggattcatgaaccagaagcacaggaaattaataaaaactgaaaacgagccaaagagaagggaaaggctctctyaccactgttgagaatgttatgtttaatccctgcaagcagtagagactcagtgtacttccatgaagtgctgcttgggcattcatgaggcattaagggagaa

SEQ ID NO: 70130 - DNA, 201 bp, Homo sapiens
tccatctcctgggttcaagtgattctcctgcctcagcctctcgagtagctgagattacaggcacgcaccatgtttcccccagcttctggcttgctacactrtggaatggaagacggatgcccaagaagaccaatgtaaggaaagcagagccaagggatggagacagagcatgccctgaaaaaataaggcaagcccatgaga

SEQ ID NO: 70131 - DNA, 201 bp, Homo sapiens
ttccataccaccccaaaacactgatcagcttggggaaacttagaaagttcaaccacctggggataaagtttggaaaactaggctagggccaattcagggtmcaggtggaggctaggaagtttggcataggatatcattaaaggtcttctaaggatgaaggcaattggagctacactataggaaggcacagcaggcggagaa

SEQ ID NO: 70132 - DNA, 201 bp, Homo sapiens
gggtttcaccatgttggccaggctggtctcgaactcctgacctcaagtgatctgcctgcctcggcctcccaaagtgctaggattacaggcgtgagccactrtgcccggctggctttcatatctcttattctttctgcttccgctctctcctgtcccctattagccatgggttccagagaggagagaaggctcgggagagca

SEQ ID NO: 70133 - DNA, 201 bp, Homo sapiens
ccctgcctacatccacatcttgaaaattctgagctgtgaagctcttgtggttggctcctgggaacttgagattcccagtgatattccaatgctgaaacagsccagcaaggtgatgcaggtaagcacgcttgtaggatgtaacaatgtgaaacctcagcacattgtggttatgtttcaaagcacgaggtgacggaagcaaga

SEQ ID NO: 70134 - DNA, 201 bp, Homo sapiens
taatcaaaatcaagaaactacgcatgaagctcttaattccacttggatatacatactttagctggcttcaagctgctcctctgggttgtggaatattacayagctctgtaaaggaatgatttaaagctgtacatactagcctgaaagggcacacactgtacactacctggggatggtggagtatgtgtccacttatttcag

SEQ ID NO: 70135 - DNA, 201 bp, Homo sapiens
aaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatg

SEQ ID NO: 70136 - DNA, 201 bp, Homo sapiens
tgtgtacatctatattaacatgaaggaggatgtacaagaagtacaaaatactaatcatggttgcctcagagggatagaattagatgaaggaatagaaaggstttttttaatgcctcctttagacagctctataattttaaaaaattattcaaataatgtataataatgttcttttataattaaaaaaatctaaaaccaaga

SEQ ID NO: 70137 - DNA, 201 bp, Homo sapiens
ctgaagtgccagtccaattcatcctccagcatagcaccactgactgaccccagtcaacaccacaaggggcagaagagtcactccactgagccctaacttasagaaatcacaagataaaacaaaatggttgttgttttaagcctctaagttttggggtaatgtattatgcggctatacataaattggaacatccacgtttta

SEQ ID NO: 70138 - DNA, 201 bp, Homo sapiens
ggaccagctgaagtgccagtccaattcatcctccagcatagcaccactgactgaccccagtcaacaccacaaggggcagaagagtcactccactgagcccyaacttagagaaatcacaagataaaacaaaatggttgttgttttaagcctctaagttttggggtaatgtattatgcggctatacataaattggaacatcca

SEQ ID NO: 70139 - DNA, 201 bp, Homo sapiens
aagtttgcagggctttgtcattagcctgtttgcattctccaaagcaaactgacagtctcatgatgcagggcattaaaaatcctcagtggtatcgactgccwgaagccgatgcttccctgttaaatacagcatggctcaattaagagctcttcaatatacaatttaatttttctttcatcttgatccacagcctggctcaaa

SEQ ID NO: 70140 - DNA, 201 bp, Homo sapiens
tactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcat

SEQ ID NO: 70141 - DNA, 201 bp, Homo sapiens
aacctccacctcccgggttcgagtgattctcctgcctcagcctccccaatagctgggattacaggcacgccaccacacccagctaatttttgtatgtttgstacagacggggtttcaccatgttgcccaggctaggttcaaactcctgacctcaagtgatccacctgcctcagcctcccaaagggcagagataactaattt

SEQ ID NO: 70142 - DNA, 201 bp, Homo sapiens
caataaaaaaagtgatctattctgagttccataccaccccaaaacactgatcagcttggggaaacttagaaagttcaaccacctggggataaagtttggamaactaggctagggccaattcagggtacaggtggaggctaggaagtttggcataggatatcattaaaggtcttctaaggatgaaggcaattggagctacac

SEQ ID NO: 70143 - DNA, 201 bp, Homo sapiens
aatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttg

SEQ ID NO: 70144 - DNA, 201 bp, Homo sapiens
gggacaggtcaaggaaggtattacctctgcatagttctaggtgtcctgcttaactcattcaggaatttcgggccagagggatatccaacaggaattctaamctgaagagtttagaaaccagtaggagaatcaggatgaattcagaaattactataatatgcattttcaagtgataaatcccatcaaaaacagaaaaagtgc

SEQ ID NO: 70145 - DNA, 201 bp, Homo sapiens
aaactgacccagaaaagggacaggtcaaggaaggtattacctctgcatagttctaggtgtcctgcttaactcattcaggaatttcgggccagagggatatycaacaggaattctaacctgaagagtttagaaaccagtaggagaatcaggatgaattcagaaattactataatatgcattttcaagtgataaatcccatca

SEQ ID NO: 70146 - DNA, 201 bp, Homo sapiens
ctccttctctcttaaaaaagaaggaacatgatatgccacttgcaagattaggatattctgtttaaaaagaggggataatttaagcagggctggcggtgggrgcggggagacaatggaaaaggctgacatctcctgagcatggctcaagaaggcataattcttccgcatgtataagaataaaacctcttaactcatctccca

SEQ ID NO: 70147 - DNA, 201 bp, Homo sapiens
gaaatcatgaagggcaaactgacccagaaaagggacaggtcaaggaaggtattacctctgcatagttctaggtgtcctgcttaactcattcaggaatttcrggccagagggatatccaacaggaattctaacctgaagagtttagaaaccagtaggagaatcaggatgaattcagaaattactataatatgcattttcaag

SEQ ID NO: 70148 - DNA, 201 bp, Homo sapiens
aaagtttcagttagcctcagtccctgatgatctgcaggaatttctccttctctcttaaaaaagaaggaacatgatatgccacttgcaagattaggatattytgtttaaaaagaggggataatttaagcagggctggcggtgggggcggggagacaatggaaaaggctgacatctcctgagcatggctcaagaaggcataat

SEQ ID NO: 70149 - DNA, 201 bp, Homo sapiens
aactttcagacattaaatatcctagcccccgtccctcaccaaattgccaggtgtgggtggaaagcaacagattttatttttaatgggctaaaattttacartcttaaagcacaattcatgcaagcaactgagagatcacagctacaaacactggactttctattttctccatgcgatcccaatttcagctgcagagccaga

SEQ ID NO: 70150 - DNA, 201 bp, Homo sapiens
gagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagctt

SEQ ID NO: 70151 - DNA, 201 bp, Homo sapiens
cgggctggggaatccaggagtgaccaacccagagatttgtcccttatatataacagacatctgtgccccatgcctgtcccgtggaacacaggccaaacagrggattgaggtcctgagtttggagttaaatgaagattgccaggtagaggttgttagggggagggtgttaagtgaaggtgtgatataaaccacatgacattt

SEQ ID NO: 70152 - DNA, 201 bp, Homo sapiens
cagggcccatgctgagacaggcagtgtggctgacggatgagaccattggttagccatgtgtttgtgtctctgttgtgccccttattcactgtcctgccagragccagttagtggctcatctgtgaaatgggaataagaacagtcccaatatctcacagatcattgtattaatctgttttctttctctttttttttttttga

SEQ ID NO: 70153 - DNA, 201 bp, Homo sapiens
gtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattcc

SEQ ID NO: 70154 - DNA, 201 bp, Homo sapiens
caggttaatgtcttgaacatttaaatagttcctgaacacataaaaattcttaccattcacaaacgtaaagacaccaagatagaaatcagtcacagaacatkaatagatcatttgcaaaagaaagaaattgttaacacatcaataaaaaataatgtttagcttcactaataatcaagaaaatgcacagtaaaattagattct

SEQ ID NO: 70155 - DNA, 201 bp, Homo sapiens
gaaactaccatcgcctcaagctaatcactctaagtcctagaaatacatctgaggttgcaaacagtccatttcattcattattatatatatatatatatatmtctatatagatatagataaatatatatatagatatacatatagagagagagagataaaacagaaaaaatctaaatgtctaaaggaccagatataagttaa

SEQ ID NO: 70156 - DNA, 201 bp, Homo sapiens
tatatcaacttcagttttttgaagttaaatttgatttttaaatcccttggctgatgagacctgtgtgggttttttttttgttgtttttttgttttgttttsttttgttttatcattgtacctctattttaaaaatagagacttgtggttctttttccaaaagcagtccaacagaaagtgaatggtggtcaatgcataataa

SEQ ID NO: 70157 - DNA, 201 bp, Homo sapiens
gctaatcactctaagtcctagaaatacatctgaggttgcaaacagtccatttcattcattattatatatatatatatatatctctatatagatatagatawatatatatatagatatacatatagagagagagagataaaacagaaaaaatctaaatgtctaaaggaccagatataagttaatcataaaacgatgacaaca

SEQ ID NO: 70158 - DNA, 201 bp, Homo sapiens
ataaggagtggcatggagaatctaaatgtgtggaaaatatatatcattggtgtgagaacacatattgtgataggtgttcccctccatcagccccctagtcyatactcctagctgctttatcttccagatcatgcctcccctgctcaaagtgaatttgccttccctttcacactgaccttagaagtggatctgagaccatgc

SEQ ID NO: 70159 - DNA, 201 bp, Homo sapiens
atgtacccaataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaag

SEQ ID NO: 70160 - DNA, 201 bp, Homo sapiens
gaagacaggctgatagatttggttgcaatagaattaaaattaaaagacaaaagtaaaacaaaaattaaaaacttaaagacaaaaaaagcagaggtcatgaraaaacatagtcatacacctcataccaacatttcagtcaataacgaactatgtacacaatgccgatcccatcagattataataccatattttcactgtacc

SEQ ID NO: 70161 - DNA, 201 bp, Homo sapiens
aggggattggttaagtaaatcatgactcacccatccattaggacattgggcagctattaaaaataatgctgttgaaggatttagtgacacagaaatactaytacatgaaaaaaggcagtttcttgaacacttccattttctttttttggctggcttttttttttttaatttttaaagagataatatatacgtgtgttatca

SEQ ID NO: 70162 - DNA, 201 bp, Homo sapiens
tttttctgttttgtcttttggtgttattttttttttaagagatggggtcttgctatattgcccaggctggcaatgaactcctgggctcaagtgatgccccytccgcagcctcccgagtagctgggattgcaggcacacccaccactgtgccccctgctttcctcttctcatgaggataaccgtcattggatttagggccca

SEQ ID NO: 70163 - DNA, 201 bp, Homo sapiens
aacaggccggacgtggtggctcacacctgtaatcccagcactttgggaggccgaggcaggcggatcacgaggtcaggagatagagaccatcctggctaacrtggtgaaaccccatctctactaaaattacaaaaaattagctgggcttggtggcgggtgcctgtagtcccagctacttgggaggctgaggcaggagaatgg

SEQ ID NO: 70164 - DNA, 201 bp, Homo sapiens
cttggagagggccagtcagctgccaaggtcacagagccagggagtgggggtggcttgcccaaggccaggtctgtccctccaggtgaaggtaatgattaagwacacaggtctggagtgggtttgaatcactgtgtgttcagccgctcactggggacctggcctcagccctctgattactgcagggctttattactttctgag

SEQ ID NO: 70165 - DNA, 201 bp, Homo sapiens
gaactcaaacaccctctcctttgggaaacccaggctggaaactgaaaggatggctccatcctcttgcttcccaagactctgcaccgcccagggacgctgarcactttgcatgtttcctgccacatcattcagcagcccctgccttccaccgtccaatgtgcctatgcatccttctctttgcctacaccaccttccacttgg

SEQ ID NO: 70166 - DNA, 201 bp, Homo sapiens
tggcctccctcaaacttcccaggagacagcttagcccctcgtgccccctgggagttggcttcttttccagcggccatcttcacaatcaagcaggaaaatgycattgttccaaagtacacaataggttctggtggttttcaaacatcctccatataccagtgcaaatggaggggcatctgaggcgaattccacaggatgttt

SEQ ID NO: 70167 - DNA, 201 bp, Homo sapiens
atacaaaaaatcaagtccgaaatgttgttgaaatgatcattttggtccacctaagtttatacaaaaacattttccatgctctgatctccccacttgcactsttgggtagcccaagttccagatgaacggccttctcacctgcatgctgaaaccagccgaggctgctgccacattaaaaactcagcccaggctgctcctgaa

SEQ ID NO: 70168 - DNA, 201 bp, Homo sapiens
tttgtcccttatatataacagacatctgtgccccatgcctgtcccgtggaacacaggccaaacagaggattgaggtcctgagtttggagttaaatgaagaytgccaggtagaggttgttagggggagggtgttaagtgaaggtgtgatataaaccacatgacatttgcaggtggttatggttttcctgcccagcccaccgc

SEQ ID NO: 70169 - DNA, 201 bp, Homo sapiens
tgggaagcaaggcctgtaagatcccttgacaataacacaccagtcccatgagcaggaacacaaaacattatccctggacccagttctccatcagggtctcrgcatgaatgaggctcttccttcctcacggggatgggaggaccaccctgctttctttgcccttcccaggaggaagggaacagcaccttccccatctctgcc

SEQ ID NO: 70170 - DNA, 201 bp, Homo sapiens
taaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctct

SEQ ID NO: 70171 - DNA, 201 bp, Homo sapiens
actaaaagaaaaagctattcttagtccttcccagatatccctgaacctccacccacccagtctgctgggatcctgatatagtttggatatttgtccccgcycaaatctcatgttgaaacatgtccgtaatgggaggtatttgaatcactggggcggagccctcatggcttggcgctgtcttcaccacagtgagtgagatct

SEQ ID NO: 70172 - DNA, 201 bp, Homo sapiens
tctactaaaagaaaaagctattcttagtccttcccagatatccctgaacctccacccacccagtctgctgggatcctgatatagtttggatatttgtcccygctcaaatctcatgttgaaacatgtccgtaatgggaggtatttgaatcactggggcggagccctcatggcttggcgctgtcttcaccacagtgagtgaga

SEQ ID NO: 70173 - DNA, 201 bp, Homo sapiens
ttttcaaatatcccttggtcttttgtatcactttttagagttttgccaattgtcccattatttgtttgttttatttgagcttggtgatttgaaagagctgyttacttattaagcagatgaactatatgaacagacagttttttaaaactctatttctacctcaaacacatacttacagaactaattcaaaatggtgcttct

SEQ ID NO: 70174 - DNA, 201 bp, Homo sapiens
gtgacacatgaaaatgtatatgaaattcaaattccagtatccataaataaagtttctcgcagccatgcctgctcctttacatatcgtttatgcctgttttygcactatgagggcagagttgagtagttggcaacaaacactacaaggccccaaaatatttattaaatatcccatcacagagaaactttgctgactcttgca

SEQ ID NO: 70175 - DNA, 201 bp, Homo sapiens
cacagggcccatgctgagacaggcagtgtggctgacggatgagaccattggttagccatgtgtttgtgtctctgttgtgccccttattcactgtcctgccmggagccagttagtggctcatctgtgaaatgggaataagaacagtcccaatatctcacagatcattgtattaatctgttttctttctcttttttttttttt

SEQ ID NO: 70176 - DNA, 201 bp, Homo sapiens
aaagtaaagaaaagccatgtgggccttggctagggaatatgcccttttttttttttttttttttttttggagggaggaatctggaatactctttaactgtygaacgaacacataaaagtacattttcttctctatcatttttgccaaactcagaataaaaacaactgggctgcatcattcaccttctaggctgttcctagg

SEQ ID NO: 70177 - DNA, 201 bp, Homo sapiens
gggaaagaataatattttgtgacacatgaaaatgtatatgaaattcaaattccagtatccataaataaagtttctcgcagccatgcctgctcctttacatrtcgtttatgcctgtttttgcactatgagggcagagttgagtagttggcaacaaacactacaaggccccaaaatatttattaaatatcccatcacagagaa

SEQ ID NO: 70178 - DNA, 201 bp, Homo sapiens
gccaagatgggacagtgctcgtctgccagtggcagccccattcggagagaattttccctttgaagaatataacccataaaagatcatcaaaactaagggawtaaataaagaggggacctcgatgacatatttaagctctgaataaagctagactctaagcaggggttggcaaactataaccgctgggccaaacacggctgt

SEQ ID NO: 70179 - DNA, 201 bp, Homo sapiens
ctgtggcttttgggccaagggtagtggggaaaacagcttcttgtcactgggggaacaagccaagatgggacagtgctcgtctgccagtggcagccccattyggagagaattttccctttgaagaatataacccataaaagatcatcaaaactaagggaataaataaagaggggacctcgatgacatatttaagctctgaat

SEQ ID NO: 70180 - DNA, 201 bp, Homo sapiens
ctaggccaatcctggttctccctgtggcttttgggccaagggtagtggggaaaacagcttcttgtcactgggggaacaagccaagatgggacagtgctcgyctgccagtggcagccccattcggagagaattttccctttgaagaatataacccataaaagatcatcaaaactaagggaataaataaagaggggacctcga

SEQ ID NO: 70181 - DNA, 201 bp, Homo sapiens
tagaagctatagatttgtgtgtccagaatgtttccccaggtgcctccttttgcaaaattggacctcatttttccattagggaacggggcctctcagactcygtggagaagcagagaattatctccagccttgactgcccaggctgcagagaaccgcatcatccggggacatgactgattcagggataggtgtctgcctaaa

SEQ ID NO: 70182 - DNA, 201 bp, Homo sapiens
accataaaaggatcatagcagattgacggtagaagctatagatttgtgtgtccagaatgtttccccaggtgcctccttttgcaaaattggacctcattttwccattagggaacggggcctctcagactctgtggagaagcagagaattatctccagccttgactgcccaggctgcagagaaccgcatcatccggggacatg

SEQ ID NO: 70183 - DNA, 201 bp, Homo sapiens
ttgctgaccactagtaagagaccatccaacaggctcctttctgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaatt

SEQ ID NO: 70184 - DNA, 201 bp, Homo sapiens
ttccatcttaggcagttcaccacttcatacgattatttggcaccctcgatttttgttctgctgctcacatcacacaaaggctatttctactttatatcttyagcattttccccacaccagagttgtacctatatacatgctgtttccaccagcaggaaagtaggagtgcaatcagctatcctcgctttggccagtggtgct

SEQ ID NO: 70185 - DNA, 201 bp, Homo sapiens
agctatcctcgctttggccagtggtgctaggaactgataactccacatatcctgcaaggcaggcaggagaagttaggaagaatcagggaggaagggaacasacttttatgactgtggatgcagggcaatgggctctcacgttgtggtagacaaaatgatgcccatttcccaaccaaagatgtccaggtcctaatccctgaa

SEQ ID NO: 70186 - DNA, 201 bp, Homo sapiens
tgaaaccccatctctactaaaaattagctggcatggtggcatgtgcctgtggtcccaggtactcaggaggctgaggcaggagaatcgcttgaaccctggargcggaagttgcagtgagccaagatcaagccactgcactccagtctgggcaacaaagcaaagctctgtctcacaaataaaataaaaataaatagggagagg

SEQ ID NO: 70187 - DNA, 201 bp, Homo sapiens
taaaactatcagatctcacgagaactcacgtgctatcacgagaacagcatgagggaaactgccaccacgggccaatcacctcctaccaggtccctacctgrcacgtagggattatggagattacagttcaaaatgagatttgggtggggacacagccaaaccataccaatcatcatgaggattaacaaagaggaaacactg

SEQ ID NO: 70188 - DNA, 201 bp, Homo sapiens
cacagtccacattacagtgtcactgggccagggctgggagaagccgtgggagaaatgcagaatggggaggctgaggcaaagtcaggatgaaccaaaatgtrggtgagcaccagacacagtggccacctgaggaggaaacacacaacagctgagaatccacgggggatgcgtggccaggttagagcatcctggaatcaggca

SEQ ID NO: 70189 - DNA, 201 bp, Homo sapiens
agaacctgacaagatcagtgctcagcacacagtaggcccacagcatgtatttgatgtacaagtgaacaaaaggaagaatgaatgaaaagagctcttcaaasccatgcctctggactccttgtgacgtgtgagtcccctgccacagccataagaagtctccagcggttctaccatcgccttcttgagaagtaacacccaccc

SEQ ID NO: 70190 - DNA, 201 bp, Homo sapiens
gtacagtggtgcgatctcacctcactgcaacctccacctcccgggttcaagcaattctcctgcctcagcctcctgagtagctgtgactacaggtatgtgcygccacgcctggctacatttttgtattttagtagagatgaggtttcaccgtattgtgcaggatggtctcaaacgactgagctcaagcaatccacctgcctc

SEQ ID NO: 70191 - DNA, 201 bp, Homo sapiens
cgggttcaagcaattctcctgcctcagcctcctgagtagctgtgactacaggtatgtgccgccacgcctggctacatttttgtattttagtagagatgagktttcaccgtattgtgcaggatggtctcaaacgactgagctcaagcaatccacctgcctcggcctcccaaagtgctgggattacagagtgtgccaccgcac

SEQ ID NO: 70192 - DNA, 201 bp, Homo sapiens
aaaatacaaaattagccgggtgtggtggcacatgtctgtaatcccagctactcgggaggctgcggcaggagaatcgcttgaacctgggaggtagagatcayggcaagccaagatcacaccactgcactccagcctgggcaacaagagcgaaactccatctcaacaacaacaaaaaaagtaatttagcacatatactgcata

SEQ ID NO: 70193 - DNA, 201 bp, Homo sapiens
actgagctcaagcaatccacctgcctcggcctcccaaagtgctgggattacagagtgtgccaccgcacccagccttcatgtccaaatgtaatccctaacgytggaggtggggcctggtggaaggtgattagatcatgcggacagatttctcatgcatggtttagcacgtatgctgtgtggtgagttggctctcctgagatc

SEQ ID NO: 70194 - DNA, 201 bp, Homo sapiens
aaacattggcatatgatcaagctagccagaagagcactgctgaggccagatggagaggctcatgcctgtaataccagcattttgggaagccaaggcgggcrgatgacctgaggtcaggagtccgagaccagcctggccaacatggcgaaaccctgtctctactaaaaatacaaaaattagctgggcgtggtggcaaatacc

SEQ ID NO: 70195 - DNA, 201 bp, Homo sapiens
agggagaggggctgggtgtggtggctcacacctgtaatcccggcagtttaggaggccaaggcaggcagatcacttgaggtcaggagtttgagaccagcctsgccaacatggtgaaaccccatctctactaaaaattagctggcatggtggcatgtgcctgtggtcccaggtactcaggaggctgaggcaggagaatcgctt

SEQ ID NO: 70196 - DNA, 201 bp, Homo sapiens
tattatgcaaatggactttccagttgattggagccatcttgcctctctatgtctgcagctgaactttacaggctgctctttgttagaaaatcatttgaggmtgcttttcattaaaaagaaaaactttactgaggatccccatacccttactgtctgcctaagtgatttcttcttaagtcctgtatcaggggtaccagagat

SEQ ID NO: 70197 - DNA, 201 bp, Homo sapiens; identical to SEQ ID NO: 25130
  misc_feature (1)...(201): n = A,T,C or G, or insertion/deletion polymorphism (see Tables 1-2)

SEQ ID NO: 70198 - DNA, 201 bp, Homo sapiens; identical to SEQ ID NO: 3532

SEQ ID NO: 70199 - DNA, 201 bp, Homo sapiens
aaagaatggggttgtcatttattgagctagagaaaactgcaggaggttaggaatttactacagagaaaatgcaaagagaaagaaaaactgaagtgaaattytaattgatgctgaggtgagatccagtgggctgccacatggcctgtcatgtggcctgctgtggcaagccaaggtgaactcagaaaagacttggagttttgc

SEQ ID NO: 70200 - DNA, 201 bp, Homo sapiens; identical to SEQ ID NO: 24801

SEQ ID NO: 70201 - DNA, 201 bp, Homo sapiens; identical to SEQ ID NO: 24889

SEQ ID NO: 70202 - DNA, 201 bp, Homo sapiens; identical to SEQ ID NO: 25302

SEQ ID NO: 70203 - DNA, 201 bp, Homo sapiens
tattattatgcaaatggactttccagttgattggagccatcttgcctctctatgtctgcagctgaactttacaggctgctctttgttagaaaatcatttgrggctgcttttcattaaaaagaaaaactttactgaggatccccatacccttactgtctgcctaagtgatttcttcttaagtcctgtatcaggggtaccaga

SEQ ID NO: 70204 - DNA, 201 bp, Homo sapiens; identical to SEQ ID NO: 3571

SEQ ID NO: 70205 - DNA, 201 bp, Homo sapiens; identical to SEQ ID NO: 24998

SEQ ID NO: 70206 - DNA, 201 bp, Homo sapiens; identical to SEQ ID NO: 3788

SEQ ID NO: 70207 - DNA, 201 bp, Homo sapiens; identical to SEQ ID NO: 25257

SEQ ID NO: 70208 - DNA, 201 bp, Homo sapiens
gaagaatataaagaaggcatctaatgactctaaccctttaaagaactcaggacaaaggcaccgttcactcctttggggctgttctgttttctttgtggagkttcaagagtcatgggcagattcttcttaggtgtaaagctctgctctcctgtattgcattacctgacctctttggcttctgggggtgaagtggctacattg

SEQ ID NO: 70209 - DNA, 201 bp, Homo sapiens; identical to SEQ ID NO: 24823

SEQ ID NO: 70210 - DNA, 201 bp, Homo sapiens; identical to SEQ ID NO: 3576

SEQ ID NO: 70211 - DNA, 201 bp, Homo sapiens
tgctgggaacaagcaagctaactagtgaaagaaacatttctggacccagttgggcaccaagtagaagcctaacaggtaaattggaatgaataagcatataggcaagccatatttttaagaagcagtttgttgaggcaagaaggtaaagtctgaaacttctttatgctcagacctacatctgctgctctcacttgactggaa

SEQ ID NO: 70212 - DNA, 201 bp, Homo sapiens; identical to SEQ ID NO: 25008

SEQ ID NO: 70213 - DNA, 201 bp, Homo sapiens; identical to SEQ ID NO: 24930

SEQ ID NO: 70214 - DNA, 201 bp, Homo sapiens; identical to SEQ ID NO: 24932

SEQ ID NO: 70215 - DNA, 201 bp, Homo sapiens
catttccaggcctagccataaaatgtcttgcacatgtgtccatgctgcctctctctttcacatatgcagggcttcaactgaaggactctaagatggtgaarccacatgatggaaggagctgggatccctgaatcaccttgtggaggagaacttaacttacatcagaatgaggcatgagtgaaggatcaattttattgtgtt

SEQ ID NO: 70216 - DNA, 201 bp, Homo sapiens
ttccagttgattggagccatcttgcctctctatgtctgcagctgaactttacaggctgctctttgttagaaaatcatttgaggctgcttttcattaaaaasaaaaactttactgaggatccccatacccttactgtctgcctaagtgatttcttcttaagtcctgtatcaggggtaccagagattaccttgtcctgtgaga

SEQ ID NO: 70217 - DNA, 201 bp, Homo sapiens; identical to SEQ ID NO: 25265

SEQ ID NO: 70218 - DNA, 201 bp, Homo sapiens
gaataaggaaagacaaggagaacaagcccccttggaagcccatttggtttcatggctcctgtactcgcaagtggctgtgtaaatggaagggccggatttcytacgactccagctgctcacgcgttaggtctgttattgtgcacgttttaaactgacaggcagattacatcaaggaaaattccgagcctgaaggtcaatctg

SEQ ID NO: 70219 - DNA, 201 bp, Homo sapiens
gaagcccatttggtttcatggctcctgtactcgcaagtggctgtgtaaatggaagggccggatttcctacgactccagctgctcacgcgttaggtctgttmttgtgcacgttttaaactgacaggcagattacatcaaggaaaattccgagcctgaaggtcaatctgcaactataaagctcctgagttctctatctctctg

SEQ ID NO: 70220 - DNA, 201 bp, Homo sapiens; identical to SEQ ID NO: 24787

SEQ ID NO: 70221 - DNA, 201 bp, Homo sapiens
agttggactccaaaagagtggggcatttgctatctgcttaaaatgaggaagtatctatcagttgaaattaaatcgtcttccaacttgaatcatcctttgcyttcattttctccttcaaaagttgcaattttaaaatgtgaatatccttattactgttttggttataatagtaatacatatttattgcaaaaaaaatttgag

SEQ ID NO: 70222 - DNA, 201 bp, Homo sapiens; identical to SEQ ID NO: 25224

SEQ ID NO: 70223 - DNA, 201 bp, Homo sapiens; identical to SEQ ID NO: 25374

SEQ ID NO: 70224 - DNA, 201 bp, Homo sapiens; identical to SEQ ID NO: 3503

SEQ ID NO: 70225 - DNA, 201 bp, Homo sapiens; identical to SEQ ID NO: 25143

SEQ ID NO: 70226 - DNA, 201 bp, Homo sapiens
tactctggactttgagctggacacagtgatgagtgtgacttagtactgaggaaagggtttgccacaagtcaggtattctgaaactagacagggagaccggmatttggcattcagagtataattaatgatcaatgcctgtggaagatagggggtggaagggagaaatcaaactgccttgcaagcccaacaaagactcagtcg

SEQ ID NO: 70227 - DNA, 201 bp, Homo sapiens
gcatcacctatggctcctgtaacctcaaaatgatcacaggatcaagaactgtgtctaggaagcaaccttggatgtggttactggcacatggaactgattgkagacaaatagattagaagtcagctaagcttttgagagaagcttattgccagagaaaccataagccagaactaaatgagccatctgttgtaaacaatagtt

SEQ ID NO: 70228 - DNA, 201 bp, Homo sapiens
tcatttcttttatcaactttattaactcctaatttttcttccctgtggctcaagaactatacatagaaaataaataattagctgtgctctcaatttcctgraaatttatcataatatttatctacataaatcatatgaagccaaaagaatcctgaggaaaacaaaatagttgagctaaattttgttaattcagtcagtatt

SEQ ID NO: 70229 - DNA, 201 bp, Homo sapiens; identical to SEQ ID NO: 25275

SEQ ID NO: 70230 - DNA, 201 bp, Homo sapiens; identical to SEQ ID NO: 25281

SEQ ID NO: 70231 - DNA, 201 bp, Homo sapiens
tggcttgtctgcatatttgcatgaggaactgcactgtcactttcatagataaatgagagactgagtttcctcaaccccaaagagaaagggcattttgctcmtcccagtcaaaaggtgctcctgggtgactggaggccaagtgggagtgtctgggggttgcctccatgtgatgtgcagtagccctacagggaattgccaaca

SEQ ID NO: 70232 - DNA, 201 bp, Homo sapiens; identical to SEQ ID NO: 3660

SEQ ID NO: 70233 - DNA, 201 bp, Homo sapiens; identical to SEQ ID NO: 3661

SEQ ID NO: 70234 - DNA, 201 bp, Homo sapiens; identical to SEQ ID NO: 3662

SEQ ID NO: 70235 - DNA, 201 bp, Homo sapiens
atgaaagaaaatatggaaaataggattatataggcaagcagtattaagtaaacagtttggtgaaagtaagattagagaagaaatggtagatgcaggaggcrcagaatgatttcttcgatgaagagaaccaaaataatccaacagaagaaaaagttataattttttctttttcttttttcttttttttttattgttactata

SEQ ID NO: 70236 - DNA, 201 bp, Homo sapiens
taaagagatgaggtcaggaaatagttggccagtttgcaagaggaactaaaagggaatagagaatagaaatggggggtcctgcagagctcaaaaatctaatraaagtggctgaggataaagatcagattaagggtgtggcatcacctatggctcctgtaacctcaaaatgatcacaggatcaagaactgtgtctaggaagca

SEQ ID NO: 70237 - DNA, 201 bp, Homo sapiens
gtggcaccatctcggctcactgcaacctctgcttcccgggttgaatcgattctcctgcctcagcctcctgagtagctgggattacaggcacgcgtcaccaygcccagccagctgatttttgtattttttgtagagacggggtttcaccatgttggtcaggctggtcttgaactcctgatctcgtgatccacccgcctcggc

SEQ ID NO: 70238 - DNA, 201 bp, Homo sapiens; identical to SEQ ID NO: 25367

SEQ ID NO: 70239 - DNA, 201 bp, Homo sapiens
ttgtccttgcgatagtttgctgagaatgatggtttccagcttcatccatgtccctacaaaggacatgaactcatccttttttatggctgcatagtattccrtggtgtatatgtgccacattttcttaatccagtctatcattgatggacatttgggttggttccaagtctttgctattgtgaatagtgccgcaataaacat

SEQ ID NO: 70240 - DNA, 201 bp, Homo sapiens; identical to SEQ ID NO: 24918

SEQ ID NO: 70241 - DNA, 201 bp, Homo sapiens; identical to SEQ ID NO: 3603

SEQ ID NO: 70242 - DNA, 201 bp, Homo sapiens
agagaaagaaagaaagagaaagagaaagaaagaaagaaagaaagaaagaaagaaagaaagaaagaaagaaagaaagaaagaaaagagaaagaaagaaagakaaagaaagaaagaaaataccatatctaagggatatacatctctgctgctaattcaagttggtttatagaatatgtgtttctgggccaggcgtggtggctt

SEQ ID NO: 70243 - DNA, 201 bp, Homo sapiens
accccatctctactaaaaatacaaaattagctgggcatggtggtgcatgcctgtaatcccagctactcaggaggctgaggcaggagaatcgcttgagcccyggaagcggaggttgcggtgagccaagatcaagccattgcactccagcctgggcaacaagagtaaaactctgtctcaaaaaaaaaaaagagacaggcatcc

SEQ ID NO: 70244 - DNA, 201 bp, Homo sapiens
attagccattaacgatcaactcaattttcagccccccttccctccttggaggttggggcctggggctgaatatcttaaccctgtaatcagaacttgatttktcccacaaaaagttcccaccctgaggctatctagaggccctcagcctccagtcacctcattagcacagaagattccaaggattgaaggaaccgtatgtca

SEQ ID NO: 70245 - DNA, 201 bp, Homo sapiens
agctcaaggctgcagtgagccatgaccatgccactgcactccagcctgggcaacagagtgagagcctgtctcttaagagaaaaaaagatagattcaaaatytgataacagtaggtttggggatggccccgaggtcttgggcttttcttttctctctctctttttttttttttttttttttgagatggagtcttgctctgtc

SEQ ID NO: 70246 - DNA, 201 bp, Homo sapiens
aactttaaaacaggcctgttgggccgcatgtggtggctcacgcctgtaatcccagcactttgggaggctgaggcaggcagatcacctgaggtcgggagttmgagaccagtctgaccaacatggagaaaccccgtctctaataaaaatacaaaattagccgggcatggtggcacatgcctgtaatcccagctatttgggagg

SEQ ID NO: 70247 - DNA, 201 bp, Homo sapiens
ttcagaatccattttggtcaaaaataatttaaactccactggttgcaccagacacatttcaatataacttcccaattttaaaactttactatcaacaaatkcaattttctttagaaaaggagatttttaaaattctacttagactgggcacagtggctcatacctataatccaaggggatttaggaggccaaaacaagtaa

SEQ ID NO: 70248 - DNA, 201 bp, Homo sapiens
tcaggattaaatgaggaaatatagggaaagatatgaacactattctcaaatctttccctccctccatataactatagacaaccagaaccaaggatcggcarttgttacatggaggaaggaaaaagatttgaactaatgaaaagaacaataataatagcagctaatagcggcatattttttttcttttttgagacaagatct

SEQ ID NO: 70249 - DNA, 201 bp, Homo sapiens
ttacattctttgttttctatccataccatttcttcagaatccattttggtcaaaaataatttaaactccactggttgcaccagacacatttcaatataacktcccaattttaaaactttactatcaacaaattcaattttctttagaaaaggagatttttaaaattctacttagactgggcacagtggctcatacctataa

SEQ ID NO: 70250 - DNA, 201 bp, Homo sapiens
actcggtaagtgttagctatctgatattaactattattttgctatggatatgggtgtggaccatgtaaaaatgcaaggcttcaaaagtagacaacaacctrcttcaaaagtagacaacaacctacttcaaaagtaggtataaacacttggggttcatacctaatgtgccacgagatgggctttggaccttccagatctgag

SEQ ID NO: 70251 - DNA, 201 bp, Homo sapiens
cgcaagcacatgggagaatgggaggaattacagaaaacaggaaggcaagctcactgcctcacaaaagattccttggtggaagactttcccagttcccttcygcagaaacaatgaaggtctgaggacatggggttatcatcaatctcttcattacagtcactcatctcagagaccagcattgcaactggagggcagctgctc

SEQ ID NO: 70252 - DNA, 201 bp, Homo sapiens
ttattcaagataaaacttacattctttgttttctatccataccatttcttcagaatccattttggtcaaaaataatttaaactccactggttgcaccagayacatttcaatataacttcccaattttaaaactttactatcaacaaattcaattttctttagaaaaggagatttttaaaattctacttagactgggcacag

SEQ ID NO: 70253 - DNA, 201 bp, Homo sapiens
acctggtgaagaccaagcaggcagggtctggcaaagtagctaggccatcaggcagagtgcagatccacccccaggatacagaagagaccctgtcacaagaycccacattcacattaagacagctaagatgcagacttctgctgcctttgaaccaaaccaaaccaaaccaaacccactcccagctgagcacacccactatta

SEQ ID NO: 70254 - DNA, 201 bp, Homo sapiens
tgccacagaggtcaaggcacctgtcatctgacttcaggctcctggatctccaaacctcttcctgcgcaaactccacagccaaaagaacacaggtaccccaygtggcacaagcagccttcttctaaaagatttcagaaaattaaataagcactagcatcatacctgtaggctaactacatgcccttcatgcaaatacaatct

SEQ ID NO: 70255 - DNA, 201 bp, Homo sapiens
cacaaccactctcccctttccttttctttcagggaatgggccactcctggcaccctgcacattttagcatttgtttcctgtctctccccactagaatgcawgctgcagaggaattgtatccgtagcacctggtaagtgctcaatgaccactttttcaaggaccacatttccataatattaaaatgtattatgagagggaag

SEQ ID NO: 70256 - DNA, 201 bp, Homo sapiens
ctttcagttcctccttactccaccctggttttctacctcattgaggcttccagtccctaaactctatttttctaaagacttatttttcaactctctctcaktttcagtctttcatgttatcaaactgcaacacacacttatcacccactgaccatggtttcattggagctttccaacctcctcatcatttttgctaacttg

SEQ ID NO: 70257 - DNA, 201 bp, Homo sapiens
cagtattgcacttcaatctaggtgacagagaaaaactctatcttgaaaaaaaaagtgtattaattaataaaataccatatcaatatacgaaataatgacamtttagaagggttagtgattgcttgggtggtaactgaaactgactttggaaatctcactctcaagtcacacacgtgcttttcttttgctttcagttcctcc

SEQ ID NO: 70258 - DNA, 201 bp, Homo sapiens
gcacattcctgtggtcccagctactcaggaggctgagattagaaggatcgtttgggaagctgaggctgtagtaagccatgatcacagtattgcacttcaayctaggtgacagagaaaaactctatcttgaaaaaaaaagtgtattaattaataaaataccatatcaatatacgaaataatgacaatttagaagggttagtg

SEQ ID NO: 70259 - DNA, 201 bp, Homo sapiens
accagcctgggcaaaatagtgagactccatgtctaaaataaaaaatttttttttagttagacaagcaagatggcacattcctgtggtcccagctactcagsaggctgagattagaaggatcgtttgggaagctgaggctgtagtaagccatgatcacagtattgcacttcaatctaggtgacagagaaaaactctatcttg

SEQ ID NO: 70260 - DNA, 201 bp, Homo sapiens
tgtattggcacaaatccatcctgggttagtcgttgactactccaacacccacttcaggctttatagccaagggcaactttaaataaacatttaaacatccyaagtggtcaattcaatgacacccctcacaggtccaatgtatgacaatgctgttgaatgtgcctcttcatttcagcacactgccttcaggcaggtaagtgt

SEQ ID NO: 70261 - DNA, 201 bp, Homo sapiens
cttcaggcaggtaagtgttttattagatctttttccagaactgcaaccactcctgctctctcatcaccctttaacacaatcctcacgtcctcctctcgccrcaagcacatgggagaatgggaggaattacagaaaacaggaaggcaagctcactgcctcacaaaagattccttggtggaagactttcccagttcccttccg

SEQ ID NO: 70262 - DNA, 201 bp, Homo sapiens
cttttgatctggcaattctgcctagaaggtcatctgaggaagtggccaggagagcacaaacacacacatttacagatgctcatcacagtgtcactttgagracttaaacagaaactctgtgagttataagatcattgaagagctgtgactttaacctctccaccttacttcctccctagattcctctaggaacagaaaaat

SEQ ID NO: 70263 - DNA, 201 bp, Homo sapiens
ccacccaccttggcctcccaaagtgctgggattacaagtgtgagccaccacacccagccaataaatgctttcttaaagcaatttacagaattctattttayagtaaaaatgaattttcagcagtacagtgttcacagtgagattggattttattaaattatatatgatagaaaaaatgttacttatatgtataaagtaaaa

SEQ ID NO: 70264 - DNA, 201 bp, Homo sapiens
gaattctattttatagtaaaaatgaattttcagcagtacagtgttcacagtgagattggattttattaaattatatatgatagaaaaaatgttacttatakgtataaagtaaaataaacgtgattggcatttttaaacaaaatttttaaaataaaggtatacaatatgcccagattacataattcaaaaagtgcatgccac

SEQ ID NO: 70265 - DNA, 201 bp, Homo sapiens
cttctctttctgtgtgtgtgtggatggatgtagcacattgttataaccaagctcaaaataatgcaaaactttgattatatatgttgttaccatggttaacmaatgtattcttccatctgagaatcctcagtagtacagagagaggttttgcatttagaattctatttagactttttattccttgaagcatcaaaagtacat

SEQ ID NO: 70266 - DNA, 201 bp, Homo sapiens
caaacaaagaaacaaagaagaaagaaagaaagagaagaaagtgagaaagagaagaaagagagaaaggaaggaaggatggaaggaaggaaggagagagagaragaaagaaagaagaaggaaagaaagaaagaaagaaaggaaagaaggagggaaggcaggcaggcaggcactgacacctggtttcaggtgactttaaaaggg

SEQ ID NO: 70267 - DNA, 201 bp, Homo sapiens
agaaagaaagaaagaaagaaagaaagaaagaaagaaagaaagaaagaaagaaagaaagaaagaaagaaagaaagaaagaaagaaagaaagaaagaaagaargaaagaaagaaagaaagaaagaaagaaggaaagaaggaaggaaggaaggaaggaaggaaggaaggaaggaaggaaggaaagcaagcaagcaagcgagaga

SEQ ID NO: 70268 - DNA, 201 bp, Homo sapiens
gaaaagaaagaaagaaagaaagaaagaaagaaagaaagaaagaaagaaagaaagaaagaaagaaagaaagaaagaaagaaagaaagaaagaaagaaagaargaaagaaagaaagaaagaaagaaagaaagaaagaaggaaagaaggaaggaaggaaggaaggaaggaaggaaggaaggaaggaaggaaagcaagcaagcaa

SEQ ID NO: 70269 - DNA, 201 bp, Homo sapiens
cacgagacctgatgggaagcgggttaaggtggtttcatgttgaccatgtgtccacaggcttcgcagaccaagagcaagtcggcacaccaggacaggcattygcatgggtgcccagaagtttcaagatctgaccttggagagaccaggtccgggaggctgccgggaagtctccatcacaccggcctcagccgagtcacagga

SEQ ID NO: 70270 - DNA, 201 bp, Homo sapiens
cagtgctcacaatggcacttagccttggctgccatcagccttccaggctccttatgcagttcagaaacatgtgtttggaagtaagaaaggcactagggccrggcgtggtggctcacacttgtaatcccaacactttgggaggctgaggcaggtggatcacgaggtcaggagttcaagaccagcctggccaatgtggtgaaa

SEQ ID NO: 70271 - DNA, 201 bp, Homo sapiens
ctcaggccataatgccttgcacctaacaggtgcttaaatatgtatatttgtgcaacaaaacccaaaatgaacccaatttttgttttttctttttctttttytttttttttttttttttttttttttttgagacagagtctcactctgtcacccaggctggaatacagtggcaagatctcagctcactgcagcctcctcctc

SEQ ID NO: 70272 - DNA, 201 bp, Homo sapiens
acttgtagtcccaactactcgggaggctgagacaggagaattgcttgaacccaggaggcagaggttgcagtgagtgaagatcatgccattgcactccagcmtgggcattacagcaaaatgctgtcaaaaaaaaaaaaaggagagagagagaaaagagaaagaaagagagagagaaagaaagaaagagaaagagaaagaaag

SEQ ID NO: 70273 - DNA, 201 bp, Homo sapiens
gggcgtggtggcacgcacttgtagtcccaactactcgggaggctgagacaggagaattgcttgaacccaggaggcagaggttgcagtgagtgaagatcatsccattgcactccagcctgggcattacagcaaaatgctgtcaaaaaaaaaaaaaggagagagagagaaaagagaaagaaagagagagagaaagaaagaaag

SEQ ID NO: 70274 - DNA, 201 bp, Homo sapiens
attagccgggcgtggtggcacgcacttgtagtcccaactactcgggaggctgagacaggagaattgcttgaacccaggaggcagaggttgcagtgagtgawgatcatgccattgcactccagcctgggcattacagcaaaatgctgtcaaaaaaaaaaaaaggagagagagagaaaagagaaagaaagagagagagaaaga

SEQ ID NO: 70275 - DNA, 201 bp, Homo sapiens
tcaccagggcccatagagctcagaaaatgccctcccatgactccacttctgcaaatcctccaaagctgcttctttggaataagctacaaggttaacaaacwattgttttttcagaaataggattataaaatgtgagaacacaatgcactattttgaaacattgaaaataccatatctggcccggcacggtggctcactctt

SEQ ID NO: 70276 - DNA, 201 bp, Homo sapiens
gagttcgagaccagcctggccaacatggtgaaaccctgtcactactaaaaatacaaaaattagccaggcatggtggcaggtgcctgtaatcccagctactygggaggctgagggaggagaatcgcttgaacacgggaggcagaggttgcagtgagctgagatcgcgccattgcactccagcctgggcaacagagcaagact

SEQ ID NO: 70277 - DNA, 201 bp, Homo sapiens
tctactaaacatacaaaaataagccaggcatggtggtacacacctgtaatcccagctacttgggatgctgaggcaggagaatcacttgaacccaggaggcrgaggttgcagtaagccaagatcgtgccactgcactccagcctaggccacagagcaacactctgtctcaaaaaaaaaaaaagaaaagaaaagaaaagaaaa

SEQ ID NO: 70278 - DNA, 201 bp, Homo sapiens
ttttattccttgaagcatcaaaagtacataaacaccccaaaaggttatatcagaagtcaaagcattatgatctctctggatgcttttcagacatggtgggkgagcgttctgaatcccaaccccgcccccaatgccccccagccgccacccggccagctttgcctggagagctactgagattttccactatctagtcttggg

SEQ ID NO: 70279 - DNA, 201 bp, Homo sapiens
tctctttccattcctagtcctagaaacttttaaaggatcctctgagtgtctgacaatcaccagggcccatagagctcagaaaatgccctcccatgactccrcttctgcaaatcctccaaagctgcttctttggaataagctacaaggttaacaaactattgttttttcagaaataggattataaaatgtgagaacacaatg

SEQ ID NO: 70280 - DNA, 201 bp, Homo sapiens
ttgcatttagaattctatttagactttttattccttgaagcatcaaaagtacataaacaccccaaaaggttatatcagaagtcaaagcattatgatctctytggatgcttttcagacatggtgggtgagcgttctgaatcccaaccccgcccccaatgccccccagccgccacccggccagctttgcctggagagctactg

SEQ ID NO: 70281 - DNA, 201 bp, Homo sapiens
ttttgcatttagaattctatttagactttttattccttgaagcatcaaaagtacataaacaccccaaaaggttatatcagaagtcaaagcattatgatctytctggatgcttttcagacatggtgggtgagcgttctgaatcccaaccccgcccccaatgccccccagccgccacccggccagctttgcctggagagctac

SEQ ID NO: 70282 - DNA, 201 bp, Homo sapiens
ggcgtgaacccaggaggcagagcttgcagtgagccaagatcttgccactgcactccaggctgggcgacagagcaagactccgtctcaaaaaaaaaaaaaaatcactactgccaatgtggcactgtagattagcaatactgattatatctgatggaggacaacagatgttatcatgtgcaaatttaggatgctgaagaagtg

SEQ ID NO: 70283 - DNA, 201 bp, Homo sapiens
tgggaggctgaggcaggtggatcacttgaggtcaggagttcgagaacagcctggccaatatggtgaaaccccgtctctactaaaaatacaaaaattagccrggcgtggtggcacgcacttgtagtcccaactactcgggaggctgagacaggagaattgcttgaacccaggaggcagaggttgcagtgagtgaagatcatg

SEQ ID NO: 70284 - DNA, 201 bp, Homo sapiens
agctacaaggttaacaaactattgttttttcagaaataggattataaaatgtgagaacacaatgcactattttgaaacattgaaaataccatatctggccyggcacggtggctcactcttgtaatcccagcactttgggaggctgaggcaggtggatcacttgaggtcaggagttcgagaacagcctggccaatatggtga

SEQ ID NO: 70285 - DNA, 201 bp, Homo sapiens
atctccacccccagaagcacccgacgtctctcctactcgacctcacaggtgcgccccatgcacagtcctgcccagcacaagcacatggcctcactcccacrtctccttatttccctgacacagcctcaccctccactcaggctcaggattaaatgaggaaatatagggaaagatatgaacactattctcaaatctttccct

SEQ ID NO: 70286 - DNA, 201 bp, Homo sapiens
cagtgagccaagatcccgccactgcactccagcctgggggacagagcaagactctgtctcaaaaaaaacaaaacaacaacaacaaaaaagttagccgggcrttgtggtgcatgcctgtaatcccagctactcgggaggctgaggcaggagaattgcttgaatctgggaggcagaggttgcagaaagcggagatcgcaacat

SEQ ID NO: 70287 - DNA, 201 bp, Homo sapiens
actgacacctggtttcaggtgactttaaaagggacctattctgagagactccgtttcacaggagcttctttcagtgtggccagggccctctaggatctcaytgccctttcctccgtctcctcccagcctccctgcacttgctgtcctccagccattccttgccatttcttttcaaaggcacgctcctgcctcagggccttt

SEQ ID NO: 70288 - DNA, 201 bp, Homo sapiens
tctgcctcccagcttcaagcgattctcctgcctcagactcccgagtagctgggattacaggcacctgccaccacgcccaatttttttttttttttttttgkattttttagtagagacggggttttgccatgttggccaggctcgtcttgaactcctgacttcaggtgatccacccgtctcggtcttccaaagtgctgggat

SEQ ID NO: 70289 - DNA, 201 bp, Homo sapiens
tccgggaagcagagcctgcagtgagccaagatcccgccactgcactccagcctgggggacagagcaagactctgtctcaaaaaaaacaaaacaacaacaamaaaaaagttagccgggcgttgtggtgcatgcctgtaatcccagctactcgggaggctgaggcaggagaattgcttgaatctgggaggcagaggttgcaga

SEQ ID NO: 70290 - DNA, 201 bp, Homo sapiens
ccactcccagctgagcacacccactattagaagcatccccacactcactgtgagccccactgacctccagggatttgggctgtgggtgtctgtggaacccragtggaacctctgctccagcagctggggctttgtttcacttaatcaaatctttaaatgttatagagatgagacaattattatatttgctttctcaccctt

SEQ ID NO: 70291 - DNA, 201 bp, Homo sapiens
ctctaggatctcattgccctttcctccgtctcctcccagcctccctgcacttgctgtcctccagccattccttgccatttcttttcaaaggcacgctcctrcctcagggcctttgcacttactgtcttcccccacaaatagccctgttgctcactcccctcatatcctctggtctctgctcagatgctgccctatcagaga

SEQ ID NO: 70292 - DNA, 201 bp, Homo sapiens
aaaaatattaaataaataaatgtggttaatgtaaccaatcatggtgtacttttttaatttattattattatttttttttttgagacagagtctcactcttktcatctaggctagagtgcactgacataatcggctcactgcaaccttcacctcccaggtttaagcgattcttgtgcctcagcctcctgagtagctaggatt

SEQ ID NO: 70293 - DNA, 201 bp, Homo sapiens
acggggttttgccatgttggccaggctcgtcttgaactcctgacttcaggtgatccacccgtctcggtcttccaaagtgctgggattacaggcctgagccrccgcgcccagccaggtcttgggcttttcataggctccctgggcatctttcaaggtgtggaaatttgaaagccaggaacaatctgccatacatcaggaagc

SEQ ID NO: 70294 - DNA, 201 bp, Homo sapiens
atagtacccttcagtttttgaaatagtttagaaagcagtgatactgggggcacttaaatatatttttaaagtggttaggccgggcgctgtggctcatgccwgtaatcccagcactttgggaggccaaggcaagtggatcacctgacgtcaggagttcaagaccagcctgcccaacatggtcaaacgccatctctactaaaa

SEQ ID NO: 70295 - DNA, 201 bp, Homo sapiens
aaaaaaagatagattcaaaatctgataacagtaggtttggggatggccccgaggtcttgggcttttcttttctctctctctttttttttttttttttttttgagatggagtcttgctctgtcgccaggctggaatgcgatggtgcaatctcagctcactgcaacctctgcctcccagcttcaagcgattctcctgcctcag

SEQ ID NO: 70296 - DNA, 201 bp, Homo sapiens
tgcagaaagcggagatcgcaacattggactccagcctggtcaagaagagcaaaactccatctcaaataataataataataataataaaataataaataaamagcattactgtggctggccacacaggagcctcctagaagagtctacagcattgtgaggtgttcattatctttgggcagaaggaatacatgtgatctttat

SEQ ID NO: 70297 - DNA, 201 bp, Homo sapiens
tgatattaaggattcacttttaaaattataaagtttgccaggtacagtggctcacacctgtaatcctagcactttagcactttgggagacagaggcagcargatggcttcagaccaagattcaagaacagcctgggccccctagcaagacctccatctctacaaaaaataaacattagcctggtgtggtggtgtgtacctg

SEQ ID NO: 70298 - DNA, 201 bp, Homo sapiens
cccgtatttactaaaatacaaaaaattagcgggtgtggtggtgggcgcctgtagtcccagctactcgggaggctgaggcaggagaatggcatgaatccggraagcagagcctgcagtgagccaagatcccgccactgcactccagcctgggggacagagcaagactctgtctcaaaaaaaacaaaacaacaacaacaaaaa

SEQ ID NO: 70299 - DNA, 201 bp, Homo sapiens
aatacagtggcaagatctcagctcactgcagcctcctcctccctggttcaaacaattcttatgcctcagctgggactacaggcgcacaccaccactcctgrctaatttttgtatttttagtagagaaaacgcttcaccattttggccaggctggtcttgaactcctgacctcaggtgatctgcccgcctcggcctcccaaa

SEQ ID NO: 70300 - DNA, 201 bp, Homo sapiens
gaaaccccgtatttactaaaatacaaaaaattagcgggtgtggtggtgggcgcctgtagtcccagctactcgggaggctgaggcaggagaatggcatgaayccgggaagcagagcctgcagtgagccaagatcccgccactgcactccagcctgggggacagagcaagactctgtctcaaaaaaaacaaaacaacaacaac

SEQ ID NO: 70301 - DNA, 201 bp, Homo sapiens
tacataaaacttactgacacggaagatgcccacttcatatgcggtgtgcgtcatggccccattgtagagccttctttcattttaaacagcattactggccrggcacggtggctcatgcctgtaatcccagaactttgggaggccaaggcaggtaaatcacctgaggtcaggagttcaagaccagcctgaccaacatggtga

SEQ ID NO: 70302 - DNA, 201 bp, Homo sapiens
atcgcttgagccccggaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaaa

SEQ ID NO: 70303 - DNA, 201 bp, Homo sapiens
attccttgccatttcttttcaaaggcacgctcctgcctcagggcctttgcacttactgtcttcccccacaaatagccctgttgctcactcccctcatatcstctggtctctgctcagatgctgccctatcagagagaatctcctgacacaaccactctcccctttccttttctttcagggaatgggccactcctggcaccc

SEQ ID NO: 70304 - DNA, 201 bp, Homo sapiens
aagaaagaaagaaagaaaagagaaagaaagaaagagaaagaaagaaagaaaataccatatctaagggatatacatctctgctgctaattcaagttggtttwtagaatatgtgtttctgggccaggcgtggtggcttacgtctgtaatcccaacattttgggaggctaaagctcgcagatcacttgaggtcaggaggtcgag

SEQ ID NO: 70305 - DNA, 201 bp, Homo sapiens
cccacgagacctgatgggaagcgggttaaggtggtttcatgttgaccatgtgtccacaggcttcgcagaccaagagcaagtcggcacaccaggacaggcayttgcatgggtgcccagaagtttcaagatctgaccttggagagaccaggtccgggaggctgccgggaagtctccatcacaccggcctcagccgagtcacag

SEQ ID NO: 70306 - DNA, 201 bp, Homo sapiens
ctccatcacaccggcctcagccgagtcacaggaacgcaggctctgccatgcccagaagcctgagatgcaacttcaaggacaacgggagccagaacgcttgrcctcacacggaaggtgactcctaaccaccaccacacttgacgtagcaccagcacacggagattaggtgagagtgggctctggtgcaaagataacagtgct

SEQ ID NO: 70307 - DNA, 201 bp, Homo sapiens
tccatcacaccggcctcagccgagtcacaggaacgcaggctctgccatgcccagaagcctgagatgcaacttcaaggacaacgggagccagaacgcttgayctcacacggaaggtgactcctaaccaccaccacacttgacgtagcaccagcacacggagattaggtgagagtgggctctggtgcaaagataacagtgctg

SEQ ID NO: 70308 - DNA, 201 bp, Homo sapiens
gcaatcttagttcactgcaacctctgcctcccgggttcaagcgattcttatgcctcagcttctcaagtagctgggattactggcccgcgtccccaagcccrgctaatttttgtatttgtagtagagatgcggtttcaccatgttggccaggctgggcttgaactcctggcctcaagtgatccacctgcctcagcctcctaa

SEQ ID NO: 70309 - DNA, 201 bp, Homo sapiens
ttgcaccagacacatttcaatataacttcccaattttaaaactttactatcaacaaattcaattttctttagaaaaggagatttttaaaattctacttagwctgggcacagtggctcatacctataatccaaggggatttaggaggccaaaacaagtaaattccttgggcccaggagtttgacaccagcctgggcaaaata

SEQ ID NO: 70310 - DNA, 201 bp, Homo sapiens
actcactcaaaccacaatctaattttttgctctacaggcttccattctactcagttactttctacttagcactttagatgtttttatcctcatttttacawctatcccttgatattttctatgtatgtttcaaaggccacaaagaggttaatgtaaccattctcccaggctcccctgataaagctgaactttaaatttagg

SEQ ID NO: 70311 - DNA, 201 bp, Homo sapiens
agcaattaaataactttcacagagtccaaagagacatgccacagaggtcaaggcacctgtcatctgacttcaggctcctggatctccaaacctcttcctgygcaaactccacagccaaaagaacacaggtaccccacgtggcacaagcagccttcttctaaaagatttcagaaaattaaataagcactagcatcatacctg

SEQ ID NO: 70312 - DNA, 201 bp, Homo sapiens
gaaacagactttggttttgaaatttgtcaggaataactgtcagaactgtaagagtccaagcagtgcatgtggcaccttacaattatcttcatattcttctrgaaaaccacagcaattaaataactttcacagagtccaaagagacatgccacagaggtcaaggcacctgtcatctgacttcaggctcctggatctccaaac

SEQ ID NO: 70313 - DNA, 201 bp, Homo sapiens
aggaagaccaaatacatatttcacaatatcacaccttccaagtgtatgaccctgtacctaagagataacacatgttaaaatcagatacaaaacagatagtrccatcccgtgatttttctgtagaatgtgcttttcctccaaatgccaggaaatggcataacagagactaaaattcagagtgcttgctcttctttttagtgg

SEQ ID NO: 70314 - DNA, 201 bp, Homo sapiens
ggccctctaggatctcattgccctttcctccgtctcctcccagcctccctgcacttgctgtcctccagccattccttgccatttcttttcaaaggcacgcycctgcctcagggcctttgcacttactgtcttcccccacaaatagccctgttgctcactcccctcatatcctctggtctctgctcagatgctgccctatca

SEQ ID NO: 70315 - DNA, 201 bp, Homo sapiens
gttcaagtgattctcctgcctcagcctcccaagtagctgggactacaggcctagctaatttttatatttttagtagagacggggttttaccacaccaccaygctcagctaatttttatatttttagtagagacagggttttaccatgttggccaggatggtctccatctcttgatctcgtgatccgcccactcaggcctcc

SEQ ID NO: 70316 - DNA, 201 bp, Homo sapiens
gctctgtcaccaggctggagtgcagtggcgcgatctcgactcactgcaacctccacctcccgggttcaagtgattctcctgcctcagcctcccaagtagcygggactacaggcctagctaatttttatatttttagtagagacggggttttaccacaccaccatgctcagctaatttttatatttttagtagagacagggt

SEQ ID NO: 70317 - DNA, 201 bp, Homo sapiens
ataatgccttgcacctaacaggtgcttaaatatgtatatttgtgcaacaaaacccaaaatgaacccaatttttgttttttctttttctttttctttttttytttttttttttttttttttgagacagagtctcactctgtcacccaggctggaatacagtggcaagatctcagctcactgcagcctcctcctccctggttc

SEQ ID NO: 70318 - DNA, 201 bp, Homo sapiens
atcagaacaggacagtgggaagggcccggagaagcatctgcacctgactccccaggggcaaggtgggctggaggtaggtgacaaggtttggctcccaaacrggcactggccaaaaacaaatggaccagcagggccaagtgacatggcagaagaccaggtgggtgactcggtcaacactttcaaacatccccaaagttatag

SEQ ID NO: 70319 - DNA, 201 bp, Homo sapiens
taaccagttgaaggctttaagagcaaaaattgaggttttagagggaaggaattctgccgcgactttagcatcaattcttgcacatttcctgcctgtcctgyacatttcagacttgccagtccccacaatcacacaggccaattccttgaaatgaatcttttctatatcttacatacaaatgcatatgtttctctagagaac

SEQ ID NO: 70320 - DNA, 201 bp, Homo sapiens
cactgcccactcccagcctcctttccacgttgagagcccagggagggcatctaacctactccccaatctgcaaatctaatctccacccccagaagcacccracgtctctcctactcgacctcacaggtgcgccccatgcacagtcctgcccagcacaagcacatggcctcactcccacgtctccttatttccctgacacag

SEQ ID NO: 70321 - DNA, 201 bp, Homo sapiens
tgatacaaccttgcagaaagctggagtgggaatgccatttctccattggccttctcgttcttctctgtcatcccacctccagctgctaacgccccaggccycactgcccactcccagcctcctttccacgttgagagcccagggagggcatctaacctactccccaatctgcaaatctaatctccacccccagaagcaccc

SEQ ID NO: 70322 - DNA, 201 bp, Homo sapiens
ctgacatgcacgacttcaatgatacaaccttgcagaaagctggagtgggaatgccatttctccattggccttctcgttcttctctgtcatcccacctccarctgctaacgccccaggccccactgcccactcccagcctcctttccacgttgagagcccagggagggcatctaacctactccccaatctgcaaatctaatc

SEQ ID NO: 70323 - DNA, 201 bp, Homo sapiens
ctttaatactaatttcatttggtgtcacccaagtcctacccagccttgactcggccctgctcctccagtcttacccctctacccacacatctagaaggctsacatgcacgacttcaatgatacaaccttgcagaaagctggagtgggaatgccatttctccattggccttctcgttcttctctgtcatcccacctccagct

SEQ ID NO: 70324 - DNA, 201 bp, Homo sapiens
ctctctctttccattcctagtcctagaaacttttaaaggatcctctgagtgtctgacaatcaccagggcccatagagctcagaaaatgccctcccatgacwccacttctgcaaatcctccaaagctgcttctttggaataagctacaaggttaacaaactattgttttttcagaaataggattataaaatgtgagaacaca

SEQ ID NO: 70325 - DNA, 201 bp, Homo sapiens
cggtttcaccatgttggccaggctgggcttgaactcctggcctcaagtgatccacctgcctcagcctcctaaagttctgggattacaggcatgagccaccrtgcccggcctctgtcctccagaatttttattttgctgcataaatgtaatgatattagggatctgttaggtattccatacatctacttatctgaataactt

SEQ ID NO: 70326 - DNA, 201 bp, Homo sapiens
gacccccataagggatccaccacagtgaaaccagttgaactgccctttcctgagcctctctgtgctccaggcactgccccatccctcccacgagacctgaygggaagcgggttaaggtggtttcatgttgaccatgtgtccacaggcttcgcagaccaagagcaagtcggcacaccaggacaggcatttgcatgggtgccc

SEQ ID NO: 70327 - DNA, 201 bp, Homo sapiens
ataaaatacgagaaaaacaagagcttcccatgagctcttgactatcccaggatcacacccagtttgggctagaaagacccccataagggatccaccacagygaaaccagttgaactgccctttcctgagcctctctgtgctccaggcactgccccatccctcccacgagacctgatgggaagcgggttaaggtggtttcat

SEQ ID NO: 70328 - DNA, 201 bp, Homo sapiens
aaaactccacgttcctataaaatacgagaaaaacaagagcttcccatgagctcttgactatcccaggatcacacccagtttgggctagaaagacccccatragggatccaccacagtgaaaccagttgaactgccctttcctgagcctctctgtgctccaggcactgccccatccctcccacgagacctgatgggaagcgg

SEQ ID NO: 70329 - DNA, 201 bp, Homo sapiens
tcaccaggggtgaagggaactggcaacaagtcaggtggccaagactcaaagcctgccaagaccactgggcacttttttggacttcctgaaaactccacgtkcctataaaatacgagaaaaacaagagcttcccatgagctcttgactatcccaggatcacacccagtttgggctagaaagacccccataagggatccacca

SEQ ID NO: 70330 - DNA, 201 bp, Homo sapiens
ggtcaccaggggtgaagggaactggcaacaagtcaggtggccaagactcaaagcctgccaagaccactgggcacttttttggacttcctgaaaactccacrttcctataaaatacgagaaaaacaagagcttcccatgagctcttgactatcccaggatcacacccagtttgggctagaaagacccccataagggatccac

SEQ ID NO: 70331 - DNA, 201 bp, Homo sapiens
ttaaaataattacgggtttttatttcattcaaaagcactaagaggccaggagcggtggctcacgcctataattccagaacttttggaggctgaggcgggcrggtcacttgaggccaggagtttgagaccagcccagccaacatggcaaaaccccgtctctactaaaaatacaaaaattagccaggcgtggtggtgcacacc

SEQ ID NO: 70332 - DNA, 201 bp, Homo sapiens
gcctgggcattacagcaaaatgctgtcaaaaaaaaaaaaaggagagagagagaaaagagaaagaaagagagagagaaagaaagaaagagaaagagaaagaragaaagaaagaaagaaagaaagaaagaaagaaagaaagaaagaaagaaagaaaagagaaagaaagaaagagaaagaaagaaagaaaataccatatctaag

SEQ ID NO: 70333 - DNA, 201 bp, Homo sapiens
gggcattacagcaaaatgctgtcaaaaaaaaaaaaaggagagagagagaaaagagaaagaaagagagagagaaagaaagaaagagaaagagaaagaaagaragaaagaaagaaagaaagaaagaaagaaagaaagaaagaaagaaagaaaagagaaagaaagaaagagaaagaaagaaagaaaataccatatctaagggat

SEQ ID NO: 70334 - DNA, 201 bp, Homo sapiens
tcaggcagtgggatgggtgataggaatgggtttattgacttcatagagtataaaataaacaattcaaatacacccaaatgcactctttcataaaagaaackgaagtaacaaattctgaccccatgatgagaccccagataaacgttaggggtcaccaggggtgaagggaactggcaacaagtcaggtggccaagactcaaa

SEQ ID NO: 70335 - DNA, 201 bp, Homo sapiens
aatcgcttgagccccggaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaa

SEQ ID NO: 70336 - DNA, 201 bp, Homo sapiens
ccccatctctactaaaaatacaaaattagctgggcatggtggtgcatgcctgtaatcccagctactcaggaggctgaggcaggagaatcgcttgagccccrgaagcggaggttgcggtgagccaagatcaagccattgcactccagcctgggcaacaagagtaaaactctgtctcaaaaaaaaaaaagagacaggcatccc

SEQ ID NO: 70337 - DNA, 201 bp, Homo sapiens
tataaccaagctcaaaataatgcaaaactttgattatatatgttgttaccatggttaacaaatgtattcttccatctgagaatcctcagtagtacagagaraggttttgcatttagaattctatttagactttttattccttgaagcatcaaaagtacataaacaccccaaaaggttatatcagaagtcaaagcattatga

SEQ ID NO: 70338 - DNA, 201 bp, Homo sapiens
tcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatcc

SEQ ID NO: 70339 - DNA, 201 bp, Homo sapiens
ttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatc

SEQ ID NO: 70340 - DNA, 201 bp, Homo sapiens
tttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacat

SEQ ID NO: 70341 - DNA, 201 bp, Homo sapiens
ttacaaaaactgtgcctgggaaaggagcccagtgatcacttgttcactgtgtgtgtctgggaaaaagtacatagataatatataagtactatataaataawtttttttttttttttgagatggaatatcgctctgtcacccaggctggagtgcagtggcgcgatcttggctcactgcaagttctgcctccctggttcatgc

SEQ ID NO: 70342 - DNA, 201 bp, Homo sapiens
ctccctctgagtctaccagtctatgttggacagacaagaacacctgtttagttctaattttttctttctttctttctttcttttttttttttttttgagaygaagtttcactcttgttgcccaggctggagtgcaatggcgatcttggctcactgcaacctccaccttccaggtacaaacaattctcctgactcagcctcc

SEQ ID NO: 70343 - DNA, 201 bp, Homo sapiens
tcagcttcctgggctcaagctatcctctctcttcagcttaccaaattgttgggactacaggtgcacaccaccacatccagctaatttttaattttttatasagacagggtcttgctaattgcccaggctggtcttgaacttctggactcaagcaatcctcccatcttggcctcccaaatttctcggattacaggcataaac

SEQ ID NO: 70344 - DNA, 201 bp, Homo sapiens
cagtttccgaacattggaatactccctctgagtctaccagtctatgttggacagacaagaacacctgtttagttctaattttttctttctttctttctttyttttttttttttttttgagacgaagtttcactcttgttgcccaggctggagtgcaatggcgatcttggctcactgcaacctccaccttccaggtacaaac

SEQ ID NO: 70345 - DNA, 201 bp, Homo sapiens
tccagcctgggcattacagcaaaatgctgtcaaaaaaaaaaaaaggagagagagagaaaagagaaagaaagagagagagaaagaaagaaagagaaagagaragaaagaaagaaagaaagaaagaaagaaagaaagaaagaaagaaagaaagaaagaaaagagaaagaaagaaagagaaagaaagaaagaaaataccatatc

SEQ ID NO: 70346 - DNA, 201 bp, Homo sapiens
atggggccaggtatggtggctcacgcctgtaatcccagcactttgggaagccaaggcaggtagatcacaaagtcaggagttcgagaccagcctggccaacrtggtgaaaccctgtcactactaaaaatacaaaaattagccaggcatggtggcaggtgcctgtaatcccagctacttgggaggctgagggaggagaatcgc

SEQ ID NO: 70347 - DNA, 201 bp, Homo sapiens
ttagacccctagtggaggaaaatttagatcaacagggacaggacccacctcagtgtggagttaggtttaaccacaaagtcttagacatttattattcatttcactttactttgaggaaggactcgttattggttgctctgtacatgttaaaagtcaaggatggggccaggtatggtggctcacgcctgtaatcccagcact

SEQ ID NO: 70348 - DNA, 201 bp, Homo sapiens
cagctcactgcagcctcctcctccctggttcaaacaattcttatgcctcagctgggactacaggcgcacaccaccactcctgactaatttttgtatttttrgtagagaaaacgcttcaccattttggccaggctggtcttgaactcctgacctcaggtgatctgcccgcctcggcctcccaaagtgctgggattacaggcg

SEQ ID NO: 70349 - DNA, 201 bp, Homo sapiens
aatcatacattttgtaaaagagatccaaactcaattaatttcttttctaaattctccctgagtccacaaccagtctgtttcacatcaaaggagcctgttcrtctttgaaaatggataaaagagaatttaattgtttgaatttgagctcaaatcacaagtctggctttaatactaatttcatttggtgtcacccaagtccta

SEQ ID NO: 70350 - DNA, 201 bp, Homo sapiens
ttttctttcagggaatgggccactcctggcaccctgcacattttagcatttgtttcctgtctctccccactagaatgcaagctgcagaggaattgtatccrtagcacctggtaagtgctcaatgaccactttttcaaggaccacatttccataatattaaaatgtattatgagagggaagagcagtgaattttcctgttat

SEQ ID NO: 70351 - DNA, 201 bp, Homo sapiens
gaactgttgtcctgtcttaaatgaaaacaaaggtcaggaaatgcacacactgaataaagagtagaaatgatttattttaaaaatcatacattttgtaaaasagatccaaactcaattaatttcttttctaaattctccctgagtccacaaccagtctgtttcacatcaaaggagcctgttcgtctttgaaaatggataaaa

SEQ ID NO: 70352 - DNA, 201 bp, Homo sapiens
ggaagagcagtgaattttcctgttatctgcactggccacgtgttgcctgagcatgtgcctctatgtgtgtaattgagtctctctgtgcctcactttccttrtctgttaaatgggagttacaatattatcacctccacaaagttatggaaattaaatcacaggtggggattgtgcctggcaggcagcaagcactcggtaagt

SEQ ID NO: 70353 - DNA, 201 bp, Homo sapiens
gaaagagatttcaaagaacgaaggaaaaacttccttatcttcttcttcttctccttattcttcttttttcttttagtagagacagggttttgtcctccagrttgcagcacagtggcaagttatgctcactgtaccctggaactcctgggctcaaggagtcctcaagcctcccaagcagctaggagcacaagtgcatgtcac

SEQ ID NO: 70354 - DNA, 201 bp, Homo sapiens
aaggaccacatttccataatattaaaatgtattatgagagggaagagcagtgaattttcctgttatctgcactggccacgtgttgcctgagcatgtgcctytatgtgtgtaattgagtctctctgtgcctcactttccttgtctgttaaatgggagttacaatattatcacctccacaaagttatggaaattaaatcacag

SEQ ID NO: 70355 - DNA, 201 bp, Homo sapiens
aaagttagccgggcgttgtggtgcatgcctgtaatcccagctactcgggaggctgaggcaggagaattgcttgaatctgggaggcagaggttgcagaaagyggagatcgcaacattggactccagcctggtcaagaagagcaaaactccatctcaaataataataataataataataaaataataaataaaaagcattact

SEQ ID NO: 70356 - DNA, 201 bp, Homo sapiens
tcctctggtctctgctcagatgctgccctatcagagagaatctcctgacacaaccactctcccctttccttttctttcagggaatgggccactcctggcaycctgcacattttagcatttgtttcctgtctctccccactagaatgcaagctgcagaggaattgtatccgtagcacctggtaagtgctcaatgaccacttt

SEQ ID NO: 70357 - DNA, 201 bp, Homo sapiens
aatatgaagctaaattggtgttccaggcattgtatgggttgcatacatattggcatgcacacacatacacacaatgcacacactattaaacttctggcaarcaatgacttttgacccaagcagagagaatttggaaactgaaaggaggcaagagagggtgagtcacagttaacatcaatcaaaggtccagtgtcaagccag

SEQ ID NO: 70358 - DNA, 201 bp, Homo sapiens
actttgcacagaatcaagggcccataatggcacactgtttctttgtttaaaatatcaggacccagaggagaaagagagctcatgtaccatttggcatgggmtacacagtgatccatagtaccttctaatgtggatgcagaacttttaacatataagactttgacatgatgttggaatcatggtctgttaaaatatgaagct

SEQ ID NO: 70359 - DNA, 201 bp, Homo sapiens
ctaggtaagtaaggcaaagtggtatggccaaaagctagtgccaggtgagtaaggcctaattgctaaggccaggagatcaaaaccaggtggataataccagrtgggtaagcacaatgggtaagaccatgaggttaagaccaggtgagtaacaccagaaggttaatagaaacaggctggtaaggcaaggaggttaaggccagg

SEQ ID NO: 70360 - DNA, 201 bp, Homo sapiens
ggctgagacttcgcgtcttaacaagctgctctcagttgatgctgatcctcatggtaccttggttcccagaccccattttaagcagcaaggctgcagaaaayagatgccctaggttaaatatgggggagtcctctccatggccaggcctggtaccagcgcccacaccaattctggatagctctttcccatctgttatcttct

SEQ ID NO: 70361 - DNA, 201 bp, Homo sapiens
ctcttccacggatccacaacctaagaggaagcctcagaggcacaggctctgggagtaccaggtggcagcttcaacccagaagcgcactcgagtgcagtgcrcttgaactctccaggtcaactgtggaaggccccttagctcaggcagtgggatgggtgataggaatgggtttattgacttcatagagtataaaataaacaa

SEQ ID NO: 70362 - DNA, 201 bp, Homo sapiens
gtaggtgacaaggtttggctcccaaacgggcactggccaaaaacaaatggaccagcagggccaagtgacatggcagaagaccaggtgggtgactcggtcamcactttcaaacatccccaaagttatagtaagcatcaagagaccacttactagagtctcactgttaagagtaaaaagagattgtgtatgcaaacaattaga

SEQ ID NO: 70363 - DNA, 201 bp, Homo sapiens
gtgggctggaggtaggtgacaaggtttggctcccaaacgggcactggccaaaaacaaatggaccagcagggccaagtgacatggcagaagaccaggtgggkgactcggtcaacactttcaaacatccccaaagttatagtaagcatcaagagaccacttactagagtctcactgttaagagtaaaaagagattgtgtatgc

SEQ ID NO: 70364 - DNA, 201 bp, Homo sapiens
tctgtaaatgctgagtcatttccagattggagaatgatttaagcaaagatggtgaggaggttagaaagctcttaggaaacggttgtcaacggtaaactcaygtcccagtttgaaacatgaaacactgtgaaactatgagagggcagaaaaataagacttcggaaaaatggaggtgagggtctagaagcctcaatgaagtag

SEQ ID NO: 70365 - DNA, 201 bp, Homo sapiens
taactatagacaaccagaaccaaggatcggcagttgttacatggaggaaggaaaaagatttgaactaatgaaaagaacaataataatagcagctaatagcrgcatattttttttcttttttgagacaagatctcactatgttgcccaggctgaactcaaagaactcctgggctcaagagatcctcctgacttagcctcaga

SEQ ID NO: 70366 - DNA, 201 bp, Homo sapiens
cggccagctttgcctggagagctactgagattttccactatctagtcttgggatgctgaagcctcaagaggttaggaatgaatgcaattctcacccacctracaatgttggtatgcaagctttggttgctttggttggtatgagaccacctcatcctactggagaagttattttcttgtctttcaccatggaatcatttac

SEQ ID NO: 70367 - DNA, 201 bp, Homo sapiens
ctggatgcttttcagacatggtgggtgagcgttctgaatcccaaccccgcccccaatgccccccagccgccacccggccagctttgcctggagagctactragattttccactatctagtcttgggatgctgaagcctcaagaggttaggaatgaatgcaattctcacccacctgacaatgttggtatgcaagctttggtt

SEQ ID NO: 70368 - DNA, 201 bp, Homo sapiens
gccataatgccttgcacctaacaggtgcttaaatatgtatatttgtgcaacaaaacccaaaatgaacccaatttttgttttttctttttctttttcttttyttttttttttttttttttttttgagacagagtctcactctgtcacccaggctggaatacagtggcaagatctcagctcactgcagcctcctcctccctgg

SEQ ID NO: 70369 - DNA, 201 bp, Homo sapiens
cattgtccctgttgttcttgggggaacctccctccgcattagcagaatatgatcagctattctagcttcccaggaagtgtgcatgaggcctttctaattahtgtacttgttaaaaacataaactcattaaatggtactacttattctgaatttgtgttaattactcaaactatagctcattaataaagacagtttattata

SEQ ID NO: 70370 - DNA, 201 bp, Homo sapiens
cactccagcctgggtgacagagcaagactccacctcaaaaaaaaaagaactgaggtctccctttgttgcccaggctggtgtcaaactcctggcaccgaggrtccacctgcttctccttccaaaagcattgggattacagacatgagccaccatgcccggcctgtgtgcttttcagaatatcatagtcaacactgaattgtg

SEQ ID NO: 70371 - DNA, 201 bp, Homo sapiens
agcctcccaagtagctgagaccacaggaacgcaccaccatgcctggctaatttttaaaaatttttatagaaatggggtctcggccaggcgcagtggctcaygcctataatcccagcactttgggaggccgaggcaggcgcatcacgaggtcaggagttccagaccagcctaaccaacatggtgaaaccccgtctctactaa

SEQ ID NO: 70372 - DNA, 201 bp, Homo sapiens
ctctgtcattcaggctggagtgcactggcaccatcatgactcactgcagccatcatggctcacagcagccttaacctcccaggctcaagctatcctcccayctcagcctcccaagtagctgagaccacaggaacgcaccaccatgcctggctaatttttaaaaatttttatagaaatggggtctcggccaggcgcagtggc

SEQ ID NO: 70373 - DNA, 201 bp, Homo sapiens
tatgccagcactagtgcccagaaagtgcaggcagttccagctgttgccacaactgctgcctagacaattggcctatcagggcagtgttgggggaccagggrttgcaagagaaccagcttttaaaaacagcattgaagataaaatggcaaataaagactaaaagttttcagaatccttgtctcagaaggttctaggctgatc

SEQ ID NO: 70374 - DNA, 201 bp, Homo sapiens
actcgttattggttgctctgtacatgttaaaagtcaaggatggggccaggtatggtggctcacgcctgtaatcccagcactttgggaagccaaggcaggtrgatcacaaagtcaggagttcgagaccagcctggccaacatggtgaaaccctgtcactactaaaaatacaaaaattagccaggcatggtggcaggtgcctg

SEQ ID NO: 70375 - DNA, 201 bp, Homo sapiens
catttcactttactttgaggaaggactcgttattggttgctctgtacatgttaaaagtcaaggatggggccaggtatggtggctcacgcctgtaatcccarcactttgggaagccaaggcaggtagatcacaaagtcaggagttcgagaccagcctggccaacatggtgaaaccctgtcactactaaaaatacaaaaatta

SEQ ID NO: 70376 - DNA, 201 bp, Homo sapiens
agtgtgcatgaggcctttctaattaatgtacttgttaaaaacataaactcattaaatggtactacttattctgaatttgtgttaattactcaaactatagytcattaataaagacagtttattatagacctaatccttatttttcaactgctgtcaatcccacatttcaaatcagaaagtgggatttgtagccaccattgc

SEQ ID NO: 70377 - DNA, 201 bp, Homo sapiens
cttcccaggaagtgtgcatgaggcctttctaattaatgtacttgttaaaaacataaactcattaaatggtactacttattctgaatttgtgttaattactyaaactatagctcattaataaagacagtttattatagacctaatccttatttttcaactgctgtcaatcccacatttcaaatcagaaagtgggatttgtag

SEQ ID NO: 70378 - DNA, 201 bp, Homo sapiens
gaacctccctccgcattagcagaatatgatcagctattctagcttcccaggaagtgtgcatgaggcctttctaattaatgtacttgttaaaaacataaacycattaaatggtactacttattctgaatttgtgttaattactcaaactatagctcattaataaagacagtttattatagacctaatccttatttttcaact

SEQ ID NO: 70379 - DNA, 201 bp, Homo sapiens
ttgtgtatgcaaacaattagaaaaatcagaaataactaatgtttaaacaaaacctaacaccgtaatacttcaagacctttgggctcatagtctgcctgacwcataggaagtggacaggatggctcagagcactgtcaaggacctcacttgacctcctgcaagtcagttcttctcaggacaaagtggacttttccacaagtt

SEQ ID NO: 70380 - DNA, 201 bp, Homo sapiens
ctctgtcacccaggctggaatacagtggcaagatctcagctcactgcagcctcctcctccctggttcaaacaattcttatgcctcagctgggactacaggygcacaccaccactcctgactaatttttgtatttttagtagagaaaacgcttcaccattttggccaggctggtcttgaactcctgacctcaggtgatctgc

SEQ ID NO: 70381 - DNA, 201 bp, Homo sapiens
agaaagaaagagagagagaaagaaagaaagagaaagagaaagaaagaaagaaagaaagaaagaaagaaagaaagaaagaaagaaagaaagaaagaaaagakaaagaaagaaagagaaagaaagaaagaaaataccatatctaagggatatacatctctgctgctaattcaagttggtttatagaatatgtgtttctgggcc

SEQ ID NO: 70382 - DNA, 201 bp, Homo sapiens
ctaaatctgaaaaattgctctgaaattagttaacctgggaggcctatcttatttgaggagctctcaaccaaggagaaacctcaagtcactctacacttgaycctgagatctcatatggctccctagtgtattctagaacagttgcttctcaaattctgatgtgaacaagagttgccttggaatcctgcctactgcagatta

SEQ ID NO: 70383 - DNA, 201 bp, Homo sapiens
cctgccaccacgcccagctaattttttgtatttttagtagagacggggtttcaccgtgttagccaggatggtctccatctcctgacctcatgatccacccrccttggcctcccaaagtgctgggattacaagtgtgagccaccacacccagccaataaatgctttcttaaagcaatttacagaattctattttatagtaaa

SEQ ID NO: 70384 - DNA, 201 bp, Homo sapiens
tcttgaactcctgacctcaggtgatctgcccgcctcggcctcccaaagtgctgggattacaggcgtgagccactgcgcctgactccaattttctaaatctraaaaattgctctgaaattagttaacctgggaggcctatcttatttgaggagctctcaaccaaggagaaacctcaagtcactctacacttgatcctgagat

SEQ ID NO: 70385 - DNA, 201 bp, Homo sapiens
gaggaattgtatccgtagcacctggtaagtgctcaatgaccactttttcaaggaccacatttccataatattaaaatgtattatgagagggaagagcagtraattttcctgttatctgcactggccacgtgttgcctgagcatgtgcctctatgtgtgtaattgagtctctctgtgcctcactttccttgtctgttaaatg

SEQ ID NO: 70386 - DNA, 201 bp, Homo sapiens
ttgttgggactacaggtgcacaccaccacatccagctaatttttaattttttatagagacagggtcttgctaattgcccaggctggtcttgaacttctggrctcaagcaatcctcccatcttggcctcccaaatttctcggattacaggcataaaccactcactcaaaccacaatctaattttttgctctacaggcttcca

SEQ ID NO: 70387 - DNA, 201 bp, Homo sapiens
cactggcaccatcatgactcactgcagccatcatggctcacagcagccttaacctcccaggctcaagctatcctcccacctcagcctcccaagtagctgaraccacaggaacgcaccaccatgcctggctaatttttaaaaatttttatagaaatggggtctcggccaggcgcagtggctcatgcctataatcccagcact

SEQ ID NO: 70388 - DNA, 201 bp, Homo sapiens
acaccaaacaatccgttttccagcaggttctccagtggacactagctgggtgtcctctaattcaactcaattttgacactccctacctaaagacagtgttagatctcataggttcaggggttagtctcacaaaactgtccccaacttcagataccagttgcagatctgagcctctagaacttctgacccaccagctacaaa

SEQ ID NO: 70389 - DNA, 201 bp, Homo sapiens
gctctctccagcttctcccaggagaaaggaggatattaaaggagtggttgcaagagggcttcccagcaccaacattaaacaagggaaatgcagtcccatgycaaggctgtaatcatacacagcaggagcaacctggtgaagaccaagcaggcagggtctggcaaagtagctaggccatcaggcagagtgcagatccacccc

SEQ ID NO: 70390 - DNA, 201 bp, Homo sapiens
tccttcaaatagaataagaaatcaaactcaaaacagctgcaggagatggaggtgtatctggtgtttctctccatctcccttctcccagaggaggacctcakgacctgtagctctctccagcttctcccaggagaaaggaggatattaaaggagtggttgcaagagggcttcccagcaccaacattaaacaagggaaatgca

SEQ ID NO: 70391 - DNA, 201 bp, Homo sapiens
cattaaacaagggaaatgcagtcccatgccaaggctgtaatcatacacagcaggagcaacctggtgaagaccaagcaggcagggtctggcaaagtagctargccatcaggcagagtgcagatccacccccaggatacagaagagaccctgtcacaagaccccacattcacattaagacagctaagatgcagacttctgctg

SEQ ID NO: 70392 - DNA, 201 bp, Homo sapiens
tggcaggagaaacttcagtgccatttgtagatgatgacactatggccctgagctcccacatggagccagtgaatttcagtggtctcacttccatcccattsctactttccctctttacgttcgaaaatgtgtttattatacatgtatctgttattctaaaaaatttccttcaaatagaataagaaatcaaactcaaaacag

SEQ ID NO: 70393 - DNA, 201 bp, Homo sapiens
ttttaaaactttactatcaacaaattcaattttctttagaaaaggagatttttaaaattctacttagactgggcacagtggctcatacctataatccaagrggatttaggaggccaaaacaagtaaattccttgggcccaggagtttgacaccagcctgggcaaaatagtgagactccatgtctaaaataaaaaatttttt

SEQ ID NO: 70394 - DNA, 201 bp, Homo sapiens
ttataagccctaagattacccataagggtaattgagagtactgagaggcttcaatatcatcaaattcataattacatcaaacaatatatttatgaatagaygtatttccaaaacaggccccctcaccttttctagagctaagattttgatccataaagacttacttctccattgccttcaattagaccaacctgcagaaaa

SEQ ID NO: 70395 - DNA, 201 bp, Homo sapiens
ttgcgaggccgaggtgggtggatcacctgaggttgggagttcgagaccagcctgaccaaaatggagaaaccccatctctactaaaaatacaaaattagctrggcatggtggtgcatgcctgtaatcccagctactcaggaggctgaggcaggagaatcgcttgagccccggaagcggaggttgcggtgagccaagatcaag

SEQ ID NO: 70396 - DNA, 201 bp, Homo sapiens
aaactatagctcattaataaagacagtttattatagacctaatccttatttttcaactgctgtcaatcccacatttcaaatcagaaagtgggatttgtagycaccattgcatctgtctactttgctactttcagttcaccatccacgtctaccctcattttaactggacttacaataggtaaagatgagaaaggagattca

SEQ ID NO: 70397 - DNA, 201 bp, Homo sapiens
tttgcgaggccgaggtgggtggatcacctgaggttgggagttcgagaccagcctgaccaaaatggagaaaccccatctctactaaaaatacaaaattagcygggcatggtggtgcatgcctgtaatcccagctactcaggaggctgaggcaggagaatcgcttgagccccggaagcggaggttgcggtgagccaagatcaa

SEQ ID NO: 70398 - DNA, 201 bp, Homo sapiens
tacttagcactttagatgtttttatcctcatttttacaactatcccttgatattttctatgtatgtttcaaaggccacaaagaggttaatgtaaccattckcccaggctcccctgataaagctgaactttaaatttaggttttctgaaggccaagtccaaggaaatcttctacataggaaaaaaacaatcaacccaagaag

SEQ ID NO: 70399 - DNA, 201 bp, Homo sapiens
gcgcacaccaccactcctgactaatttttgtatttttagtagagaaaacgcttcaccattttggccaggctggtcttgaactcctgacctcaggtgatctkcccgcctcggcctcccaaagtgctgggattacaggcgtgagccactgcgcctgactccaattttctaaatctgaaaaattgctctgaaattagttaacct

SEQ ID NO: 70400 - DNA, 201 bp, Homo sapiens
gagaaagaaagaagaaggaaagaaagaaagaaagaaaggaaagaaggagggaaggcaggcaggcaggcactgacacctggtttcaggtgactttaaaaggracctattctgagagactccgtttcacaggagcttctttcagtgtggccagggccctctaggatctcattgccctttcctccgtctcctcccagcctccct

SEQ ID NO: 70401 - DNA, 201 bp, Homo sapiens
tggcccttgcctcccacctcctcggctcctgtccaggtttgacagcaagtctggaggaaatacaggaacaaagcacttaactgcactgggcattgccatcrccacctgattgccttaacctggctcctctctctttccattcctagtcctagaaacttttaaaggatcctctgagtgtctgacaatcaccagggcccatag

SEQ ID NO: 70402 - DNA, 201 bp, Homo sapiens
gaggcagcatctccatctgtcaccttggctggagtgatgtggctcactgcagcctcagcttcctgggctcaagctatcctctctcttcagcttaccaaatygttgggactacaggtgcacaccaccacatccagctaatttttaattttttatagagacagggtcttgctaattgcccaggctggtcttgaacttctggac

SEQ ID NO: 70403 - DNA, 201 bp, Homo sapiens
actgaataccaccttccccccagaaagccctcttatcactatattatggacagagaacctcagaggagctactccatttgcccaagtcctcctctaggaargggtagaactggaatttgaaccccactacatgcactggcccttgcctcccacctcctcggctcctgtccaggtttgacagcaagtctggaggaaatacag

SEQ ID NO: 70404 - DNA, 201 bp, Homo sapiens
gcgagtgaagccggaggcatgaggtccagccagctgcagagcccaggtcctccccacacccacccactgctccgccaccagtaacccctgtcacctctgcyggtcgttaatggcgaacaccagcaggaagccgtggccagcacgcatgtactgctctctcatggccccgaactcttcctggcccgcggtgtccaggactgc

SEQ ID NO: 70405 - DNA, 201 bp, Homo sapiens
ctcatcacccctctgtcctcgtcccacagatcctcagccacagaaagccaccctcaagtctggggatgaccccagctcctgtgcccacctctttgggtctrccccctggcccctccagctacctgcttcctggcagcctccctctggggggctgcggttcgaccccccccacccccaccgggctggctgccacgtctgaca

SEQ ID NO: 70406 - DNA, 201 bp, Homo sapiens; identical to SEQ ID NO: 45980

SEQ ID NO: 70407 - DNA, 201 bp, Homo sapiens
agtggggaagcaggatttgccagtcttcatgtgaccagggacggcgtagagcctctctggcctcttccaggtgttggacatggccacggacagcttcctckcagggctggtgagtgtcctggatcccccggatacctgggttcccagccgcctggacctgcggcctggcgagtgagtagctgggcagctggagtgggagag

SEQ ID NO: 70408 - DNA, 201 bp, Homo sapiens
cggccgccgctgctggtccgcccacgcgcaagaagtccaggcgggaacgcaagcgcagcggcgaggccaaggaggccgcctcgtcctcgtcgggcacccakccagcgccgcccgccccggcctcgccctgggactccaagaagcaccgctcgcgggaccgcaagcccggctcccacgcctcgtcgtccgcccgccgccgct

SEQ ID NO: 70409 - DNA, 201 bp, Homo sapiens
ctgtatttggaggaggggttggagggagaggagaagaaggtgcagtcagctatgggcaccagctgtgagccgtgagcaccagttctgtggtagagcaggcmcaccactctgtgccaggtcatgtttaccttgtttaccttgtttcgctgtgtcgcccaggctggagtgcagtggcataatctcagctcactgcaacctcca

SEQ ID NO: 70410 - DNA, 201 bp, Homo sapiens
gtgatccgcccgcctcagcctcccacagtgctgggattacaggcgtgagccactgtgccctgctaccttgtttgttttttttgagacagggtctcactgcrtcccccaggctagagtgcagtggcacagtcacagctcactgcagcctcaaattccccggttcaagttatcctgttgtctcagtctctggagtagctggga

SEQ ID NO: 70411 - DNA, 201 bp, Homo sapiens
gagattgagaccatcctggccaacatggtgaaaccctgtctccattaaaaatacaaaaattagctgggcatggtggcacacgcctctagtcccagctactmgggaggctgaggcaggagaattgcttgaaccaggagatggaggttgcagtgagctgagatcgtgccactgcactccagcctgggtaacagagtgagactc

SEQ ID NO: 70412 - DNA, 201 bp, Homo sapiens
ggacgaatggctgagcgtcgcagcctctgaagtgggtgctgggaagtcctcctgggaggtggcgcatggaggcctggagagcatgcgggaggctggttccrctgtcaggaactagatcaagctcctctttcctctaccccgcaagtctctgcagcaagtcccctgtgtccaatcccccatgcaaatctctcaccagatggc

SEQ ID NO: 70413 - DNA, 201 bp, Homo sapiens
cctcaagtctggggatgaccccagctcctgtgcccacctctttgggtctgccccctggcccctccagctacctgcttcctggcagcctccctctggggggstgcggttcgaccccccccacccccaccgggctggctgccacgtctgacaagagagagggcagcagcagctctgagggccgtggggacacagataaggtga

SEQ ID NO: 70414 - DNA, 201 bp, Homo sapiens
cgtcgggcacccagccagcgccgcccgccccggcctcgccctgggactccaagaagcaccgctcgcgggaccgcaagcccggctcccacgcctcgtcgtcygcccgccgccgctcccgctcccgctcccgctcccgctccacccgccgccgctcgcgcagcaccgaccgccgccgcgggggcagccgcaggtcgcggtccc

SEQ ID NO: 70415 - DNA, 201 bp, Homo sapiens
gggagggattgtggctctgggggtagttaggggcgtgacctcagagcacagcgtgagaagctcagggctgagaactgggagccagcccggaggtggctcargggttttgggaggttatagtatatacagtcttagaaacattgagttcatttatggggtcagagaaactcccaaggaatagatctttctgggggtgccaag

SEQ ID NO: 70416 - DNA, 201 bp, Homo sapiens
tatttagcatgctcccaggaggtgctcaaagccaggtcagcaggtaagcggggtcttaggcactgggagagggaatagtgggtctcgggatgcgagtgcakaaggaagggtcccccgtgcaggggatggaggctctccaagagtttaggttacaatctgtggggatcttttaagattagagggccttataggagggtctca

SEQ ID NO: 70417 - DNA, 201 bp, Homo sapiens
ctgctggcatccttgcctgtggtgtggcctctgtcagccatctccatcgtgtgactgtggcatcatgactgtagtacttagcacagtgcagcgggctcttygggggcgaatgaggtgacatacgaagcaccatgcctggtttggaggaagaggcaaacctttgtcattgccactgtcactggtcagtggtgtctttgagtc

SEQ ID NO: 70418 - DNA, 201 bp, Homo sapiens
ctgccccccgattcgatatctatgaccccttccaccccaccgacgaggcctactctccaccgcctgctccggagcaaaagtacgacccttttgagcccacyggctccaaccccagctcatcagcggggaccccctcacctgaggaggaagaggaggaggaagaggaagaagaagaggaagaggaagacgaggaggaggagg

SEQ ID NO: 70419 - DNA, 201 bp, Homo sapiens
cggcgactcggagatcgaggaaggggagatcgtccagccggaggaggagcccaggctggcgctgtccctcttccgccccggcggccgggccgcccggcctmcaccggccgcctcggccacccccacggcccagccccttcctcagcctcccgctccgcgggcccccgagggggacgacttcttgtccctgcatgcggagtc

SEQ ID NO: 70420 - DNA, 201 bp, Homo sapiens
tgctgcagccgccccaagcactgcccccagcgcggggtccacagccggtgactcgggggcggaggacgggccagcttcccgtgtctcccagctgcccacgytgcccccgcccatgccctggaatctgccagctggtgtggactgcaccaccagcggcgtcctggcctgtgagtgtcccctgggggagggtggtgctggggc

SEQ ID NO: 70421 - DNA, 201 bp, Homo sapiens
aatgataaaggtatggcggcttccggttccttttagcccctgccccctctctgcattctttatcctaatgtcattcatacaagcttttctgaagcctcctrggtgccacccttgtgctggcatggggagccaaaaatgggcagacaccctgtagctgccttggaagggcctagtgtgcagtggaagggagacaggcacagt

SEQ ID NO: 70422 - DNA, 201 bp, Homo sapiens; identical to SEQ ID NO: 45985

SEQ ID NO: 70423 - DNA, 201 bp, Homo sapiens; identical to SEQ ID NO: 45987

SEQ ID NO: 70424 - DNA, 201 bp, Homo sapiens
acatggtgaaaccctgtctccattaaaaatacaaaaattagctgggcatggtggcacacgcctctagtcccagctactcgggaggctgaggcaggagaatygcttgaaccaggagatggaggttgcagtgagctgagatcgtgccactgcactccagcctgggtaacagagtgagactccctctcaaaaaaaaaaaaaaaa

SEQ ID NO: 70425 - DNA, 201 bp, Homo sapiens
cattggcgtcaaattcagccgtgaccgcgagagtcgctcccccttcctcaaacctgacgagcgggcccccactgagatggccaaagcagctccgggcagcrccaagcccaaaaagaccaaggtcaaggccaaggcaggggccaagaaaaccaaggggaccaagggaaagaccaagccatccaagaccaggaaaaaggtccg

SEQ ID NO: 70426 - DNA, 201 bp, Homo sapiens
tctgtatttggaggaggggttggagggagaggagaagaaggtgcagtcagctatgggcaccagctgtgagccgtgagcaccagttctgtggtagagcaggvacaccactctgtgccaggtcatgtttaccttgtttaccttgtttcgctgtgtcgcccaggctggagtgcagtggcataatctcagctcactgcaacctcc

SEQ ID NO: 70427 - DNA, 201 bp, Homo sapiens; identical to SEQ ID NO: 45999

SEQ ID NO: 70428 - DNA, 201 bp, Homo sapiens
gcaggaagccgtggccagcacgcatgtactgctctctcatggccccgaactcttcctggcccgcggtgtccaggactgcagagacagggagaggggccatygtggggaccaggctccccgcagtcacccccaagagccctcagcccccactgacaccacccccatccatcatccatccttgccgccctcactgtccagccg

SEQ ID NO: 70429 - DNA, 201 bp, Homo sapiens
aaacatcctgtgtgagccgcagaggcggggctgcagtttagtcggtcacttgtccgtagcttgtgccttgcgctgcaggactcggacggtgaggaccccctggtctacagtggcccttgctctgccctggtctgtgctctgccctttgccccgctttgcccatccgagatgggtgttggggagcagcgtctctctagagac

SEQ ID NO: 70430 - DNA, 201 bp, Homo sapiens
tgcccacctcgttgaaactgcgagtgaagccggaggcatgaggtccagccagctgcagagcccaggtcctccccacacccacccactgctccgccaccagyaacccctgtcacctctgccggtcgttaatggcgaacaccagcaggaagccgtggccagcacgcatgtactgctctctcatggccccgaactcttcctggc

SEQ ID NO: 70431 - DNA, 201 bp, Homo sapiens
gtttccgtcttgtagcccatgctggagtgcaatggcgcgatcttggcccactgcaacctccgcttcccgggttcaagcgattctcctacctcagcctcccragtagctgggattacaggcgttagccaccacgccaggctaatttttgtatttttagtagagactgggtttcaccatgttggtcaggctggtcttgaactc

SEQ ID NO: 70432 - DNA, 201 bp, Homo sapiens
ctttcaactgcctgactggggaatcatatcaaagaatttccatgacattgcaaaggctttgtgcagatggcgataggtaaatgcctcctgtgaagttttcmttcggcatgtctttctgaagtttagcgttttcattttaaaaatggcatactggttttgcagatcactcaatgaagtttccaacttaggtgtataaataca

SEQ ID NO: 70433 - DNA, 201 bp, Homo sapiens; identical to SEQ ID NO: 46000

SEQ ID NO: 70434 - DNA, 201 bp, Homo sapiens
ttatggctccacctccccacctccctcccccgtcagtgggatgactgggggagggttgctgcagggaagaggagagccccctgccctgccctgccccgtgyccacctcccttgcccccaagcctgtccccagtgcccctcccttctgtttgtgcccctctccccaatttcattaaagatttcatgaaacattacccctgag

SEQ ID NO: 70435 - DNA, 201 bp, Homo sapiens
cttcccccgctgtcgccaccccaccagtatctgaagaagctgcacacgcaggagcgggcggtggaggaggtgaagctggccatcaagccatactatcagargaaggacatcaccaaggaggagtacaaggacatcctgaggaaggccgtccacaaggtgggcacccggagagaggggcagacacaggccggggagagaacg

SEQ ID NO: 70436 - DNA, 201 bp, Homo sapiens; identical to SEQ ID NO: 46002

SEQ ID NO: 70437 - DNA, 201 bp, Homo sapiens
tttttgagacggagtttccgtcttgtagcccatgctggagtgcaatggcgcgatcttggcccactgcaacctccgcttcccgggttcaagcgattctcctrcctcagcctcccgagtagctgggattacaggcgttagccaccacgccaggctaatttttgtatttttagtagagactgggtttcaccatgttggtcaggc

SEQ ID NO: 70438 - DNA, 201 bp, Homo sapiens
gctggactcttggctcccttgaagcacttgagtctagctgtcagtgtctgggatgtctgtctcccaaggggcagaggttgcaaagcatctgcctgggtccyctgacgcttggttcttccccccttccccagcgagccatccagcaggctgtgggaagctccctgcagggggacctgcccaatgataaaggtatggcggctt

SEQ ID NO: 70439 - DNA, 201 bp, Homo sapiens
tatttgtttatttttgagacggagtttccgtcttgtagcccatgctggagtgcaatggcgcgatcttggcccactgcaacctccgcttcccgggttcaagygattctcctacctcagcctcccgagtagctgggattacaggcgttagccaccacgccaggctaatttttgtatttttagtagagactgggtttcaccatg

SEQ ID NO: 70440 - DNA, 201 bp, Homo sapiens
ctgctcacagggaggcaggggccggaccccacctgatcagcatcttcccagctcggctcctgggtgccatgtgcctgccttggaattgctcccagagcagkatctgtgttccccattgagttggcttctcttttcagcagccccgtgaagctggggtgatctcatcaactgtcctgagagggaaactgaggcacagagcag

SEQ ID NO: 70441 - DNA, 201 bp, Homo sapiens
ggcatttcaccacgttggccaggctggtcttgactcctgacctcaggtgatctgccagcctcggcctcccaaagtgcagggattacaggtgtgagccaccrtgcccggccttggttggttggtttttgagacagggtctcgctttgtcacccaagctggcatgcagtggcacagtcacagctcactgtagcctcagccttg

SEQ ID NO: 70442 - DNA, 201 bp, Homo sapiens
gtgcacgtcccctcttcccctccacctccctttactcatcacccctctgtcctcgtcccacagatcctcagccacagaaagccaccctcaagtctggggaygaccccagctcctgtgcccacctctttgggtctgccccctggcccctccagctacctgcttcctggcagcctccctctggggggctgcggttcgaccccc

SEQ ID NO: 70443 - DNA, 201 bp, Homo sapiens; identical to SEQ ID NO: 46007

SEQ ID NO: 70444 - DNA, 201 bp, Homo sapiens
tttgagacggagtttccgtcttgtagcccatgctggagtgcaatggcgcgatcttggcccactgcaacctccgcttcccgggttcaagcgattctcctacytcagcctcccgagtagctgggattacaggcgttagccaccacgccaggctaatttttgtatttttagtagagactgggtttcaccatgttggtcaggctg

SEQ ID NO: 70445 - DNA, 201 bp, Homo sapiens; identical to SEQ ID NO: 46009

SEQ ID NO: 70446 - DNA, 201 bp, Homo sapiens
tgaagtttggataggttgttggggaagctgcgggaattgaggagtgagatgttaaaagcggaggccagggaggcctccctttgacataagaggcacctgaracccagaaaaaaggaagagaattgctcctagtccctggggtgtctgtgctgggtccagcgcccacccaagcacagggtggagtgggaggaggtggaggag

SEQ ID NO: 70447 - DNA, 201 bp, Homo sapiens
gctgtataaaccccattaaacatcctgtgtgagccgcagaggcggggctgcagtttagtcggtcacttgtccgtagcttgtgccttgcgctgcaggactcrgacggtgaggaccccctggtctacagtggcccttgctctgccctggtctgtgctctgccctttgccccgctttgcccatccgagatgggtgttggggagc

SEQ ID NO: 70448 - DNA, 201 bp, Homo sapiens
tgtcacctctgccggtcgttaatggcgaacaccagcaggaagccgtggccagcacgcatgtactgctctctcatggccccgaactcttcctggcccgcggkgtccaggactgcagagacagggagaggggccatcgtggggaccaggctccccgcagtcacccccaagagccctcagcccccactgacaccacccccatcc

SEQ ID NO: 70449 - DNA, 201 bp, Homo sapiens
ttgacataagaggcacctgagacccagaaaaaaggaagagaattgctcctagtccctggggtgtctgtgctgggtccagcgcccacccaagcacagggtgragtgggaggaggtggaggagaggaggggtgccagaggggatgctgagggagatagtgtggggcccttgaggtcttcatgtctatcctctacttccatcct

SEQ ID NO: 70450 - DNA, 201 bp, Homo sapiens
tgccagaggggatgctgagggagatagtgtggggcccttgaggtcttcatgtctatcctctacttccatcctttctcccgggacctccactccaaactctmccccctggacccccaggtgaccatggaggaagaagatgagtctcgagggaagacagaggagtcgggggaggatcggggcgatggtccgccagacagagac

SEQ ID NO: 70451 - DNA, 201 bp, Homo sapiens
gggcagacacaggccggggagagaacgagctggagggacagatgtgtgcagacagatggacgcggatgggagacggggaggaggtcagtctgggaggtgakgagggtgacaggattttctcaaggccacctgggcctgttccgctggccctggggcacccatcgtctagggggacagagggactttggcctggttattggg

SEQ ID NO: 70452 - DNA, 201 bp, Homo sapiens
tgcctctctcagtctctgtccctctctctctaaatgtctgtccctgttgctgggtctctgcccccttttctctgggtctctgtcccgtctgtctctctgartcttttttttttttttttttttttgagacggagtttcgctcttgttgcacaggctggagtgcaatggcgagatctcggctcactgcaacctccgcctcct

SEQ ID NO: 70453 - DNA, 201 bp, Homo sapiens
gaggcacctgagacccagaaaaaaggaagagaattgctcctagtccctggggtgtctgtgctgggtccagcgcccacccaagcacagggtggagtgggagraggtggaggagaggaggggtgccagaggggatgctgagggagatagtgtggggcccttgaggtcttcatgtctatcctctacttccatcctttctcccgg

SEQ ID NO: 70454 - DNA, 201 bp, Homo sapiens
atctgtatttggaggaggggttggagggagaggagaagaaggtgcagtcagctatgggcaccagctgtgagccgtgagcaccagttctgtggtagagcagscacaccactctgtgccaggtcatgtttaccttgtttaccttgtttcgctgtgtcgcccaggctggagtgcagtggcataatctcagctcactgcaacctc

SEQ ID NO: 70455 - DNA, 201 bp, Homo sapiens
tctctgaatcttttttttttttttttttttttgagacggagtttcgctcttgttgcacaggctggagtgcaatggcgagatctcggctcactgcaacctcygcctcctgggttcaagagattctcctgcctcagcctcccaagtagctgggattacaggcatgcgccaccacacctggctaattttgtatttttagtagag

SEQ ID NO: 70456 - DNA, 201 bp, Homo sapiens; identical to SEQ ID NO: 46019

SEQ ID NO: 70457 - DNA, 201 bp, Homo sapiens
tgaagccggaggcatgaggtccagccagctgcagagcccaggtcctccccacacccacccactgctccgccaccagtaacccctgtcacctctgccggtcrttaatggcgaacaccagcaggaagccgtggccagcacgcatgtactgctctctcatggccccgaactcttcctggcccgcggtgtccaggactgcagaga

SEQ ID NO: 70458 - DNA, 201 bp, Homo sapiens
catggccccgaactcttcctggcccgcggtgtccaggactgcagagacagggagaggggccatcgtggggaccaggctccccgcagtcacccccaagagcmctcagcccccactgacaccacccccatccatcatccatccttgccgccctcactgtccagccgggctgggatgccatccacactgcagatcttcgtgtag

SEQ ID NO: 70459 - DNA, 201 bp, Homo sapiens
cccttgtgtccagttgactcacatctctgaaaaatttctgctcagttacaaatgtctgctggtctctttccaatgatactttgtttgtttgtttgatggtwggaaatctgaagaaagttcacttagttaaaatggtgatgtaaagtatatgagtacagtcctaaaatttactaaatgtacatactcaaatttactcaactt

SEQ ID NO: 70460 - DNA, 201 bp, Homo sapiens
tctgaaaaatttctgctcagttacaaatgtctgctggtctctttccaatgatactttgtttgtttgtttgatggttggaaatctgaagaaagttcacttakttaaaatggtgatgtaaagtatatgagtacagtcctaaaatttactaaatgtacatactcaaatttactcaactttaggtcttcagattttaaaaactag

SEQ ID NO: 70461 - DNA, 201 bp, Homo sapiens
aaaatacagtaaaaatgattttctagaaaaataaggaaaaatttttattaaacagatgtgaaattactctgtaaatttcaataaaagcttctatatacttwttctcctgttttgtacttgtcatgaagcagtaacaaatcgttgtgggtcatattttgaatagcactgtacaataactcttctcatgagtgtcccaaagat

SEQ ID NO: 70462 - DNA, 201 bp, Homo sapiens
gtctctttccaatgatactttgtttgtttgtttgatggttggaaatctgaagaaagttcacttagttaaaatggtgatgtaaagtatatgagtacagtccwaaaatttactaaatgtacatactcaaatttactcaactttaggtcttcagattttaaaaactagatgaataatctatcctttaaaaattcaccattaatt

SEQ ID NO: 70463 - DNA, 201 bp, Homo sapiens
taacaacagaaccagcaggagttcttcaaggtagcatagtgcagtaagaaaggtgtagagccagggcaagtaaatttttctctctgtgcctcactactgtyatctttaaaataggaataataatgctatctacctcaaagggttgttaggaggattaattactatttataaagatcctaaaacatctaccattaagtgcaa

SEQ ID NO: 70464 - DNA, 201 bp, Homo sapiens
tctttccaatgatactttgtttgtttgtttgatggttggaaatctgaagaaagttcacttagttaaaatggtgatgtaaagtatatgagtacagtcctaawatttactaaatgtacatactcaaatttactcaactttaggtcttcagattttaaaaactagatgaataatctatcctttaaaaattcaccattaattctt

SEQ ID NO: 70465 - DNA, 201 bp, Homo sapiens
attgataaaatatataccaaaatgtattacaaacataaaacttcatgaggtcagtattattaatttcaaattttgggtttttttctaacattaaattattyaaaacttttatttaaaaatgccacattcaggtaaaaggtagtagatgggaaaatttcagcagtagatatttcagaatacaatggttgtagaaaaagggat

SEQ ID NO: 70466 - DNA, 201 bp, Homo sapiens
ccacatccttgtttcttaaacatcaaatggtgacttgaggagttaaacaagttaataaaacaaaagcattaatacttgacatatttctcttatcactaagwcatcatgccagttagtcaaaaaacaaaaataaattcagagtacctctttcacatgttaaactcattggattatttaaatactaagtgatttaacatagtt

SEQ ID NO: 70467 - DNA, 201 bp, Homo sapiens
gtagctgggactacaggcgggtgccaccactcccagctaatatttaaatttttatagagacagggtcttgctttgttgtgcaagctggtctccaactcccrggctctcacagtcctcctggcttgacctcccaaagtgccaccacacccaggctattttgaggacgtttctcttttcagaaaagttataagtattttgacc

SEQ ID NO: 70468 - DNA, 201 bp, Homo sapiens
tcattggattatttaaatactaagtgatttaacatagtttttctgagcatttcacacacaaaacattttttttttccacatgagaccattacttctgaatwttaaggaatttcatatggtgcatgtttgaggaatttcgtatggtgcctgctgtaataggatcttggcttatttgcatttgttgatcagatgcaactaggt

SEQ ID NO: 70469 - DNA, 201 bp, Homo sapiens
ttctgaatattaaggaatttcatatggtgcatgtttgaggaatttcgtatggtgcctgctgtaataggatcttggcttatttgcatttgttgatcagatgsaactaggtatagagattggatgagggaagagtaaagtaaaattacagaaaacttttaaggcttcccaagtttgttaccgtttgatagtattagaaacaat

SEQ ID NO: 70470 - DNA, 201 bp, Homo sapiens
tatgtatacccttcagtactttgcttttttgatttagctctgtttcttgcagatctttttctctcagtaaatgggcattttcctcatccttttgaaggatrcatggatgaagaactaccatagttattcaaccagtgccttattttatggattcttaggctattgtcagtcttttgccactattaacagtactacaaagag

SEQ ID NO: 70471 - DNA, 201 bp, Homo sapiens
ggtttatattttgccgtccttgttgagaagaaaaacatggatgtatagatatacagtgatggatggactagcagcttaagaatcattttggggacattttwaaaaaaattttttgagacagagtcttgttccatctcccaggctggagttcagtggggcaatcgtggctcactgcagccttgacctcatgggctcaggtga

SEQ ID NO: 70472 - DNA, 201 bp, Homo sapiens
ccagctttgttctttttggtcaagattattttgactattctgggcctttgtgattccatatgaattttaggattttttttttttttttttgcaaaggatcmtaagaaactactatgaacaattatatgtcaacaaatcatataacctagaaaaatggatagaaacatttaacataacaaaactgaatcaagagattggaaa

SEQ ID NO: 70473 - DNA, 201 bp, Homo sapiens
tgggcctttgtgattccatatgaattttaggattttttttttttttttttgcaaaggatcctaagaaactactatgaacaattatatgtcaacaaatcatrtaacctagaaaaatggatagaaacatttaacataacaaaactgaatcaagagattggaaatctgaacagaccaataattagtaaggagattgactcagta

SEQ ID NO: 70474 - DNA, 201 bp, Homo sapiens
gcatccctcggttcagtcacacctaatattaactaaccgtcacaaccgccattccccatattagtacttagtgtgctaagtcagtgcaaaatgtgggacamttaatttacataatttctttttatattttaattcctgtgaataatatgtgtgctcttaagtatttataaacataaacatagaaaaacaaacacttgtgat

SEQ ID NO: 70475 - DNA, 201 bp, Homo sapiens
ttcttgggatatttcctaaattcagtatgagattgttgatatagataagaaaactgacttgcaaagagatttcattgccccaggtaacacagctaagtggsagagctgcaatttgtactctgagtctggttttggggtctgcacatttgaccacaatgctactgcctgtattttacttaagataatagttatgtttatgac

SEQ ID NO: 70476 - DNA, 201 bp, Homo sapiens
tttaaaaatcataaaatataactactgctataaaaatgtgttcatataagagactagaggataatattcagagcataaaacaatggttggagatccacagrcaaccaacactggtagtcaaatagtgattaaattcttgataagtcttgctgcttttttttctgaaattttatttaataatatcatataatgtttttcatt

SEQ ID NO: 70477 - DNA, 201 bp, Homo sapiens
atttacacattctttgagtgttctaatttcattgtcataaaagcttactattttctcatttttaagacatatttcatacttcttaagatagctcttaaatktattccagaaactttaaacatttttgatattgttgaactagttttggaatcaaaacaatttgtgattcccacataattgcagttaaattttttcagtgta

SEQ ID NO: 70478 - DNA, 201 bp, Homo sapiens
tggaatcaaataacttttaaagatttgagaaaatcagcaccaatatttgaagattaaaacttgatccatctgtcagttagaattttgatttggaaaagccrcaggtaacagtgtaaattctagttttacaaatgtagtaataaagaatatacttcagtggcaatttaaacttcatattagtgaattaagatactcagtaag

SEQ ID NO: 70479 - DNA, 201 bp, Homo sapiens
cttttctttggtataccatagttcttgaaggctaaaattttggtaactgtttcaggaaaataaatactgtactatatttcgtttctttccttcaatcctgwtatgtaaagtaaacaaacctgttttcagaatatctaacctttagttgagtaaatgacaggtaggaaataaagctgttgatacaggagaatgagtaagtga

SEQ ID NO: 70480 - DNA, 201 bp, Homo sapiens
tctttccttcaatcctgttatgtaaagtaaacaaacctgttttcagaatatctaacctttagttgagtaaatgacaggtaggaaataaagctgttgatacrggagaatgagtaagtgaaaaaatccatcctttgtcaaccactcttattttttaaattgaatctgctttcagtttcagtagttgggagtgctagatgtaca

SEQ ID NO: 70481 - DNA, 201 bp, Homo sapiens
gttctgaatggccttgtagtcttctgttggttttggtttcatctttcagtagatggacctgtggaaaagtggaactggctttgaaaatgtactggaagcarttattttcctaagacaataattttttttctcttttccattttctttagaacatacaggctagaagatccactcagcatttaatgcatatgactttacatt

SEQ ID NO: 70482 - DNA, 201 bp, Homo sapiens
gaggaccataggcagtttttccttcagatgccagcaatctagaaggaggagtaggatgggagcagacaggttgcctccccacctggataactgagtgtggktttctgcagttcttaaaattgtcagctcacacatactacttacttacttacttacttacttacttacttacttatatatgtctgtaagtacgtgacagag

SEQ ID NO: 70483 - DNA, 201 bp, Homo sapiens
ctacataaaattctcttccaaatatttactcattttatagattaggaaactgatccccaatgaggtatatccttttggtatattggttaaagaataatatrtctacttgagagtggcatcctaattactgaaaactggactacgaacttttaaagtttaattaacagtaatttaatgtatttttatgttatttcttaatct

SEQ ID NO: 70484 - DNA, 201 bp, Homo sapiens
gtatatttttcttcccagatccaaatctagcttttattctacctttgatttggtctatcaagtaaataaactggcttatttaaaaatatgtcatattcagygttaactttaaacaaattataaaagaaagtttgttgtatgtatctaaggtactcatgtgaataaatgagaaataagtaggcattaacttgttatctcttg

SEQ ID NO: 70485 - DNA, 201 bp, Homo sapiens
atagttatgaaactcaaaattaagctctctgtttaataatagacatcagagataacatgaacagatactgataaattgagaaaagagcttcagtaccaaaygaaacaaagaacacagatttccaggtgcttttttatctgatcatgttgcagcaccattggaaccattgtgtcactttaaccaagcctccaatatttttat

SEQ ID NO: 70486 - DNA, 201 bp, Homo sapiens
tttactcagttgcccaatttttgaatgaaactgaaaactgtggacagatacatcagggaagaggaacatacagagtaaaagacataaaagccttaaagttgcttcagtttcttcatttcatcttgtaaattacacaggagtccttcagataaaactcactggttatatgacaaattaagcaattagattactgcacaccta

SEQ ID NO: 70487 - DNA, 201 bp, Homo sapiens
gctgcttgctttacctctgaattcccttctccaatgccattttactccctgagctgctttcttggcagtttggggcaccccttgctgtttgtgcctgtgayagtctgacttccatctgctgctctgcagccaggagcctgctgtgctcccttcagtcacatctttcatgcctggccattcaagcacctttcatcaggtctc

SEQ ID NO: 70488 - DNA, 201 bp, Homo sapiens
gataaattttttgtaatctttagggatataaaaaagtgtatgtggataaattttttgtaatctttatttttgaaggccagccagtaaaatggcccaatgtrccagccaggcttatgtggccttgttttcaaatatacatatatgtgttatcattaaaattcatatatgcatttttgttttagccttcttaatctctaccta

SEQ ID NO: 70489 - DNA, 201 bp, Homo sapiens
tcactaataacagtttacctcagcttcatctccatgaaggttttacttctaatcccagagtctcatgtttatgtattacaagagtgtatgaaagctgggcrtggtggcacacaccagtagtcccagctactcggtcgggggttgaggtgagaggatcgcttgaactcaggagtttgaatccagcctggtcaatgtagcgag

SEQ ID NO: 70490 - DNA, 201 bp, Homo sapiens
caaaatccaaaaaaaatctgaaatctgaaacactctggtcccaagcaattcagataaggggtattcaccctgtattattagtttttccagaaaaaaaaaaraaagattatcaaagatacacacccgactttagcactaaaatttttaagttgttgtaccttcaattgctttatttttccctttcaattctaatgttaaaaa

SEQ ID NO: 70491 - DNA, 201 bp, Homo sapiens
gcgttattttactccttgctatgtcacatttacatgtcagactcatttgctgtgatgtagcacactaggctggtgaaataattgcttgtgatgtccctaartccccgaggcttttttctacctcctgcttagatagtgaagagaagttgaagttgcgtcctctagtgttcattttgcgtaagagtgataggatgcggtagg

SEQ ID NO: 70492 - DNA, 201 bp, Homo sapiens
atcattaatacatttatgtaattgtacatgaatcattgtaatgctcattcaatccagaagaaacgtaatacttagaaccttatgttcatatgagtgaacaytttttaaaatttcaaaatatgtgcatatttttctaagaattattacaagatgatcagagaaagaaggaaattctattgggatagtagagtagaagtacaa

SEQ ID NO: 70493 - DNA, 201 bp, Homo sapiens
caccatggcacatgtatacctatgtaacaaacctgcacacctatgtaacaaacctgcacattctgcacacgtatcccagaacttaaagtataataataagmaaagataattagaagacaagctacaggctgggggagaatatttgcaaaagacacatctgataaaggactgttatccaaaatacacaaagagcttttgaaa

SEQ ID NO: 70494 - DNA, 201 bp, Homo sapiens
atgatttaaagtatacaagaggatgtgcgtaggtcataatcaagtagataccattttatataagagacttgaacatcctcagattttggtatctgcaggargtcctggaaccaatccctcatgaataccagagaatagtattttattttttgagcaactaaaatgttgtttttctgttagttttaaagcatagtttgattt

SEQ ID NO: 70495 - DNA, 201 bp, Homo sapiens
taaaaggacacaaaccaacctctttgtaaaacttctgccctccaaaggctttatgttctctaagatagttaagaagattaaaaaaaaaaaaaaagaaaaamaaagaaactcctgttcttaatgatcccatgctgatagtttttttttggataaagtgtaggctgctgttcatagagatgccaagtacatatgaaaggaggg

SEQ ID NO: 70496 - DNA, 201 bp, Homo sapiens
ccgaagtgctgggattactggtgtgagccaccgcacccagcctctacaagcttttattcatcataaccatacacatttattgttgcataccataagaagcrtaaagctttaaaagccttttctggactaggccacctctaccccctactttgtatggtttacattggtttctatgtgaatcatttgattattgcattcatg

SEQ ID NO: 70497 - DNA, 201 bp, Homo sapiens
caaaatttcttattgtactatactcaccgattttcagactgaggttgaccttgggcagctgaaactgcggaaagagaaactgagtctaggatgactttctrtctcaattcttgcattgtattgtacactccttaaggataaaagccatgtttcttcagaatcttatcccaaaaacttagcagagtgcctggtacataatca

SEQ ID NO: 70498 - DNA, 201 bp, Homo sapiens
aaaaatggatttaaaacacctaacctaccaaacatcacaatttagcgtagcttaccttatatgtgctcaacacttacattagccttcagttgggcaaaatmgcctaacataaaacctgttttataataaactattgaatatattatgtaattaattgaatactgtactgaaagtgaaaaacagaatggttgtatgggtact

SEQ ID NO: 70499 - DNA, 201 bp, Homo sapiens
ttgtatacatgcttaaaattcttaaaaatataaatttgtctctttttctatttttacaaaatatcaaggaactagaataatgttatcatcttcaaggtatwtatgcggtgaaaatgtaattcatactcctcccaaactttgctatggagagggggagtatttttagaaagaatctctttttatgtgtttgttcctgtccaa

SEQ ID NO: 70500 - DNA, 201 bp, Homo sapiens
gaaaatggataatatgatagggagtgagacgttgagggaggaaggggagttgaattatactgggctaataataatattagataacattcctttagtgcttmttacatactagaaactacttacattgctttacagtaaagaaaaactcacagaaaggtccctgcattaatgcaaagtaggatattatacaattggcagttg

SEQ ID NO: 70501 - DNA, 201 bp, Homo sapiens
ggctactcatatgtaaaagttactggaatggtcttcttatttttctgacctttttatatccatataaattcggatgatttctcattgatatttatgatatyctgctctgaaaataatataatcaattacttgcctttttaagtcaagtattctaccctagttgactataaagtgaattttttcaaaggaagtcttaaattt

SEQ ID NO: 70502 - DNA, 201 bp, Homo sapiens
gggcgtggtggcagacgcctgtagtcccagttacttgggaggctaaggcaggagaatggcgtgaactcaggaggcggagcttgcagtgagctgagatcgcrccactgcactccagcctgggtgacagagcgagactgtctcaaaaaaaaaaaagaagaagaagaaggtttcaagaatttagtttctaaattcaggatgttt

SEQ ID NO: 70503 - DNA, 201 bp, Homo sapiens
aatttgaagctacaagagaatttagaaatcatccagtgcaacttattaaattatacttttgataggggatgctaaatggttagggaacttgtttggatctrtggatttcgttggttatatactcagctcttaattgccaaggaatagtcatgatgaaccagcagactttcctcacctagttggggagaaaagaattagatt

SEQ ID NO: 70504 - DNA, 201 bp, Homo sapiens
atctcacaccagttagaatggcgatcattaaaaagtcaggaaacggccgggcgcggtggctcacgcctgtaatcccagcactttgggaggccgagacgggyggatcacgaggtcaggagatcgagaccatcctggctaacacggtgaaaccccgtctctactaaaaaaaaaaatacaaaaattagccgggcatggtggcgc

SEQ ID NO: 70505 - DNA, 201 bp, Homo sapiens
gtgggtaacctgacctttctctctggctgctcttaacattttttccttcattttaactttggtgaatctgacaattatgtgtcttggaattgctcttctcraggagtatctttgtggcgttctctgtatttcctgaatctgaatgttggcctgcctcgctagattggggaagttctctttgataatatcctgcagagtgtt

SEQ ID NO: 70506 - DNA, 201 bp, Homo sapiens
ggtcctaagcagtaatagcttcctgcagtccctagactttggttccgtcagcatgccttaacctttccagcactttgggaaatattccctaagttgatttrtcttcagagtctctaacaggaccctgactaattttctattttatttttacaagtaaaaattgtatatatttatggtgtgtatgatgttttgatatatata

SEQ ID NO: 70507 - DNA, 201 bp, Homo sapiens
tcagctcactgcaacctacgcttcctgggttcaagcgattctcctgcctcagcctcccgagtagctgggactacaggcgcccactaccacacccggctaawtttttgtatttttagtagagatggggtttcaccgtgttagccaggatggtctcgatcgcctgacttcgtgatccatgcgccttggcctcccaaagtgctg

SEQ ID NO: 70508 - DNA, 201 bp, Homo sapiens
tatacatgctcataccttgttccttctaccactgtaccccaacctttccaccttacttttattagtctcttgtttcttcttccaattttttaacacaaacaaaaaatatgcaaatatatatgcaaatataaatatatgtttatgtgtgtgtatatataatatatattatatataattatattatatataatatatatatta

SEQ ID NO: 70509 - DNA, 201 bp, Homo sapiens
ctaacagacaggaccctcagctgcaggtctgttggagtttgctagaggtccactccagaccctgtttgcctgggtatcagcagcgctgtctgcagaaccgygcattttcatgatctgcaaatgctgctgtctgatcatccctctggaagttttgtctcagaggagtacccggccgtgtgaggtgtcagtctgcccctactg

SEQ ID NO: 70510 - DNA, 201 bp, Homo sapiens
cactgtaccccaacctttccaccttacttttattagtctcttgtttcttcttccaattttttaacacaaacaaaaaatatgcaaatatatatgcaaatataaatatatgtttatgtgtgtgtatatataatatatattatatataattatattatatataatatatatattatattatatatattatatatatatatatat

SEQ ID NO: 70511 - DNA, 201 bp, Homo sapiens
tgtaccccaacctttccaccttacttttattagtctcttgtttcttcttccaattttttaacacaaacaaaaaatatgcaaatatatatgcaaatataaatatatgtttatgtgtgtgtatatataatatatattatatataattatattatatataatatatatattatattatatatattatatatatatatatatgtt

SEQ ID NO: 70512 - DNA, 201 bp, Homo sapiens
tcttaattgccaaggaatagtcatgatgaaccagcagactttcctcacctagttggggagaaaagaattagattaattttcggttccttgaactctagaaktctataaatctatcaactgtaactatgtcaaatataatgctatggatgttactcttcttaattaactatgtctaccttcactttctcatagtccagctat

SEQ ID NO: 70513 - DNA, 201 bp, Homo sapiens
tatatattatatatatttgatatatatacttacatatagatatctatatataatatacttatatgtaggtatctatatatatagctttttggggggtcctrcttagcctttctttctccataggtttaattgtagagctgtgtttcttttttttgtttgtttgtttgtttttgagacggagtctcgctctgttgcccaggc

SEQ ID NO: 70514 - DNA, 201 bp, Homo sapiens
taggatagttcctctactgcactgggcggggcttagactgggtctcctcaggatatgttgtgggatagaggctggtgagcatgtcggggaggatcagagtyccaggccatgagatttgtgtgaatctccccctggtttcttgtgtaagcaactataagctgggacctcagctagggaggcctggagcagtgtcacagttca

SEQ ID NO: 70515 - DNA, 201 bp, Homo sapiens
atcacgaggtcaggagatcgagaccatcctggctaacacggtgaaaccccgtctctactaaaaaaaaaaatacaaaaattagccgggcatggtggcgcgcrcctgtagtcccagctacacgggaggctgaggcaggagaatggcgtgaacccgggaggcggagcttgcagtgagtcgagatcacgccactgcactccagcc

SEQ ID NO: 70516 - DNA, 201 bp, Homo sapiens
agagatgtggtttctccatgttggtcaggctggtcttgaactcctgaccttaggtgatccgcccacctcagcctcccaaagtgctgggattacaggcgtgwtccactgcatctggcctgaaacagtttttcaaaaagattaatcatcttgggttaatagaaaaaaatcaggcagaaagataaaactacttctgtcattact

SEQ ID NO: 70517 - DNA, 201 bp, Homo sapiens
ctgtcctgagttggtaaatgtctacttagatgccagtgatgcgaatagaaactgtcgtgtcagcttataacattctcagagggttgcactttcaatgcagrtggggggaaggacaaagtaatagcttcttgttgggattacagtaagtgagggctcaagtgaagatctcttagttccttgaatgatcctttaaaaggtaat

SEQ ID NO: 70518 - DNA, 201 bp, Homo sapiens
attagcctcaaatattgatttttagactatgtataatctattactctgaaacagttttttggggtttttttgtttgtttgtttttgttgtttttttgagayggagtttcgctcttgttgtctaggctggagtgcaatggcgtgatctcggctcacagcaactgctgcctcccaggttcaagcgattctcctgcctgagtct

SEQ ID NO: 70519 - DNA, 201 bp, Homo sapiens
ccgggcatggtggcgcgcacctgtagtcccagctacacgggaggctgaggcaggagaatggcgtgaacccgggaggcggagcttgcagtgagtcgagatcrcgccactgcactccagcctgggcgacagagtgaaactccgtctcaaaaaaaaaaaaaaaaaaaaaaaaagtcaggaaacaacaggtgctggagaggatgt

SEQ ID NO: 70520 - DNA, 201 bp, Homo sapiens
atggggaagggaatttatatttaataccaacctacggcatgcctatattttaaactattaatcatccagtaacccataagcctaggaaggattagtccgasgtattacagtctcaaagagatagagcctggctatgcgcattgttctgtctgattatttttcattttctcttttgttttgtttttttgtttctagcctagg

SEQ ID NO: 70521 - DNA, 201 bp, Homo sapiens
tgggctcaagctattcttctgcctcagcctcctgagcagctaggactacaggtgtgagccatcacaccagctaactttttaacatttttgtagagacaggktctcactgtgttgcccaggctggtctcaaactcctggcctcaagcagccctcccaccttaccctcccaaagtgctgggattataggagtgagctgctgca

SEQ ID NO: 70522 - DNA, 201 bp, Homo sapiens
caataaatgtaatccatcacataaacagaaccaatgacaaaaaccacatgattatctcaatagatgcagaaaaggccttcgaaaaaattcaacagccgttyatgctaaaaactctcaataaactaggtattgatggaaatatctcaaaataataagagctatttatgacaaacccacagccaatatcatactgaatgggca

SEQ ID NO: 70523 - DNA, 201 bp, Homo sapiens
tataataatacttgttacacctttaggaaaacatagttgttcaccatgctttatataccatgtgtgaacttttctatatttttttcctttcagagtgtatygttctttttgtttgtaaagcagcatacttgatgctgcaaccagtgactttttgccatgcattcttaatacttcttggaatatttggtttaggaagtgggg

SEQ ID NO: 70524 - DNA, 201 bp, Homo sapiens
ttctctgtttgtcctggcaaaacttatatttggaaaatgttctatttttcaggtatcctggtcagatataggaggactggaaagtatcaaactgaagttgsaacaggctgtggaatggcccttaaaacatccagagtctttcattcgaatgggtattcagccacctaaaggagttcttctctatgggccacctgggtgctc

SEQ ID NO: 70525 - DNA, 201 bp, Homo sapiens
atgtactcctaatttacttcttgttattcttggaattttttaaaggattttcctgattcttaaatggttctattcttttttgcagttcttctgttaatgayatgttttttatttttttttagttctctgtttgtcctggcaaaacttatatttggaaaatgttctatttttcaggtatcctggtcagatataggaggactg

SEQ ID NO: 70526 - DNA, 201 bp, Homo sapiens
cacgtatgtttattgcagcactgttcacaatagcaaagacttggaaccaacccaaatgtccatcagtgatagactggattaagaaaatgtggcacatatayaccatggaatactatgcagccataaaaaatgatgagttcatgtcctttgtagggacatggataaaactggaaaccatcattctcagcaagctattgcaag

SEQ ID NO: 70527 - DNA, 201 bp, Homo sapiens
cttgaacaggcgccgagttgtcacagatctcattagtctcatccgccagcgatttggcttccgttctgggggccctccgaggcctctacctggagcagggkttcctgccccccaccgagagcgcatgcctgatgagagacaatgactgcctcagagttaaattagaagagagaggagttgctgagaattctgtagtcatca

SEQ ID NO: 70528 - DNA, 201 bp, Homo sapiens
attaagaaaatgtggcacatatataccatggaatactatgcagccataaaaaatgatgagttcatgtcctttgtagggacatggataaaactggaaaccawcattctcagcaagctattgcaaggacaaaaaaccaaacacctcatgttctaactcataggtgggaattgaacaatgagaacacttgaacacaggaagggg

SEQ ID NO: 70529 - DNA, 201 bp, Homo sapiens
ctagtcttggacttctttttgttggaaaattttttttttcttttttttttttttgagacggagtagttttgctcttgttgaccagactggagtgcaatggygcaatctcggctcatcgcaacctctgcctctcagattcaagcgattctcctccctcagcctcccaagtagctgggtgggattataagcatgtgccatcac

SEQ ID NO: 70530 - DNA, 201 bp, Homo sapiens
atatctcaaaataataagagctattcatgacaaacccacagccagtatcatactgaataggcaaaagctggaagcattccctttgaaaactggcacaagamaaggatgccctctctcaccactcctgttcaacatagtactggaagttctggccagggcaatcaggcaagagaaagaaataaagcgtatttaaataggaag

SEQ ID NO: 70531 - DNA, 201 bp, Homo sapiens
tctatttcttttgtacatttaaaagtgtggggatcctcttggaattagcctgtgaaatgtatttgcattgaaaggtcaatctcaggaatttcagagcaaasgttttgtttgtatgtatgggtgaaaggacacttacagttttagtatcaatgcaatttgatataaactcattagaaagtctaagtttactaagctatgtat

SEQ ID NO: 70532 - DNA, 201 bp, Homo sapiens
agaaagaggggaaaggctgggagaaaagagaagcaaagacctctttgaatactcagcccttcccactcaccctgtgcatagcacttcacatttttacttgwctgcacaatctgtctgcttttcattggttttcagagtcctcgagtgatttttgtattttgtctgacatttttctttctttttttttttttttttaattga

SEQ ID NO: 70533 - DNA, 201 bp, Homo sapiens
aatgtttggttgaattcaccaggaaacgatctgggttttgtgctttctgttttgaaaggttattaattatttatttaatttctttaactgacacaggcctrttcaatttgtttattcttgtgtgggttttggcagattgaagtttttaaggaatttattcatttcatctaggttttcaaattttgggccataggatgtctt

SEQ ID NO: 70534 - DNA, 201 bp, Homo sapiens
ctcagcaagctattgcaaggacaaaaaaccaaacacctcatgttctaactcataggtgggaattgaacaatgagaacacttgaacacaggaaggggaacaycacataccagggcctgttgtggggtgtggggagaggggagggatagcattaggagatatacgtaatgtaaatgacgagttaatggtatagcacaccaaca

SEQ ID NO: 70535 - DNA, 201 bp, Homo sapiens
aaatacacacttgtaacgcatgggccccacacttaccctaagttataaaaatggtacaattaggtaatttctaccctaagacagtcagtttttgctcagcratctaaccacgtaggcttgcttacttctgagacttgcttgacctatctcattgaactcgctctgtgcctgagatacatgtccaatttctcaaggcaagtt

SEQ ID NO: 70536 - DNA, 201 bp, Homo sapiens
cttaaggtgggatgtgtggttactgattttagatctttcttcttttctaatctaggcattcaaagccataaacattcattaagcactgctttagcggcatsacacatatttgatatagtgtattttcatttccatttagttcagcatattttagaatttcccttggtacatctttaaattatcacagtctacctttaagtg

SEQ ID NO: 70537 - DNA, 201 bp, Homo sapiens
atagctttatggaacaaattacagaactttactaaaggacgtaaatgaaaacttggttaaatgaagagctataacatgtctattggtggggcacataacarcataaagataccaattctccccaaatccaattccaattaaaattataataagacttttggggagcctcagttaactgactctgatgtagaaaaagtttct

SEQ ID NO: 70538 - DNA, 201 bp, Homo sapiens
agcctagaacatcagaatgtgacagtcagttgagtttcataggatgagctcattagcagtacatttctggtgcaaaggtttgagtgaagtagtttaattgrctataattatatttcattcttcatatccccttaggataattagaagaaattcattttagtttttattctttaaatacagtactgcattttatattttatt

SEQ ID NO: 70539 - DNA, 201 bp, Homo sapiens
gtgtttatttgactcctagtccagtgttctgtccattacattttgttaggaagaattataattctaacaaattacttccaaatgccaggtaaatcaggccygattaaaagtatgtcttttatagctgttaaatggttctgaaaaactaattctgaaggatttatagataatttattatttcgttttcttttgtaaaagttt

SEQ ID NO: 70540 - DNA, 201 bp, Homo sapiens
ctgcaccctcaacctcctgggcccaagcaatcctcccacctcatccccctcaggtagctgggacaacagctgcatgccaccatgcttggctgatttttgtrgagatggggtttcaccattttgcccaggctggtcttgaactcctggggtcaggcaagccatcatgcccagcctattttctaatcttgatatgaggaagaa

SEQ ID NO: 70541 - DNA, 201 bp, Homo sapiens
tttcaggaggcagagacaacgccatgattgattatcttaattaaatcatctgtaaggagggaagaattgagtgaagctaatggtgtagttggtgaagaagyagtcactcttactagctggaactgggaatatatgtttattttgtggcttggagagtgttcatattttgtccatacctgaatatgcagcggtcttgttttt

SEQ ID NO: 70542 - DNA, 201 bp, Homo sapiens
taattttaggagaccacaagtgttagccacttacttaaatgtaatgtttccttcttttggagcttctgaatggtgattacagtgacattaaggtcaaatgygttttctttacagcatgaatccttacaatctaggaatatgctaatattcattgtgaaattccaattttcttatccagagataacagctgttaacattttg

SEQ ID NO: 70543 - DNA, 201 bp, Homo sapiens
ccagagcagctctcaaatatcccttctgtttttcagtactacaacaatacacaagatcttaaaaatgtagtagtgattattaaaaagggcttacagcaagwcctataacataatattatttatataaattacagacataataaataaaacagtagtatgtattattcaaggatgaatatatgtatacaagaccctatacca

SEQ ID NO: 70544 - DNA, 201 bp, Homo sapiens
ccatcatcagtttcatcacagttgtactctttcttgcaaaaactctaccattagaattatttgaaaacttagagccttgttagagagtctggcctagttgyatcctttacctcactgtgtataggcgtttcagtatccatagttctcttggtcattaactaatgtttttaaattgttagctaaaaataaaacaaaaaacaa

SEQ ID NO: 70545 - DNA, 201 bp, Homo sapiens
acataataaataaaacagtagtatgtattattcaaggatgaatatatgtatacaagaccctataccaaatacaagggttttcatctctagtgtggtcggasggaaggggccagtagccaatattgggggtgaaaggaaatattaaataagagaagagccttgtatggaccaatgtgatagtgtgctatgtagattgaaaac

SEQ ID NO: 70546 - DNA, 201 bp, Homo sapiens
tccttgtgtcttcacttcatcttccttaataagtatttagaggcagtattttcgatattaacagcatagattctttaatttaggaaagaagaaaacttaaytttgatttttctaactttctgctcagctcttccaacgtgaatatgtaggtctctgtctcccggggtcctcattatgctttactttgccctttccagtgcc

SEQ ID NO: 70547 - DNA, 201 bp, Homo sapiens
agccagtatcatactgaataggcaaaagctggaagcattccctttgaaaactggcacaagaaaaggatgccctctctcaccactcctgttcaacatagtaytggaagttctggccagggcaatcaggcaagagaaagaaataaagcgtatttaaataggaagagaggaagtcaaattgtctctgtttgcagatgacatgat

SEQ ID NO: 70548 - DNA, 201 bp, Homo sapiens
aaatcatcagtgaactcccattcacaattgctaaaaagagaatacctaggaatccaacttacaagggatgtgaaggacctctttaaggagaactacaaacsactgctcaaggaaataagataggacacaaacaaatgaaaaaatatcccatgtgctcatggatatgaagaatcaatatcatgaaagtggccatactgccca

SEQ ID NO: 70549 - DNA, 201 bp, Homo sapiens
tttaccggatgcagcaacaagaagggaaatatttaagctgcagtttcactccatgcctgtcagtaatgaagttgacctggatgaactcatccttcaaacckacgcatactcaggagcagaggtaagatagttcccttcaaaataccttagtgggaggaaagcggtggctcagggtcattaagcaaaataaattgcttgccc

SEQ ID NO: 70550 - DNA, 201 bp, Homo sapiens
agtgggtgaaaaagtgggcgaaggatatcaacagacactcctcaaagaaagacgtttatgcaaccaacaaacataagaaaaaaaggtcatcactggtcatkagagaaatgcaaatcaaaaccacaatgagataccatctctcaccagttagaatggtgatcattaaaaagtccagaaacaacagatgctggagaggatgtg

SEQ ID NO: 70551 - DNA, 201 bp, Homo sapiens
atcaaaaccacaatgagataccatctctcaccagttagaatggtgatcattaaaaagtccagaaacaacagatgctggagaggatgtggagaaataggaaygcttttacactgttggtgggagtataaattagttcaaccattgtggaagacagtgtggcgattcctcaaggacctagaaacagaaagaccatttgaccta

SEQ ID NO: 70552 - DNA, 201 bp, Homo sapiens
tgatgtgggaattacggagattacaattcaagatgagatttgggtgtggacacaaccaaaccatatcatcttccaaacagaatttatcatcaacactgacragccatttcagttttatcttaattattgcaaggactggtcaagagaacgtgtttggaaattggaaattaatcatctatgttgaggaaataatttataaca

SEQ ID NO: 70553 - DNA, 201 bp, Homo sapiens
tacctttcagggaaataagatgtagaggtggaagacagtgatattgatgatcctgacctacgggcctaggctaatatatgtgtttgtgtcttcgtttttarcaaaaaagtttaaaaagtaaaataataaataaaatttaaaaataggaaaaagcctataggataaggatataaagaagaaaatatttttgtgcagctgtat

SEQ ID NO: 70554 - DNA, 201 bp, Homo sapiens
gctggagaggatgtggagaaataggaacgcttttacactgttggtgggagtataaattagttcaaccattgtggaagacagtgtggcgattcctcaaggayctagaaacagaaagaccatttgacctagcaattccattactgggtatatacccaaatgattatgaatcattctataaagacacatgcacacgtatgttta

SEQ ID NO: 70555 - DNA, 201 bp, Homo sapiens
ggataaggatataaagaagaaaatatttttgtgcagctgtataacatgttgttttaacctaagtgttattataagagtcaaaaagttaaaaaaaaaaaaawaaataaaaaatttataaagtaagttacagattaattcctgaagaaagaaaagttttaaaataagtttagcatagtcttattgtaccgtgtttattataaa

SEQ ID NO: 70556 - DNA, 201 bp, Homo sapiens
gtaccaaaatacagtgatttttggcaacttaaacttcaagcttaaaataacctcccttggtaatgaaattgctgtgacttctcataaaactcgagaccaaygcaacatacgagttcagctacttgggttgcattttgcaggccatctaggtaagattcatcagtacatagtcctgtacaaagtcatattttctagggaccc

SEQ ID NO: 70557 - DNA, 201 bp, Homo sapiens
gccaccacgccaggcccaaattttaatcttttactgagctagtgatatgcagtacagtactccctcatgatgcctggcagtaacagtgagccacagctccyggtcagccattgtgatcatgagtgtacacagccaacattctagaatgtactgtgttgccacgtcactttttccaactgtaggccagtgtaagcattctga

SEQ ID NO: 70558 - DNA, 201 bp, Homo sapiens
attttattttataaggagtcatcatggcatagtatgaagagctgtgggttgacatcaggcatacccaaatttgaaaccagctctgctacttactcgctatwttaactttagcatgttatttggcccctctgggtcatggtttaatcatctataaaacaaggatataattcctctctctagggttattatacagattaataa

SEQ ID NO: 70559 - DNA, 201 bp, Homo sapiens
attctaattgaagtctctatgccaatactttattactttttttggttcatttgcctttgagaattttcttagcatttttaatttacttcaataattgagcrattatgacaggaaatcatttcatgtaaaaaacagaccaagtattctggttcctagccagttttctttcatttagatatgatggtactaaagcaaacaaca

SEQ ID NO: 70560 - DNA, 201 bp, Homo sapiens
gtatgtctttattagcagcatgagaaggaactaatacagagatcaaatcatatttttgatagccgtcagataatagttgtttcatgaattttgcccgttawttaaaaataagactacatggccaagtgcagtggcccacacctgtaatcccaacattttgggagcctggggcaggaggatcacttaaggctaggagtttga

SEQ ID NO: 70561 - DNA, 201 bp, Homo sapiens
tgagtttttattagaggctgtagtataacactaactaaaatgtagtttggaaagttttattgagtttttcttccttaaccttttctttggctggctgcaarcaactagtgataatgtgtttttagatgtgcttattttcacctcttcctcctggaggttaagctagtactcattaaggaaaaaatacagtttatactaaac

SEQ ID NO: 70562 - DNA, 201 bp, Homo sapiens
ccaggcgtggtgacatatacctgtaatcccagctacctcaggaagctgaggcaggaggatcacttgaacctgggaagcagaggttgtagtgagtggagatygcaccactgccctccagcgtgggtgatagagtgagactccatctcaaaaaaaaaaaagaaagaaagaaaaagaaataaataccctatttcttaagagatt

SEQ ID NO: 70563 - DNA, 201 bp, Homo sapiens
gaacagaaaaccaaacacctcacattctcattcataagtgggagttgaacaatgagaacacatggacacagggaggggaacataacacactggggcctgtygggggatgggggtgggaaaggggagggataacattaggagaaatacctaatgtaaatgatgggctgatgggtgcagcaaacccaccatggcacatgtata

SEQ ID NO: 70564 - DNA, 201 bp, Homo sapiens
caatgagaacacatggacacagggaggggaacataacacactggggcctgtcgggggatgggggtgggaaaggggagggataacattaggagaaatacctmatgtaaatgatgggctgatgggtgcagcaaacccaccatggcacatgtatacctatgtaacaaacctgcacacctatgtaacaaacctgcacattctgca

SEQ ID NO: 70565 - DNA, 201 bp, Homo sapiens
aattaggagataaggtaatagctcatccctgccgtttaagagcataacccataaattgcagctatcatttacatcccattggctaatcttagctacaaggkaatattcagctgcaagagaggctgtaaaataaatatattctctattttgaggggctgggatttaaatttggctttaactcaggggtttcattactaaaga

SEQ ID NO: 70566 - DNA, 201 bp, Homo sapiens
ggatacctcatataagtggaattgtgcagtatgtgtcttttgtaactggcttattttaatttagcataacgtcctcaagattattttatgttatataatgkatcagaatttcttttttgaggctgaatattttattatatgtatataccacatcttgttatccattcatctgtagatggacagttaggttgtatccacctc

SEQ ID NO: 70567 - DNA, 201 bp, Homo sapiens
tccgcacgtaaccctgtgcgcccgaggcccagcggtaacccgccgaaggcccggggccgtaggttcgggcaagcatcgcgcgccagcggccccagctcagyggctgccgcatctccacgccgcttaattcgtccgttgcccaaatgacccctccgcgctccagagcggagatcgcggccgtacattttagaagagtgccat

SEQ ID NO: 70568 - DNA, 201 bp, Homo sapiens
gttggaggacatcctgtttttaggggaggactggagtagaacctgggctgttccagccggtccctccctgtctcaggatgttgcatttcctgcacatgctwcagttattcttgagagctacgatgggagagagagaacttggtcattccaagaccacccagagagctgtcctacaaaggatcttaaactaaaggaaatgaa

SEQ ID NO: 70569 - DNA, 201 bp, Homo sapiens
ttgcttttgcatctacagtttcaaccaactatgaattgaaaatatttggggtcggggaacaaaaattaacaatacagcattttcaaaatttaaattgttaaaaaaatagtataactatctgtagcatttacattgtattaggtattataagtaatctagaaatgatttaaagtatacaagaggatgtgcgtaggtcataat

SEQ ID NO: 70570 - DNA, 201 bp, Homo sapiens
ggaggggctggagctaagactgggcccccttggactctgctgtagggacggatttggaaagcttgtcttgttggctcagagtggcatgcatctcccagcakgtctcagcacagataggatagttcctctactgcactgggcggggcttagactgggtctcctcaggatatgttgtgggatagaggctggtgagcatgtcgg

SEQ ID NO: 70571 - DNA, 201 bp, Homo sapiens
ttctgccctccaaaggctttatgttctctaagatagttaagaagattaaaaaaaaaaaaaaagaaaaaaaaagaaactcctgttcttaatgatcccatgckgatagtttttttttggataaagtgtaggctgctgttcatagagatgccaagtacatatgaaaggagggactcatatggaaggtgaacttattaccagaaa

SEQ ID NO: 70572 - DNA, 201 bp, Homo sapiens
atgcgaatagaaactgtcgtgtcagcttataacattctcagagggttgcactttcaatgcagatggggggaaggacaaagtaatagcttcttgttgggatyacagtaagtgagggctcaagtgaagatctcttagttccttgaatgatcctttaaaaggtaatagttttccatttttttgctttcagttcttgcatatgta

SEQ ID NO: 70573 - DNA, 201 bp, Homo sapiens
tctctatgttgctgaggctggtttcaaactcctggcctcaagcagtcctttcacctcagcttcccaaagtactgagatgacaggcgtgagacacgatgccrggttcagttctatcagttttgataaatgcatagaattgggtaaccaccaacacaatcacaatgcaaaacaatttatttactccaaaaatttattcttgca

SEQ ID NO: 70574 - DNA, 201 bp, Homo sapiens
ctgcagaaacattttgctgcttttatctactattaaaaattcttattttagtaaggtaaacaaaaaatagtgcttttaatatttgtattcatatattatcrttgtgataagtttctctatgtacaccataacaattttcagtgataagtggcattcttaaccaaatatatacaaatggagtatcatcaagtttaattcttt

SEQ ID NO: 70575 - DNA, 201 bp, Homo sapiens
tacaaagattaatccctgctctgactggattagaagaaacagaaactgtaggccaggggtgcagggttcttcaggaaagaaatataagacaagaagttaaactaaataaaaataagacaaggatatatatgagtgatattgtaatgtataaagaaaagtgtctcattagacttgcaagctggtccatttacatttgatcat

SEQ ID NO: 70576 - DNA, 201 bp, Homo sapiens
acaaagattaatccctgctctgactggattagaagaaacagaaactgtaggccaggggtgcagggttcttcaggaaagaaatataagacaagaagttaaactaaataaaaataagacaaggatatatatgagtgatattgtaatgtataaagaaaagtgtctcattagacttgcaagctggtccatttacatttgatcata

SEQ ID NO: 70577 - DNA, 201 bp, Homo sapiens
tagggacatggataaaactggaaaccatcattctcagcaagctattgcaaggacaaaaaaccaaacacctcatgttctaactcataggtgggaattgaacmatgagaacacttgaacacaggaaggggaacaccacataccagggcctgttgtggggtgtggggagaggggagggatagcattaggagatatacgtaatgt

SEQ ID NO: 70578 - DNA, 201 bp, Homo sapiens
gacatcagagataacatgaacagatactgataaattgagaaaagagcttcagtaccaaatgaaacaaagaacacagatttccaggtgcttttttatctgawcatgttgcagcaccattggaaccattgtgtcactttaaccaagcctccaatatttttattctttcagatcacaaggggtggatgccaaacctctcatttt

SEQ ID NO: 70579 - DNA, 201 bp, Homo sapiens
tatgtctgttgttttaagtcgctaatttttggggtaattaactatcaaaagctaaaggatgcatatacttgttaactttttatataatgcagttgttttgyaaatttaggctgagaaacagtgctctatgggtaggaatattctctaaggacttattggtagcttaggttacttagtgtggttttgaattctttttgagac

SEQ ID NO: 70580 - DNA, 201 bp, Homo sapiens
gcatggtatacataggaatgatagtttaaggaaacccatttctagatctttagtgcctaaaactgatctgcttgagaattcacttgtgatgggggtggaaktttctcttctccaaactcctctttacctctgaagcatcaaacaagtgggcagtgggaaatacaggtattacgtttgagagaatagatggcactaaagcca

SEQ ID NO: 70581 - DNA, 201 bp, Homo sapiens
aaagattaatccctgctctgactggattagaagaaacagaaactgtaggccaggggtgcagggttcttcaggaaagaaatataagacaagaagttaaactaaataaaaataagacaaggatatatatgagtgatattgtaatgtataaagaaaagtgtctcattagacttgcaagctggtccatttacatttgatcatatt

SEQ ID NO: 70582 - DNA, 201 bp, Homo sapiens
aagattaatccctgctctgactggattagaagaaacagaaactgtaggccaggggtgcagggttcttcaggaaagaaatataagacaagaagttaaactaaataaaaataagacaaggatatatatgagtgatattgtaatgtataaagaaaagtgtctcattagacttgcaagctggtccatttacatttgatcatattt

SEQ ID NO: 70583 - DNA, 201 bp, Homo sapiens
ttggaaaagtttgagtttcactgccttttatttagaagtacctgattggaggtgtcaataaaacatttctaaatatgaatattttattaagagtaatcaartagctccacatagatgctacataataacagcatagaatcacaattttattaaaattcaaaagacttatgtatatattacctaaatttgctccctcattca

SEQ ID NO: 70584 - DNA, 201 bp, Homo sapiens
attgcattcatgttttatctcccaaatactgctagctcccttaggatgaggttattgttttatataaaagatccctttcaaaaaagtagtctcaaaaaaarattgtaactcttgatttacatagcaaagtattaattaacagcatcttccaagatcagacgagattgagcgtgttcggggtggtatggcagtagacaagta

SEQ ID NO: 70585 - DNA, 201 bp, Homo sapiens
tgagcgtgttcggggtggtatggcagtagacaagtaacagcatcttaattagttcacgtaaaacaaatctctagccacattcactccaactttcaatatcrcaaaatgtgtggtatttcctaaaaacatagctttctatgtcatcatcaagtgaaagtaaatacctcccccctctataaaagaacaaaacctattcaactt

SEQ ID NO: 70586 - DNA, 201 bp, Homo sapiens
tcttttgtacatttaaaagtgtggggatcctcttggaattagcctgtgaaatgtatttgcattgaaaggtcaatctcaggaatttcagagcaaaggttttktttgtatgtatgggtgaaaggacacttacagttttagtatcaatgcaatttgatataaactcattagaaagtctaagtttactaagctatgtattaattt

SEQ ID NO: 70587 - DNA, 201 bp, Homo sapiens
agttttgcctgttttgccttctcttctttcacttgttttatggtttgggagcttcatcattttattctgcatagcaggagttcatttttattgctgaattygattgtttaagtattatgagtaatgccatgaacattcttgcacatgccttttgctgcacaaatgtatgcatttctgtctattatttgtctaagagtggaa

SEQ ID NO: 70588 - DNA, 201 bp, Homo sapiens
ctccataggtttaattgtagagctgtgtttcttttttttgtttgtttgtttgtttttgagacggagtctcgctctgttgcccaggctggagtgcagtggcrcgatttcggctctctgcaacctccgcctcctggtttcacgccattctccttcctcagtctcccaagtagctgggagtacaggcgcccgccaccatgccca

SEQ ID NO: 70589 - DNA, 201 bp, Homo sapiens
ttctcaccctgtcacccaggctggagtgcaatggtgcaatctctgctcactgcaacctctgcctcccaggttcaaatgattcttctgcctcagcctcccgmgtagctgggcttacaggcgcccaccaccacgcccagctaatttttgtatttttagtagagacagggtttcaccatgttggccaggctggtctcaaactcc

SEQ ID NO: 70590 - DNA, 201 bp, Homo sapiens
ctgcaacctctgcctcccaggttcaaatgattcttctgcctcagcctcccgcgtagctgggcttacaggcgcccaccaccacgcccagctaatttttgtakttttagtagagacagggtttcaccatgttggccaggctggtctcaaactcctgacctcatgatccgcctgtctcagcctcccaaagtgctgggattatag

SEQ ID NO: 70591 - DNA, 201 bp, Homo sapiens
gtagagacagggtttcaccatgttggccaggctggtctcaaactcctgacctcatgatccgcctgtctcagcctcccaaagtgctgggattataggcctgwgccactgcacccagctggtaattttttaatatagtattttatctaaggaagttaaggatggtttaacatttaaaaaatcaaagaaattcactatattaat

SEQ ID NO: 70592 - DNA, 201 bp, Homo sapiens
cctttctgtttcaagcgattctcctgcctcagcctcccgagtagctgagactacaggcacatgccaccatgcccagctaattttttgtatttttagtagakacggggtttcaccatgttggccgggatggtctcgatctcttgaccttgtggtccacctgcctcggcctcccaaggtgctgggattacaggcgtgagccac

SEQ ID NO: 70593 - DNA, 201 bp, Homo sapiens
tatatttttatataattttttatgtttgcaaaccaagaaacatgccatttctcctagtaaaaatgggggaagtgaggactactttgccttttctcctggasagagtagtcctcatttcccccttttttctttataaaaaggaaatgatgataaaaaattgttaattggataccacttcaaatggggattagttatgcatag

SEQ ID NO: 70594 - DNA, 201 bp, Homo sapiens
ctattaccatctagatttgtgtaaggacagtctgtctacacaacagtgaaagcacctaacaatgcacttctcagaacatatccctgttgttgagcaacacrtgactgtatgttactgcactgtttgtaaattttctgaagttgtgctccattccagtgcagtttttttctatgacaatacaacaaagaagctcctgttcct

SEQ ID NO: 70595 - DNA, 201 bp, Homo sapiens
aagccagagtgcaatgtcacgatcttggctcactgcaacctctgcctcccgggttcaagtgattctcctgcctcagcctcccaagtagctgggattacagrcatgcaccaccacacccggctaattttttgtatttttagtagaaacggggtttcaccctgttggccaggctggtcaggtatccattttttagtcaaaact

SEQ ID NO: 70596 - DNA, 201 bp, Homo sapiens
taatgccagtttggggccagctctaggtagaatgctaaaagttgttgagacttctgtcttccttctgttaccctactacattctgtcatccttcctcctgwctgtgccctttgtcagtgcccttacccctaaccccaaaagctcctcactgagatgcttgacatgttacttttcccagcatatttgtgttttaataaagca

SEQ ID NO: 70597 - DNA, 201 bp, Homo sapiens
ctttaattgagcattttatgttattttattttatctcttttcttagactgttaagttttttgggtttttttgtttgtttgtttttcagttgttaccctaarttttgcaatatatttctactttcaaatagccctattcacttcacaggtagtgcaagtaccttataataaaaaaaattcctaagttatccttctcatgtcc

SEQ ID NO: 70598 - DNA, 201 bp, Homo sapiens
tttttacatttattctgctcagtgttcactggacttcctggatgtgtatctgacattaatttggggaaattctcagtgaatgtttcttcaaatattggttmtcttctttcttcttttggtgttgctattacacatgctacacctatttgcttcatagttcttagatattttgttctgtgtggttttattatttttttttta

SEQ ID NO: 70599 - DNA, 201 bp, Homo sapiens
taaatgtctacttagatgccagtgatgcgaatagaaactgtcgtgtcagcttataacattctcagagggttgcactttcaatgcagatggggggaaggacraagtaatagcttcttgttgggattacagtaagtgagggctcaagtgaagatctcttagttccttgaatgatcctttaaaaggtaatagttttccattttt

SEQ ID NO: 70600 - DNA, 201 bp, Homo sapiens
tggtcgtatatgtcttttgaatagcaataatttggaaagggggcttgacttttgaaaggaaaagaaagttaatgctttgggaatgtctggcttatatattrgctgtacattttcccctattgtgttgcctatgtctagcagataataaagtcttatgaaatcatttcattatgttagtgattaagcatttgtatttaaact

SEQ ID NO: 70601 - DNA, 201 bp, Homo sapiens
ggcccagcggtaacccgccgaaggcccggggccgtaggttcgggcaagcatcgcgcgccagcggccccagctcagcggctgccgcatctccacgccgcttrattcgtccgttgcccaaatgacccctccgcgctccagagcggagatcgcggccgtacattttagaagagtgccatcaataccctcagagttgagctgggg

SEQ ID NO: 70602 - DNA, 201 bp, Homo sapiens
gatcttcactgtgagaagctggtgtagttgctgaagataaaactcacaaatgtgtgagggaccccgctctatgactctcagacttgtcaaacactgaaccyccagcagtttgttaattgcatttccagttgtcctaccctggcactggctctcatggaggtttctctttgtgggtttccgctccagaaagttgtgattttc

SEQ ID NO: 70603 - DNA, 201 bp, Homo sapiens
tactgtcctaattgttgtttttaaagtaattagaataaaaataatggattattctatttttttaagaagttagtcaggctgtcacattaaattaagtagtrtaggtgcaaaaccagtctttttaaactattactaccactttttccctaggtcataatttaataaaggagttcagtaatttaagttcctcatctatatcta

SEQ ID NO: 70604 - DNA, 201 bp, Homo sapiens
ttttaaagtaattagaataaaaataatggattattctatttttttaagaagttagtcaggctgtcacattaaattaagtagtataggtgcaaaaccagtcyttttaaactattactaccactttttccctaggtcataatttaataaaggagttcagtaatttaagttcctcatctatatctaatatgtaatattttataa

SEQ ID NO: 70605 - DNA, 201 bp, Homo sapiens
gagagttcttaagagactcttatcttttaagcagcatactctactcaattacccagccttttaatggagggcagatagaatagaatatgaagttagtgaaktagtattttgggctagaatgaatctaaggatttttagcttaacattataatatctttataatattaagtgaattctaaatttgatatgttgcatttcagt

SEQ ID NO: 70606 - DNA, 201 bp, Homo sapiens
tcaggctgtcacattaaattaagtagtataggtgcaaaaccagtctttttaaactattactaccactttttccctaggtcataatttaataaaggagttcrgtaatttaagttcctcatctatatctaatatgtaatattttataaggatttaagttgagtaaacatttgctctcagagcgtgaaccagtttctctttttt

SEQ ID NO: 70607 - DNA, 201 bp, Homo sapiens
ttaggtattttgctatgtgataaagatcctttggtaaaattcaggaaagctttggaccttaaaaaatcattcccttcctgatgcagtattttattagaagrtaggtgagttctgagtatttatagaatctgggttggtgttaaggcatctctgaagtctatacaaagtataagactgtatcttaacaaggactgtagaaac

SEQ ID NO: 70608 - DNA, 201 bp, Homo sapiens
tacaccatctccctctcaaacaaccagttactttactctaggacaagaatccaccatgcaaggtccctcatacaaaatcactttctttatatccctccccmcaaaaaaaaaaaaaaaaaaaaaaaatatatatatatatatatgtgtgtgtgtgtgtatatatatatatatcttttatccacactttcctcacatccctct

SEQ ID NO: 70609 - DNA, 201 bp, Homo sapiens
aaagtatttaaggaatggatgcctattaatctttcacattgtttatcaaaatgatgtgaatagtctttggtgagccatattaagattaaagctggaaagcstcctgtacggttgttttccaatttcagctttgccatctttacacaagactctcataagtgtttttgttattgttgctggattcttcttttgtttgttttt

SEQ ID NO: 70610 - DNA, 201 bp, Homo sapiens
ctcattattattattatgttatcttgatctgagatcagtgatatttaacattattattgtaattgttttaggacaccataaaccacacccatgtaagacarcaaacctaataaataaacgttttgtgttctggttgctccaacagccagccatttttctgtctcttttcctctctttgggcctccctactccctgagacac

SEQ ID NO: 70611 - DNA, 201 bp, Homo sapiens
tctgcttaggacacaagctgtactttatataatcagtttgtaaatacatttcaaagctcttcagttggtaagctgatagaattgtattactgtttagccayggaaggtaaacagttttttttaataaatttaaataaaaggaattaatttttttagatcatgaaatgctttattatttggtgtttttgatggatggccact

SEQ ID NO: 70612 - DNA, 201 bp, Homo sapiens
tgaaatgtatcaggaagagggatgatttttttcaaccacattttaatccatatttgtaaaagtaatatggaactggcatagaaacagatgattacactaaygaaacagaagagacaggtcaaaaacagaaccatggtggggaaaaggaatgttgcttagtaggttcttgaagactggtttacaaaattttaaaaataaagt

SEQ ID NO: 70613 - DNA, 201 bp, Homo sapiens
gttattaattaggctattttttattcaaaaatattaacttttatggaatacctttattttcccctatgaacttgagaaaaatgagtttttattagaggctrtagtataacactaactaaaatgtagtttggaaagttttattgagtttttcttccttaaccttttctttggctggctgcaaacaactagtgataatgtgtt

SEQ ID NO: 70614 - DNA, 201 bp, Homo sapiens
cattgtcaaaactaaagatttttgttcaatgattaaagagtaaaaaaattaacagaatagtgacagattggaagaagatatctgcagtgtcataagcagaygagataaatatgtagaccataagaaaaatgctttcaaatcaagaagaaaccaatatatacaaaagcaaaagttgttactagacaattcatggaagggact

SEQ ID NO: 70615 - DNA, 201 bp, Homo sapiens
aaaaagcccttgggaggactgaaaaaaacccagtagtgattaaaggggcaaaattgtaagaacatgaggtgtaaatgttatactcgagtttgtgactgatrtgatgtaaaataatgaagcacagtaaaaagataagtcaggtttacttctcactagattaatagaacagctggacaaatattttcacatgtgtttatgata

SEQ ID NO: 70616 - DNA, 201 bp, Homo sapiens
gactcaaattacacacatatatatggagattgtgtcttcttttttactttttttgtttggtttttggtaatctctatctagtgctgcacctaccagttcayagcctttttccccttttgaaatggctaatctgctgttaattccattcagtgccttttaatattgtggacattgtagttttcttctctagaagtttgattt

SEQ ID NO: 70617 - DNA, 201 bp, Homo sapiens
atggggatttttaaaattatttttttattgcggtaaaaaagcacataacataaaagataccatcttaactgtttatttttcttttctatcttagcagtttytaagtttacagtttagtagtattaagtatattcacattgttgcacagcctccaaaactttttcatcatggaaaacagaaaatctgtacccattaaacaac

SEQ ID NO: 70618 - DNA, 201 bp, Homo sapiens
gttttaccatgttggccaggctggtctcgaactcctgacctcaggtgatctactctcttcagtctcctggagtactgggattacgggtgtgaaccacagcrcctagccgtctttgtatattttaatgtagttaatcttaagatatatgtagttttatattctgcttttttcacttaaaattatgtagtaaacattttacat

SEQ ID NO: 70619 - DNA, 201 bp, Homo sapiens
gtgaggtgtcagtctgcccctactgggggtgcctcccagttaggctgctcgggtgtcaggggtcagggacccacttgaggaggcagtctgcctgttctcaratctccagctgcgtgctgggagaaccacggctctcttcaaagctgtcagacagggacatttaagtctgcagaggttactgctgtctttttgtttgtctgt

SEQ ID NO: 70620 - DNA, 201 bp, Homo sapiens
ctggattaatgactagtcattatgaggtgtacttttatctttcatttaagtcaaaacttatgttgcattacatgctttacaaaaattgccacattattacrttatggtttggccataaataggagcaattttgggaaccatttattttgtgaatggttactgattttctgaatcattcaagttctacattctattaaattt

SEQ ID NO: 70621 - DNA, 201 bp, Homo sapiens
acagggtttgagttcgttgcagttgctagggacatacacctagggactgactactagggcaacctatgctgtcatgtcacattgttcataagtcttccgtsagcaaagatctgtcccaacaaatgccccatactcctttcacttccaagttattttctatcctaaacaatttttccttcctttatactggaaactccaaga

SEQ ID NO: 70622 - DNA, 201 bp, Homo sapiens
caacaaatgccccatactcctttcacttccaagttattttctatcctaaacaatttttccttcctttatactggaaactccaagatctataacattttatsataaacttgatcttattttatattatatatttgtgttcccatttcactcttctgttatcttactctaacacttaaatgctgtatgatcaaagttaactaa

SEQ ID NO: 70623 - DNA, 201 bp, Homo sapiens
acaaacccacacattaaatacaaaggaaaaaaagtaataattgtcattaacttcttggcagaaacagtgcaaaccaggaggcagtggaatgctgtctttaragttcttaaagaaaaaactgttaatctagaattccctttcaagcaaaaatatcccttaacatatgaaagtgtagtaaagacatttgtctttcaaagactt

SEQ ID NO: 70624 - DNA, 201 bp, Homo sapiens
agttcttaaagaaaaaactgttaatctagaattccctttcaagcaaaaatatcccttaacatatgaaagtgtagtaaagacatttgtctttcaaagacttytgaaagacaaaattatcggacaaattaaacttgtgagaatttcttgttagccaacttgaacaacaccatgagaaatgataccaagttcttgaggctggag

SEQ ID NO: 70625 - DNA, 201 bp, Homo sapiens
tattatttttatgtccattttgaaagttactaaaatcaatggcatttttctggtaaacagttttttccaatttatacttaattgcctcacatataacatartttcatattggtaaattttaaatagtaaacagtaaacaaatgctgaggaaaacaaagcaagagacgaaatggaaaatgtgtaacagattttctcttataa

SEQ ID NO: 70626 - DNA, 201 bp, Homo sapiens
attgtattaggtattataagtaatctagaaatgatttaaagtatacaagaggatgtgcgtaggtcataatcaagtagataccattttatataagagacttraacatcctcagattttggtatctgcaggaggtcctggaaccaatccctcatgaataccagagaatagtattttattttttgagcaactaaaatgttgttt

SEQ ID NO: 70627 - DNA, 201 bp, Homo sapiens
ctccggctgcgtggaaatgctggccagggatctgagtccagaagactgtcccaatcacccagatgagtgtgcctttcagcatatttctgcacaggcaggaygggctgctaactgcagtgagagggcctggagttgagactgggctgcgttgggatctgctgtgtgaaggagactggccccgacttatttgctcatatcagc

SEQ ID NO: 70628 - DNA, 201 bp, Homo sapiens
ttacagaaaaaggtgaggaaaaagttaatgtctggggatgggaataaaatgagaaatggggtttagctgtctataataaaacaaatagaaaatgaagaccraagctttttctctgcttcgatttgtacttttcaatttcataatatgtttgtctaaatcagtgattatcaaaagggctctaaggtgtgcatctgagaatta

SEQ ID NO: 70629 - DNA, 201 bp, Homo sapiens
attgttagatgttttcaacctaagcttgcttatggaaaatggaaataaaacagaaagaggggaaaggctgggagaaaagagaagcaaagacctctttgaayactcagcccttcccactcaccctgtgcatagcacttcacatttttacttgactgcacaatctgtctgcttttcattggttttcagagtcctcgagtgatt

SEQ ID NO: 70630 - DNA, 201 bp, Homo sapiens
cattggtctgtgtgcctgtttttatgccagtaccatgctgttttattactgtagctttgtagtataatttaaaataactttgttttatgcttccagcttcrttcttttagctcaggattgctttatctactcagggtcttgtgtggatccatatgaaatttaggattgctttttctatttctaccaaagaatgcccttggt

SEQ ID NO: 70631 - DNA, 201 bp, Homo sapiens
ccaaagaatgcccttggtattttgatagggattgagttaaatctgtagattgctttgggtagtgtagacattttaacaatacttattctaattcatgagcrtgggatatctgttcattttttatgtgtgtcctctttagttgttttcatcaatgttttatatagttttccttgtagagatctttgacttctttggtcaaag

SEQ ID NO: 70632 - DNA, 201 bp, Homo sapiens
atgccaggtaaatcaggcccgattaaaagtatgtcttttatagctgttaaatggttctgaaaaactaattctgaaggatttatagataatttattatttcrttttcttttgtaaaagttttggcaagtttttaatctgatattatgatgcttttggaagctaacagatgttgctctgaaagtcatatttctcacttaatta

SEQ ID NO: 70633 - DNA, 201 bp, Homo sapiens
tatttttagtgtatatattatagtttttagctttgtaattaccttgagtcttataaaaatattatattaattatttcaaactggtaccaacttaactttgrttgcaagataagaaacaaatgaaaagaaaaatttgtacaccttaacttcctctcctccaacattttgaatttttgattttacaacttgctgtttttatat

SEQ ID NO: 70634 - DNA, 201 bp, Homo sapiens
actaagaaagaaaatgcagccaattaaactatgatatgcattgtctctgatttctgcatttaaaaaatgaagaaatatgtttcctatagtcattgaaatayagtaagtcgttggttaggaaaggtaaggacctttctaaaggggaagaagcagagtagaggtgagagtgcatagcatgtagagcctgggttacaggctcct

SEQ ID NO: 70635 - DNA, 201 bp, Homo sapiens
tagtaataaatttcctcagcttttttttttttttttttttttggcctgggaaagtctttatctggcctttatttctgaaggatagttttgctgggtacacwattcttcgttaagttttttattttctttcagcattctgaataatttcactccctccaaccctaaggttcccactgaaaattctgctgccaagtgtattgg

SEQ ID NO: 70636 - DNA, 201 bp, Homo sapiens
atagtattccatggtgtatctgtgccacattttcttaatcctgtctatcattgttggacatttgggttggttccaagtctttgctattgtgaatagtgccrcaataaacatacgtgtgcatgtgtctttatagcagcatgatttatagtcctttgagtatatactcagtaatgggatggctgggtcaaatggtatttctag

SEQ ID NO: 70637 - DNA, 201 bp, Homo sapiens
ggttggttccaagtctttgctattgtgaatagtgccacaataaacatacgtgtgcatgtgtctttatagcagcatgatttatagtcctttgagtatatacycagtaatgggatggctgggtcaaatggtatttctagttctagatccctgaggaatcgccacactgacttccacaatggttgaactagtttacagtcccac

SEQ ID NO: 70638 - DNA, 201 bp, Homo sapiens
atcttctgaaatctaggcggaagttcccaaacctcaattctcgacttctgcacaaccgcaggctcaactccatgtggaagctgccaaggcttggggcttgyaccgtctgaagccatggcccaagctgtaccttgaccccttttagccatgcctggagcggctgggatgcagggcaccaagtcctgaggatgcactcagcag

SEQ ID NO: 70639 - DNA, 201 bp, Homo sapiens
tgtatgttttgatggtacctgtgcattgctctatcatagtacttgtcatacagtatgctaattttccttgtaatatggtgttttatatgaagccaaatacygcccataccagtttgggattagttaacattctgctagggtttgcctttgtgtttcagtcagtcagatttttaaaaattaatataaattgtttaggaaata

SEQ ID NO: 70640 - DNA, 201 bp, Homo sapiens
tttgcaagtttatctcttcatcatagttccttcaagtatgcttgtcatttctgttttgaacagaaaaaaaaaatggagcaaaatcttgaagttgtaatatrgaagtttgaaccaggggtagaatactgaaacaaacatgttaaaagatggggtctaggcttcacattacgtacgtaacccttcaagggcctattctctatg

SEQ ID NO: 70641 - DNA, 201 bp, Homo sapiens
aaataggaggtcagtggctaatagagctaggcaaggaagttgaaatcacattatggaaaagtttagaatttagtaggcagtagagagacgtaatttctgartagaaaaaaatactgtcatgagattttacaaagattaatccctgctctgactggattagaagaaacagaaactgtaggccaggggtgcagggttcttcag

SEQ ID NO: 70642 - DNA, 201 bp, Homo sapiens
ggaagttgaaatcacattatggaaaagtttagaatttagtaggcagtagagagacgtaatttctgaatagaaaaaaatactgtcatgagattttacaaagrttaatccctgctctgactggattagaagaaacagaaactgtaggccaggggtgcagggttcttcaggaaagaaatataagacaagaagttaaactaaata

SEQ ID NO: 70643 - DNA, 201 bp, Homo sapiens
gaatagaaaaaaatactgtcatgagattttacaaagattaatccctgctctgactggattagaagaaacagaaactgtaggccaggggtgcagggttcttmaggaaagaaatataagacaagaagttaaactaaataaaaataagacaaggatatatatgagtgatattgtaatgtataaagaaaagtgtctcattagact

SEQ ID NO: 70644 - DNA, 201 bp, Homo sapiens
gtgctaaatgattggaacaaagaaaggagagattactctggactggaatgatcaagaaaagctatataaggatacaacttgaggtggactgtgaactctgkgtagaaacagagttagggttcgttttggaggttctaacaattgtaatatttttagtagttacaagtagagctctgtcattcccatcatctaattataatg

SEQ ID NO: 70645 - DNA, 201 bp, Homo sapiens
gtctgttgttataaatattttcaacattatgactgtttttgtcaggatgggtttttttaaagcaatgcataaaagtactataaatatacatttgttctatrtaatggccaactaaggaaacaaaagcagataaggtaaaagcacaagaaatgaggaaacagaaagaaggcaaacaggaataggcagaaggataagtactaa

SEQ ID NO: 70646 - DNA, 201 bp, Homo sapiens
ctgcctttgctgtatcccagaggttttgatagactgtatcattattgtcattcagttcgaagaattttttaattttcatcttgattttgtttttgacccarcgctcattcaggagcaggttatttaattttcatgtatttgcatggttctgaaggttccttttggagtcggtttccaattttgtcccatggtggtctgaga

SEQ ID NO: 70647 - DNA, 201 bp, Homo sapiens
tagggttttgcaatactaacttgtatttttccataaatgcttttctaatattttccataaattttccacaaatatgccttgatattttatatatatatagrattccttgactgtgtgtgacgtagtttaaaattttcctttttctaaaatttttattttctttttaatttggaagtctccattcttattaaaattaagtgc

SEQ ID NO: 70648 - DNA, 201 bp, Homo sapiens
ctttcaatagttttgggacattctcagatagtattttttttttttttttttttttttgaggcagagtctcgctctgttgcccaggctggagtgcagtggcrcgaacttggctcactgcagcctccacctcccaggttcaagcaattcaccctgcctctgcctcctgaatagctgggattacaggcgcacgccaccatgcct

SEQ ID NO: 70649 - DNA, 201 bp, Homo sapiens
agttctggaggctggaaagtccaagatcaaggtgctggcaggtttgggctcagtctctttgcatccaagatggtgccttgaatgccatattctctaaaggrgaggaacgttgtgtcctcacatagcagaagggtaagaaaaagggcaagcctttcttatagctgtattaatccattcatgaggctggagacacctctcatt

SEQ ID NO: 70650 - DNA, 201 bp, Homo sapiens
gtgatcagaggtaaggtttaaagtctaccacttagacctggtttttaacttctcatcaaaataccacagtctgcattgagtgttctgatcaggcttgtttycttattattgaggtaacttactttgctctttctctgcacatttaaccatggtgttctttttattgagaaaaccaccccttttgggctcttatataaattc

SEQ ID NO: 70651 - DNA, 201 bp, Homo sapiens
cacagctcctcttcttctcattgcccaaaatgtggtgaccagtgggcgtgtttcagtcctgtttgtgttacagctctttcagtcctgccatttggaaggtyctgagttcttgtccagcctttaggaagaatgaggtatgtggacagctggagggtgagcaaggcagagaggagcttcattgagcaagagaacagctctcag

SEQ ID NO: 70652 - DNA, 201 bp, Homo sapiens
gatgggaggtagaatatgtagcaaagttctcttaaaatgtctctgaaataaagtgatgtgagaaaccagacaaggcactttgtagtaatatcttgctttcwtaggagtttagctcagtaggaattaccagatacataagagatgctaatgatttgcagcttctagatgttatttcctctggtagtcttcatcaaattgaac

SEQ ID NO: 70653 - DNA, 201 bp, Homo sapiens
ttaagtttttagattctaattgaagtctctatgccaatactttattactttttttggttcatttgcctttgagaattttcttagcatttttaatttacttyaataattgagcgattatgacaggaaatcatttcatgtaaaaaacagaccaagtattctggttcctagccagttttctttcatttagatatgatggtacta

SEQ ID NO: 70654 - DNA, 201 bp, Homo sapiens
ttttggaggctcaggtagtcataatattgtgtaagattggcacatgtttttatgaggttaatttatgtggtgtcctaacttcataaatttgatacatgaaygacataggacattttaaaaaacctacatagtgtcttacatcaactatgtagtatcctatgtagtgtgtatctctgggaaatttctttagtgattgtctcc

SEQ ID NO: 70655 - DNA, 201 bp, Homo sapiens
gtctgggcgacagtgagaccctgtctcagattaaaaaggctgcatgaaaagttttttttttccttacctgtgatttaaaacaaattcaaaataaaaaacarttatacagttttagtttttccttattttctgatgagttctcatgtaaaaactgcttataataaagcttagatatgatattcttttaacttagttatctgt

SEQ ID NO: 70656 - DNA, 201 bp, Homo sapiens
acaatgagttaaggaatcctttcacgtttttcccaactttaaaattaaggattctcagggccctgtgtagagcagtaaaaataagacctcgtgtatgtgtrtgtgtgtgtgtgtgtgtgtgtgtatgtgtgtctgtctgtctgtctggaggagaattgattggtgttccacttgggtgagagggttggctgtgagcctcag

SEQ ID NO: 70657 - DNA, 201 bp, Homo sapiens
tttagttgatcctcccacctcagtcacctgaatagctaggactacaggtgtacgccaccacacccagctaattttttgttttactttattttttgtagacrtgggttttctctgtgttgcccagagtagtcatgaattcctaggctcaagcagtcttctcacctgggcatcccaaattgccgggattacagatgtgagcta

SEQ ID NO: 70658 - DNA, 201 bp, Homo sapiens
aagcataaacttagccatcaaagtgtatccctaataacgttttacatctttagtgaaatgttgcctctttaatctgtacctaaaccaatttcactatcttyctataatctataggcgaaaaagagcattagcttagaccatcaaaatgaaatgattcaggaactgggttcagaggcaaaacatttctcacccattttatgg

SEQ ID NO: 70659 - DNA, 201 bp, Homo sapiens
tggctaattttgcaaggcttgtacaaccctaattccaaaagatagcacaagaacagaaaagtataggtccaccacacttatcattacaagtgtgggaattytaaatcaaatttagtgaataagtccaatggtttttttttttttttttttttttttttgagtcggattctcaccctgtcacccaggctggagtgcaatggt

SEQ ID NO: 70660 - DNA, 201 bp, Homo sapiens
ccctccagccagagactcctgggaacatacacctggagtggaacaagttgggtttattcctccttgtatggaggggtaatgcacaccttgcagaactgggrgtgtcttagcaagaggatgttaggagggaattataagagctgagcttgtatgagatgatatgggggagagcttaagaaagtgggcattgtactggattgc

SEQ ID NO: 70661 - DNA, 201 bp, Homo sapiens
aagagctgagcttgtatgagatgatatgggggagagcttaagaaagtgggcattgtactggattgcttactttcaggaggcagagacaacgccatgattgrttatcttaattaaatcatctgtaaggagggaagaattgagtgaagctaatggtgtagttggtgaagaagcagtcactcttactagctggaactgggaata

SEQ ID NO: 70662 - DNA, 201 bp, Homo sapiens
ctggattgcttactttcaggaggcagagacaacgccatgattgattatcttaattaaatcatctgtaaggagggaagaattgagtgaagctaatggtgtarttggtgaagaagcagtcactcttactagctggaactgggaatatatgtttattttgtggcttggagagtgttcatattttgtccatacctgaatatgcag

SEQ ID NO: 70663 - DNA, 201 bp, Homo sapiens
tgcttactttcaggaggcagagacaacgccatgattgattatcttaattaaatcatctgtaaggagggaagaattgagtgaagctaatggtgtagttggtraagaagcagtcactcttactagctggaactgggaatatatgtttattttgtggcttggagagtgttcatattttgtccatacctgaatatgcagcggtct

SEQ ID NO: 70664 - DNA, 201 bp, Homo sapiens
atttactttttaactgtagaaaagagcttgatttgatttttttttttttttttttgagacggagtcttactctgtcaccaggctggagtgcagtggcacgrtctcggctcactgcagcctccgcctcccaggttcaagcaattctcctgcctcagcctcccgagtagctgggactacaggcgtgcaccaccatgcacagct

SEQ ID NO: 70665 - DNA, 201 bp, Homo sapiens
ctcttgaaaatttctatgtgttttctctctgaatatgtagaaattccatgtttgttctatgtagataggattaagatggaactgtgttctaaaaattgggytgttttttataaattgtccaaatttacattttcctaaaaaatatattaagaatgttagcttgcaacctcttttaaatccataatatgctgacatattatc

SEQ ID NO: 70666 - DNA, 201 bp, Homo sapiens
caacaaagcaaaagaagacaccaaaccgaccaacagcaaggagtaatattgaatattcaaaaataaaatctattccttgacttcaaatcattaaagtagarctgcctatttaagaacttttatttgcacagtcctattaattttaatgcctaaagcagtgttaatcgcatgacccacgtgaaaagattttaaaaattgctt

SEQ ID NO: 70667 - DNA, 201 bp, Homo sapiens
cttctcattgcccaaaatgtggtgaccagtgggcgtgtttcagtcctgtttgtgttacagctctttcagtcctgccatttggaaggttctgagttcttgtscagcctttaggaagaatgaggtatgtggacagctggagggtgagcaaggcagagaggagcttcattgagcaagagaacagctctcaggagacctgaagtg

SEQ ID NO: 70668 - DNA, 201 bp, Homo sapiens
atttgtgaccagcagattacaaacaagcaagaaagtgtaatcccattctgctatatttttaatggacaggattggatatatctttctaatcatagaagacrtctggaagaaaatggtttctgcagagggaaattaatgtattgaaggtgggaacaagattttggtttttacatacacatttctgtactgtttgttgttgct

SEQ ID NO: 70669 - DNA, 201 bp, Homo sapiens
gaacccgggaggcaggggttgcagtgagctgagatggcagcactgcactccagcctaggcaacagagcaagactccaactcaaaaaaaaaaaaaaaaaaamaaaacctggagttaaaattaaatttagcatataacttaacaacaacttaaaattacctctgttgtcacatattctagttgctagtgatttttagcagtga

SEQ ID NO: 70670 - DNA, 201 bp, Homo sapiens
taattcttccattatctcagtgggcaattgagtcatgtcctagcttcctcttttaggtggaaacttgacaggcctagaatgtccacagtggctcacctatrtgtctggcttatctgggactttctcctgtagcaccttcgaactcttccacatggcctttctacagcatgggcttctcacagcatggcagccgagttccaa

SEQ ID NO: 70671 - DNA, 201 bp, Homo sapiens
gcagttagttgtttgcgtgttgatctttctctactttttagtgttcttaaaggtaaggaccaagtcatatgcttctgtattttcctcacagtgctttgcamaaaaaaaaaaaattgtctagtaggtgtctttttagttacttttaaagtatcttgtgggtagttaagacttttttattcaaattttatataaaatctgttt

SEQ ID NO: 70672 - DNA, 201 bp, Homo sapiens
actgtgagtcaaacagaaacaagttttaattaagactatgcaagcaaagaacctgattgtatattttaacttgttgattattcgatttagtaaaacaaacsgtcattactatcagattttaaaataatccctcaccacagggtaattgtttgaatctacctatcaaggtagttaaggtatatcatccatcctcctggatat

SEQ ID NO: 70673 - DNA, 201 bp, Homo sapiens
agatttttccatagttgaatttgcatgctatgccttcaattagattataaaaccctcagaggccgtttgaaaaactgctgcaccactaaatcgacttcttycaaagtgaaggctcctccatccaagctttcttatcattgggctcaaggttgaaagccagtaaaaagttttcttattgaagactgaaaccacccaccaccg

SEQ ID NO: 70674 - DNA, 201 bp, Homo sapiens
agtatagtaacatgccttacaggtttgtagccttgctgtatagtaggccataccatctagattttcataagtagactctttgatgtttgcacaatgataaratcacataaagacacatctctcagaatgtatccctgtcattaagcaatgcatggctgtatctagaaaaagtaaaaaaaaaatttttttttttttttgaga

SEQ ID NO: 70675 - DNA, 201 bp, Homo sapiens
cgttcaggctggagttcaatggcgcgatctcggctcagtgtaacctccgcctccctggttcaagtgattcccttgcctcagcctcccgagtagcggagttyccaggtgccggccactatgcctggctaatttttgtatttttagtagaggcggggtttcaccacgttggccaggctggtcttgaactcctgacctgtgtgt

SEQ ID NO: 70676 - DNA, 201 bp, Homo sapiens
actcttctgtgtaataataagctttttttttttgagacagagtctcgctgtgtcacccaggctagagtgtagtggcatgctcttggctcactgcaacctcygcctcccaggttcaagcgagtctcctgcctcagcctcttgagtagctgggattactggcatgcaccaccacgcccagctaatttttttttttttttgtat

SEQ ID NO: 70677 - DNA, 201 bp, Homo sapiens
cctaatcttgctttatctgtattaaagaagcatttggaaatttataattgttcttgaccttggaggttggttttctcaaccttttttttcctgcaatatgyagtatctttagtaatttggtacacttatgatttctaaacaaaatatgtgtcttttgaacattgttgaaaagttagtgtatgaccccacaaagaatttgga

SEQ ID NO: 70678 - DNA, 201 bp, Homo sapiens
aataccaaagcctggcagagacaaaacaaaaaaagagaattttagaccaatatccctgatgaacatcgatgcgagaatcctcaataaaatactggcaaacygaatccagcagcacatccaaaagcttatccactatgatcaagtcagcttcatccctgggatgcaaggctgtttcaacatacgcaaatcaataaatgtaat

SEQ ID NO: 70679 - DNA, 201 bp, Homo sapiens
tttgtctccttggcttattaggggctagtatgcattgcaaacattgcaacagatgtttacttattatttgggtacattaagttgtgctatgtttattacaraatcagtctttgtactttacttttttggagacagggtctcacctgtcacccaagtttagtgactgagtgcagcagcatgatgatggctcactgcggtctt

SEQ ID NO: 70680 - DNA, 201 bp, Homo sapiens
tagtgtccagaattttactggaggttagtcacgttggtatactacagtgctggcgtgactgacctcagctatccagattccagtacttcccagggcaaaarcaagcattcaccataaatcacactgtcagtataaacttatctggtcagattggtacagcatggcccaaggtacatacatactgggatattgtgcctgata

SEQ ID NO: 70681 - DNA, 201 bp, Homo sapiens
ggggagagacacagagagaaggggtgggtgagcagccaaagcaggtgtccccacaattgacttgccaccaagggaatgtgggtgaatgaccaaggcaggcstccctgcggtgatcagacaccaatgaaatgtgggtgaataatcaggcaggcatccccgcagtgattaaacaccgagggaagactgtcttctcaagtctgt

SEQ ID NO: 70682 - DNA, 201 bp, Homo sapiens
tcttttccttcttttttttttttttttttttttgagatggagttttacccttgttgcccaggctggaatgcagtggcgaggtctcagctcactgcaacctmcgcttcctgggttcaagcgattctcctgcctcagcctcccgagtagctgggactacaggcgcccactaccacacccggctaaatttttgtatttttagta

SEQ ID NO: 70683 - DNA, 201 bp, Homo sapiens
ttaatttctttaactgacacaggcctattcaatttgtttattcttgtgtgggttttggcagattgaagtttttaaggaatttattcatttcatctaggttwtcaaattttgggccataggatgtcttagttttttaaaattatccttttaatatatatagatctgtagtgatgtgtcctctgtcatatctgatattaggaa

SEQ ID NO: 70684 - DNA, 201 bp, Homo sapiens
tttattatttctttcgttctgcttactttagcttgctcttctagttgcttaaggtgaaagcttagtattgattttagatcttctctaatatatactctcartactataagttttgctttaagtactgctttctctgcattgacaaattttgataagttctattttctttgtatatttatagacaatagaactttgataagt

SEQ ID NO: 70685 - DNA, 201 bp, Homo sapiens
caccagttcttatgggaactaagagtgaaaacttactcactcctggagaatggcaccaagccattcatgagggatctgctgccacaatccagacagctctyacctaggccctacctccaatattggggatcaaatttcagtgagatttggcaggaccaaacaaaccatatccaaactatagcaagacagaaaggtaaataa

SEQ ID NO: 70686 - DNA, 201 bp, Homo sapiens
agagaatgagagccaagtgaaaggggaaaccccttataaaaccgtcagatcgggctgggcgccgtggctcacgcctgtaatcccagcactttggcaggccraggtgggcgaatcatttgaggtcaggagtttgagactagcctggcccacatggtgaaacgctgtctctactaaaaatatagaaattagctgggcgtggtg

SEQ ID NO: 70687 - DNA, 201 bp, Homo sapiens
ttttctgtgggatacttattaaattaaggttgagccatttttaaaaaacgtattttctctgtgaggaaaagcaaatctgtcttaatgagttacatgaaatkatatgaagttatatgaaatctaagggatttgaaaatttcaaaaagatttaaaggaaatacatcagaattttggttgcatttcagttaacagatttattta

SEQ ID NO: 70688 - DNA, 201 bp, Homo sapiens
tctgtgggatacttattaaattaaggttgagccatttttaaaaaacgtattttctctgtgaggaaaagcaaatctgtcttaatgagttacatgaaatgatwtgaagttatatgaaatctaagggatttgaaaatttcaaaaagatttaaaggaaatacatcagaattttggttgcatttcagttaacagatttatttatct

SEQ ID NO: 70689 - DNA, 201 bp, Homo sapiens
tgataaaataaaacaaaagcatgaatacttgacatatttctctcatcactaagacaacatgccagttagtcaattaaaaaacaaaaataaatgtatcaaamcacgtggtattatgtggagaagacttgatcccaaatgttcccttttctcgaagttatttgctgttgtccatactatccacgctatccaagtttacctgga

SEQ ID NO: 70690 - DNA, 201 bp, Homo sapiens
aaaagcaatataattctattacatatttatcttaacaagtaacattttaaaagtccatgtaatttatagatttatttgctttctctaacaagtaatgcttytaataaaaatctgggcctggtggggtggctcatgcctgttatcccagcattttgggaggctgaggtggacgcatcacaagatcaggagttccagaccagc

SEQ ID NO: 70691 - DNA, 201 bp, Homo sapiens
tggtctcaaactcgtaggctcaagcaatcttcctccctcagcctcccaaagtgctagaactacaggcgtgagccactgcacctggcctgagatgtcttttrtacaccagattttgaagactattcaaaaacaatgtaaaatatttttaaacaattgttaacattgatttttaaatgatgatattctggaatattggattga

SEQ ID NO: 70692 - DNA, 201 bp, Homo sapiens
gatgatattctggaatattggattgaatatattacatttgttttacttttttaaaaacctttaaaatatagtttcttaaaaaatgtaaaaatggccaggcrcagtggctcacacttgtaatcctagcactttgggagaccgaggtgagcagatcacctgaagtcaggagttcgagaccagcctggccaacatggtgaaacc

SEQ ID NO: 70693 - DNA, 201 bp, Homo sapiens
cagcctggccaacatggtgaaaccccgtctctactaaaaatacaaaaaaattagacaggcatagtggcacgtgcttgtaatcccagctactcaggaggctraggcaggagaatcatttgaacccgggaggcggaggttgcagtgagccaaaattgcgccactgcattccagcctgagcaacaagaacaaaaactccatctc

SEQ ID NO: 70694 - DNA, 201 bp, Homo sapiens
acacccactcccaccgtaatggcattaatccattcctgaggattaatgttgttacggtctcatggcctaatcgcctcccagtggtcctacctcttaatacmataaaaatatcaattaaatttcaacatgagttgtggaagggacattcaaaccattgcagttattttagagctttagttcagaaatacaaatgcaataact

SEQ ID NO: 70695 - DNA, 201 bp, Homo sapiens
ctcaccattatgaatttaaagactactatgtctgtacaatttattagaacttattacatatgacctaatgatatctcttccattagctattttttccaatyctatttaatattccatgcatttgcaatcctccagggtaaccctacattatgcactggggctcaatttgtactaatgaaatgactggcttgcctaaagtca

SEQ ID NO: 70696 - DNA, 201 bp, Homo sapiens
aaatcttttgtttttgcgccttgatgtggttgccttttagccaaatgcttctcaagctctctgtggtgaagactttaaaatttataataggtcacagatcrgcacttttctaaaatacagtaaaaatgattttctagaaaaataaggaaaaatttttattaaacagatgtgaaattactctgtaaatttcaataaaagctt

SEQ ID NO: 70697 - DNA, 201 bp, Homo sapiens
ggtgtcggttttgtagacctttggtttttttgtcaggttcaatttcagttaacaaaatgtaaaacatgacattccctgcaaacgttgttgtataccaataygtatggtttcttctcttttttaaaagtttttgaccatcaagcagcagttgtcagtaggagtttataataccaagaatgtgctgcatatcttgtctcatta

SEQ ID NO: 70698 - DNA, 201 bp, Homo sapiens
aggtgttgttaactggcctgaattctggaccccctttttcagccaaaagttgaaatcactagtggtgtgtgttcgtataaggaagacgacttctgttactmtctttacgtattcttggtaatacaaaagaaaaagatctggtgaccataatgtggggcagaagtagaaacataacttaatcctctagagccagatagatgt

SEQ ID NO: 70699 - DNA, 201 bp, Homo sapiens
ccactgtactccagcctgggcaacggggcgagactccatcccccccaaaaaaaagaaagagagaaaagaaaatgaacaaatttacatgcctaccatttggracttgttatgatatttaaaatgtatactaggaaaaaatattttaaaattaaaaatgagtatataagatgctggtatataatttgggtagggcattttatt

SEQ ID NO: 70700 - DNA, 201 bp, Homo sapiens
tgatatatgatgatatgttaggcttatttattgagtcaatgcttcacacctgttctgtgtcacaacacctcccttagaggataaggttttttttttttttwaaaaagcgattctttcttgtaatgccacaggcattataaatctctcaattgaaaaatactgaattaaatttgcttcttatttaaaactacttaagggtaa

SEQ ID NO: 70701 - DNA, 201 bp, Homo sapiens
tgtctcaaaaaaaaaaaaaaaaaaaaaaaggagttccattccaagagggccaaataggaacagctctggtctgcagctcccagcatgatcgacacagaagwtgggtgatttctgcgtttccaactggggtgactagttcatctcattgggactggttggacagtgggtgcagcccacggagagtgaactgaaatagggtgg

SEQ ID NO: 70702 - DNA, 201 bp, Homo sapiens
tgctgagtcatatggtaactttgtgttttaaccttttgagggtcttctagatattttccaaagtatctgtaccattttacattcttaccagtaatatatasagagttcccattttttccacttctttgctaacacttgttattatttatctttttgattatagctatcctagtgggtgtaaagtattatctcattgtggtt

SEQ ID NO: 70703 - DNA, 201 bp, Homo sapiens
ggagaatgttttcagagcttatagtaacagtttaatgaacaataaaaagcagaagggacaggagacaatatgttgagtaccggctgtatacagaagctttktatatattgcatgtatgtatacacacacacacatttacccttttctttttaaacagatgaaatagtctgaggagaacttgcctaatattttatgaggtag

SEQ ID NO: 70704 - DNA, 201 bp, Homo sapiens
atgaacaataaaaagcagaagggacaggagacaatatgttgagtaccggctgtatacagaagctttttatatattgcatgtatgtatacacacacacacakttacccttttctttttaaacagatgaaatagtctgaggagaacttgcctaatattttatgaggtagttaatagtactgttgagattaaactggattattc

SEQ ID NO: 70705 - DNA, 201 bp, Homo sapiens
caaatgatattttcatggctatatgtttctgaaaaatgcccatcatttcaaaattgtatacattatttattttaaggttgcaggtggattattcttttgaytaagtctatattataaccatatacatgtaattttacatcacagtttagtttctggtgtacctaatgctgatttctgttcccttcttatccttttacagtg

SEQ ID NO: 70706 - DNA, 201 bp, Homo sapiens
cctgctgtgctattagtcatataaaagtatagcacattccatttgtatagtacatcatacttgataataaacaactgtgttacaggcttatgtattacctrtactatacatttttatcattgtagtgtgtactctgcttataaaaaaaaattaactgtaaaacagcctcaggcaggtcctacaggggatattccataaaga

SEQ ID NO: 70707 - DNA, 201 bp, Homo sapiens
ggactctgttcagacatgttttaacaagttagtatgaatttattttggtgcaaaaataactgaaatccatgcataatttttaaaataatacatcttttacrtgaactttttgaagacccctcatatattaaacctcttaatattgttgttattaagggacctgtgtctctgaggatgtcatgtttttttttgtcaatcttt

SEQ ID NO: 70708 - DNA, 201 bp, Homo sapiens
tttgtaaactgctatctcattagggcattgtctcatgaacttttcataaagcatcaatagttttaccatttttctatccaagcttcaccataaatttgctkcttcttgcttcaattttaacaaaattcatgtggctctgacaaactgttttcaaactggtatcttacccttagtgcctcaaactggactctgttcagacat

SEQ ID NO: 70709 - DNA, 201 bp, Homo sapiens
gaaatccctcatcttctgcgttgctcacgctgggagctgtagaccggagctgttcctattcagccatcttggctcctccccactattttgaatgttttctrtgttatcttttgagataatctagtgtttcttagtctgtcaatatgaattatattaattgattttcaatgtttgaatcagtcttgtagtcctggaatgaac

SEQ ID NO: 70710 - DNA, 201 bp, Homo sapiens
gccagttagatctggaggatacccagatcccaacatcaagaagtactccttataaaccaattgatgacagaattacaaataaagccagtgatgttttgctkgatgttacacagagccctggagatggcagtggacttatgctagaggaagtcacaggtcttaaatgtaattttgaatctgccagagaaggaaatgagcaac

SEQ ID NO: 70711 - DNA, 201 bp, Homo sapiens
gttaaaaggaccatctttgctcccttgtattgcctttgctactatgccaaagattagccagctgtatttatgtgggtctatttctaggctctctgttctgytctgttggtactttttgtgtgtgtctctgtctctctctctcttttttcttttttttttttttttggtcactaccacactgttttgattactgtcgcttta

SEQ ID NO: 70712 - DNA, 201 bp, Homo sapiens
taattagttgcatagccttttattaattccctcaaaatttataatgttttaaattaacaacatagataagcatactgcattttttgggaaaacatgaaatrttaattatgtagcagtgacataagtttcgtaaactctgttgaatgttagaagatgcttacaacaatgttttccaaatatagggatttattataaacttat

SEQ ID NO: 70713 - DNA, 201 bp, Homo sapiens
aggccttgataaggtagcataacagaacaggaagaattaaaactcatatttaaataattattttgttattacagcacttaaatctgtctagtagcaatacygaatctaataattgtaactttttctgagatggaaaattttatctcttgtccagtgttctgagatatttttagctcatttgtccctccacccccaactagc

SEQ ID NO: 70714 - DNA, 201 bp, Homo sapiens
tacgtatatttatgcatttctctggtagaagcttgtttggattttggcaatttttctgatatgaagtgttcttgattatcctagtataaaagatagggaamtctggcagaatcctttgctttgctaaagtagtgattttcactgaatctgaatcagtaaaaatcttgcctgtcagtaagaatatgcagactagagatatgg

SEQ ID NO: 70715 - DNA, 201 bp, Homo sapiens
tcttgattatcctagtataaaagatagggaaatctggcagaatcctttgctttgctaaagtagtgattttcactgaatctgaatcagtaaaaatcttgccygtcagtaagaatatgcagactagagatatggcttgtttttgggtagcctccttgacagattttctttctttttgagacggagtcttacgctttttgccca

SEQ ID NO: 70716 - DNA, 201 bp, Homo sapiens
aaatgaggtaagcactcagtgaggaaataatgggtattggttcacactcattgagtacttggattatgtcaaccactgtttgaagcaccttgtatgtactracacatttcttcctcacagcagctctctgaggttctctttattttgtagttgaggaaacttatgtcagattaaggaaatttcccaagatcacacaggtaa

SEQ ID NO: 70717 - DNA, 201 bp, Homo sapiens
tttttattctctgtagtatctttttgaggaacagaaagtttataattatatatttattataatatatattgatataaaggatccagttcatcagtcttttycttcgtggctggtgatttttgtagctagcttaagaaatcttggtcaaatctactgttaggtatattttctcttaccttcttgatgcttttattgtttttc

SEQ ID NO: 70718 - DNA, 201 bp, Homo sapiens
ttttatttttttaatccatctgctgttgtcattgtttaaattcaagtacttaatacatttatatttagggtaatatcttaaaatacttaggtttaatgtasttccttatttgccccacttgtatgttttttttcctgttttttttttcattcttttggaataggcaagtatttttattatttcatcctcttcccattgtct

SEQ ID NO: 70719 - DNA, 201 bp, Homo sapiens
tcaaaatgcaaaattggtttgcctttagtttaaagtgatcagaacaaaaaaaaattaagataatttaatggcttatctttttcagtagtcctccagaatayaaactttataatcatctctcagacatttaaataaagtatctagtatttattaaatatttaccacatgccaggcaaagtacaattaatttaacatatgctc

SEQ ID NO: 70720 - DNA, 201 bp, Homo sapiens
agccatagaaagagttatcatttttttggctttcaggtactaaaatcaaaatgcaaaattggtttgcctttagtttaaagtgatcagaacaaaaaaaaatkaagataatttaatggcttatctttttcagtagtcctccagaatataaactttataatcatctctcagacatttaaataaagtatctagtatttattaaat

SEQ ID NO: 70721 - DNA, 201 bp, Homo sapiens
tttaaaaaaatggtcatcaaaattttcttgactattgttggcactttgcattcccatagaagttttaaaatcaatgtgtcgggttcttccttctccccacmcagtaaactggcttgcattttgattggaattattaagtctttcaatcaatttggagagatttgggaagttaataccttgtaatccatgaacttcttagat

SEQ ID NO: 70722 - DNA, 201 bp, Homo sapiens
gttatccttctcatgtcccttgtatcatttttgtcattcatttcacttgtccgtaaactataggtatcaaatacattgttgttattttgaacaagcttttsttagatcagttaaaagtaggaaaaattaaagtttttatcttctttatttcttctttctctttctttatatagatcaaaatttctgacctatattttcttc

SEQ ID NO: 70723 - DNA, 201 bp, Homo sapiens
tttagaattttgtatattcttggtgaattgacccttttattaccccgagtgtctggtgatgcctcttacttaatgcctatttgatagtagatataggtgcrctgttatccttccatgtatatttcattctgtgtatatttgcatagtattccttttattcttttactttcaacctttgtatattcttatatttcagataca

SEQ ID NO: 70724 - DNA, 201 bp, Homo sapiens
tttttttttttttttatttgagacggagtctcactctgtcgcccaggctggagtgcagtggcgcgatctcggctcactgcaaactccgcctcccaggttcrcgccattcttctgcctcagcctcccaagtaggtgggactacaggcacccgccaccgcgcctggctaattttttgtatttttagtagagacggggtttcac

SEQ ID NO: 70725 - DNA, 201 bp, Homo sapiens
ttcttcaaatattggttctcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaa

SEQ ID NO: 70726 - DNA, 201 bp, Homo sapiens
ggtctaagatatgatctatccttcagaatgtgtcatgtgcacttgaaaagaatatgtatttgagagccccatagatggttcacatcacaggactctgtacrgacaacccccagtaccaacccagagctgggtagacttgctgggtggctagacctagaagacagacaacaatcactgcagttaggctcacaggaagacaca

SEQ ID NO: 70727 - DNA, 201 bp, Homo sapiens
tcttcaaatattggttctcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaag

SEQ ID NO: 70728 - DNA, 201 bp, Homo sapiens
ttcaaatattggttctcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaagtg

SEQ ID NO: 70729 - DNA, 201 bp, Homo sapiens
gaacacatatagaatactttcacttcagctttaacaatgcatatagaatactttaaattaaaatctttaaattagagtctcttatgggtagcataattttkaatcttgttgtttaatccattcagccactctgtcttttgactggagaatttaatgttccatttgaagtaattattgataggtaagggcttactagagcta

SEQ ID NO: 70730 - DNA, 201 bp, Homo sapiens
tgtgggatcattcttgatctttagaaaaagatgtaatatttattaaaaagtttatttttcatgagcccatgtagtatttaaattttttaaaaaatgcaatktatcttattgcaattggtatcagattgtaactctttttgggtaaagactgtattttgcatatcttaagtgcttgactgtgcttagcattctaccttataa

SEQ ID NO: 70731 - DNA, 201 bp, Homo sapiens
ctatgggtgtacagtttgaatttttgttgttgttgttttattttgttttggggtgtttggctaggaagaactaactataggatgtttgtcagggacatgtkccttgggaaatttatctcactgctctgtgcttgtttgacagctgttcttgcacttctgactttaattcaaaaagttataaagccatatgtgagcagctgt

SEQ ID NO: 70732 - DNA, 201 bp, Homo sapiens
gagttgagctggggttaccactctgcagagctatgccaaggagaccgcgaagtggtccaccagcccttctcagcaatttgccccgctccagttaagcgggraaaacctcctcccccaccgccactcacttattttgtttggtagtttaattcaacagacgttggtttagggatggggaagccgggaggagatgcaaaaacg

SEQ ID NO: 70733 - DNA, 201 bp, Homo sapiens
tattctctattccatttttcattttgctcattgtattttccagctccacaatttttgtttgattttgtttatgatttcagtatctctgttaaatttccctratacatttctgaatcgattccgtctgttttcttgaagttcattgagctctcttaaaacaggtattttgaattccttgtctgaaaggtcacatatctctat

SEQ ID NO: 70734 - DNA, 201 bp, Homo sapiens
tttttttcagtgtataatacagtattaccaactgtaggtgtaatgtcatacagtagatgtgtagaacttaactgaagcattgcttcactgaagcattatgsctgttgattagtaactcctcatttccccctctccccagcacctggtaaccatctttctactctttgattctatgaatttatctattttagatacctcagt

SEQ ID NO: 70735 - DNA, 201 bp, Homo sapiens
aatattggttctcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaagtgcaga

SEQ ID NO: 70736 - DNA, 201 bp, Homo sapiens
tttttttgtaaggatataatgccaaaaattttgaaaaaaagaaaacaggcactgtggctcacacctgtaatccctgcactttgggaggctgaggtgggagratctcttgaaccaaggagttcaagaccagcctgggcaacatggcaaaaccccatctgtccaaaaaatacaaaaattagctgggtatagtggcacatgctt

SEQ ID NO: 70737 - DNA, 201 bp, Homo sapiens
ggttcaggtgatcatcccacctcagcttcccaagtagctggaaccacaggcgtgcaccacacctggctaatttattttttttaagagacagggtctccctrtgttgcccaggctggtcttgaacttctggaatcaattgatcctcccactgcagcctcccaaagtgctgggattacaggtgtgagacaccacgcccagctt

SEQ ID NO: 70738 - DNA, 201 bp, Homo sapiens
tgaggcaggagaatcgcttgagcccgggaggtgcaggttgcagtgagccaagattgtgccactgcactccagcctaaacgacagagctacactccgtctcaaaaaaaaaaaaagagcaaccagctggagtcaccgagcatgtagctgcccagagcctcctccctacatcatgtgtgtagcttgttccatattgtgaagggt

SEQ ID NO: 70739 - DNA, 201 bp, Homo sapiens
cctgagtagctgggactacaggcacgtgccaccacacctggctaatttttgtatttttagtagagacggggtttcgccatgttggccaggctggtctccarctcctgacctcgtggtctgcccgcctcaggctcccaaagtgctgggattacaggcatgagccaccacacccggccgatatactcagagttctaatgtttt

SEQ ID NO: 70740 - DNA, 201 bp, Homo sapiens
ataattttatggccagcagatgacttttttctttcctcttattttgtaacttttaattttgacatatgatacgtacacataaagttgaaaaaaatagtacrtagtaccccataagccatagcccagcacccccaatggtgatatcttatatctgtagaacaatatcaaaaccaggaaattgtcattagtacaatattatta

SEQ ID NO: 70741 - DNA, 201 bp, Homo sapiens
atctcagctcactgcaacctccgctcccaggttcaagtgattctcctgccccagcctcctgagtagctgggattacaggtgcgctccaccacgcccagctratttttgtatttatttatttatttgagacggaatcttgctctgtcacccaggctagagtccaatggcgcagtcttggctcactgcaacctccgcctcctg

SEQ ID NO: 70742 - DNA, 201 bp, Homo sapiens
tgggattacaggcacccaccaccgtgttggccaggctggtcttgaactcctgacctcaggtgatgcacctgcctcggcctcctaaagtgctgggattatargcgtgagccactgcgcccagccagttgtaccttttttattcctgagtagttacactgctttatggatgtaccagagtttaaccatttatctgtctaagga

SEQ ID NO: 70743 - DNA, 201 bp, Homo sapiens
tgatgtcctccagggtcatccatgttgtcaaaacataacagactttccttctttttttaggctgaatagtattccattttgttgcacattttctttatccrttcatttgttgatggacgcttaggttgatttcatatcttggctattgtgaatagtgctacaataaacatgggagtacagatagctctttgatatactgat

SEQ ID NO: 70744 - DNA, 201 bp, Homo sapiens
tcagggaagaggaacatacagagtaaaagacataaaagccttaaagttgcttcagtttcttcatttcatcttgtaaattacacaggagtccttcagataamactcactggttatatgacaaattaagcaattagattactgcacacctaataatagtagcaaataatgcactttcaatctgctaatatgttaagcactttt

SEQ ID NO: 70745 - DNA, 201 bp, Homo sapiens
gagaggaggcaagcgtctgacacaggtagaaagagaaagccagaagtctcagcaaactgcttataccccttctcctgcctgttttgttgtagctgctggcrgccattggatggcacctgcattgaagggtattgctttcagtccatcaactcaaatgtcagtctcctctgacaacaccctcacagacacacccagtaacaa

SEQ ID NO: 70746 - DNA, 201 bp, Homo sapiens
ttatttaataatatcatataatgtttttcatttgaaaaggaaaaagatgttatcaagttcctgcctatttaactttagagagaacttagtttggtttattmagttagacatgtagtcagtgtagcactttaatcttttaactttaccactttaattattttacaaatacaagttcttgatgatcttttatgtttttctagg

SEQ ID NO: 70747 - DNA, 201 bp, Homo sapiens
atgatactttgtttgtttgtttgatggttggaaatctgaagaaagttcacttagttaaaatggtgatgtaaagtatatgagtacagtcctaaaatttactmaatgtacatactcaaatttactcaactttaggtcttcagattttaaaaactagatgaataatctatcctttaaaaattcaccattaattcttcaagtata

SEQ ID NO: 70748 - DNA, 201 bp, Homo sapiens
atactttgtttgtttgtttgatggttggaaatctgaagaaagttcacttagttaaaatggtgatgtaaagtatatgagtacagtcctaaaatttactaaawgtacatactcaaatttactcaactttaggtcttcagattttaaaaactagatgaataatctatcctttaaaaattcaccattaattcttcaagtatacca

SEQ ID NO: 70749 - DNA, 201 bp, Homo sapiens
tggttggaaatctgaagaaagttcacttagttaaaatggtgatgtaaagtatatgagtacagtcctaaaatttactaaatgtacatactcaaatttactcmactttaggtcttcagattttaaaaactagatgaataatctatcctttaaaaattcaccattaattcttcaagtataccaactgctgcatttctaatacca

SEQ ID NO: 70750 - DNA, 201 bp, Homo sapiens
agtacagtcctaaaatttactaaatgtacatactcaaatttactcaactttaggtcttcagattttaaaaactagatgaataatctatcctttaaaaattmaccattaattcttcaagtataccaactgctgcatttctaataccaaaacaaccttatcaagtgataatttaattacaccttttaaatgaaattttaaaac

SEQ ID NO: 70751 - DNA, 201 bp, Homo sapiens
gtacagtcctaaaatttactaaatgtacatactcaaatttactcaactttaggtcttcagattttaaaaactagatgaataatctatcctttaaaaattcwccattaattcttcaagtataccaactgctgcatttctaataccaaaacaaccttatcaagtgataatttaattacaccttttaaatgaaattttaaaaca

SEQ ID NO: 70752 - DNA, 201 bp, Homo sapiens
caactttaggtcttcagattttaaaaactagatgaataatctatcctttaaaaattcaccattaattcttcaagtataccaactgctgcatttctaatacmaaaacaaccttatcaagtgataatttaattacaccttttaaatgaaattttaaaacatgatttattcatgaaaaacaagtagtttcatccacccttcttt

SEQ ID NO: 70753 - DNA, 201 bp, Homo sapiens
actttaggtcttcagattttaaaaactagatgaataatctatcctttaaaaattcaccattaattcttcaagtataccaactgctgcatttctaataccawaacaaccttatcaagtgataatttaattacaccttttaaatgaaattttaaaacatgatttattcatgaaaaacaagtagtttcatccacccttcttttt

SEQ ID NO: 70754 - DNA, 201 bp, Homo sapiens
cgaaatgttttgtataacatttaaaaaaaaacttattcatattaccagattctctcataggggatatgttctttctttttttttttttttttttttttttkggagacagagtttcgctcttgttgcccaggctggagtgcaatggcacaatctcggctcaccgcaacctctgcctcccaggttcaagcaattctcctgcct

SEQ ID NO: 70755 - DNA, 201 bp, Homo sapiens
agggaaatgaaagaaagtgagaataatgcgaaatgttttgtataacatttaaaaaaaaacttattcatattaccagattctctcataggggatatgttctytcttttttttttttttttttttttttttggagacagagtttcgctcttgttgcccaggctggagtgcaatggcacaatctcggctcaccgcaacctctgc

SEQ ID NO: 70756 - DNA, 201 bp, Homo sapiens
aaaaactagatgaataatctatcctttaaaaattcaccattaattcttcaagtataccaactgctgcatttctaataccaaaacaaccttatcaagtgatwatttaattacaccttttaaatgaaattttaaaacatgatttattcatgaaaaacaagtagtttcatccacccttctttttctacaactctttgcatatct

SEQ ID NO: 70757 - DNA, 201 bp, Homo sapiens
ttcttcaagtataccaactgctgcatttctaataccaaaacaaccttatcaagtgataatttaattacaccttttaaatgaaattttaaaacatgatttawtcatgaaaaacaagtagtttcatccacccttctttttctacaactctttgcatatctgtggcctgctatttattacagcctttctcataatttttagtgt

SEQ ID NO: 70758 - DNA, 201 bp, Homo sapiens
aaatgaaattttaaaacatgatttattcatgaaaaacaagtagtttcatccacccttctttttctacaactctttgcatatctgtggcctgctatttattwcagcctttctcataatttttagtgtaggcttaacaagcatatagttttaaatctttctttaggagactttctggcttttctcattgctgaattcgacaca

SEQ ID NO: 70759 - DNA, 201 bp, Homo sapiens
tcctgttgattggaatagtttcagaaggaatggtaccagctcctccttgtacctctggtagaatttggctgtgaatccatctggtcctggactttttttcrttggtaagctattaattattgcctcaatttcagagcctgttattggtctattcagagattcaacttcttcctgttttagtcttgggagggtgtatgtgtc

SEQ ID NO: 70760 - DNA, 201 bp, Homo sapiens
accctatttcttaagagatttttaaatttatttcgtttttatgggatcataaattcctttctattcagtggtttatgatttctcagtatcactatttgtaytgatgtctcagttgcaccagtttggctagcaggccctcttttaagctgtcttttgtgtgctcttggcattaattaatcgcagatggaaagtcagttgtaa

SEQ ID NO: 70761 - DNA, 201 bp, Homo sapiens
aagaaaaccttgaccctgtttcttcaaatgaatataagctctaataaatagacatttgttcaatctctgaactatttaactgtaatgagttgaaaaaaaatttttttttttttgagacagagtttcgctcttgttgcccaggctggagtgcagtggtgagatcttggctcactgcaacctccgcctttctgtttcaagcga

SEQ ID NO: 70762 - DNA, 201 bp, Homo sapiens
ggagaccgaggtgagcagatcacctgaagtcaggagttcgagaccagcctggccaacatggtgaaaccccgtctctactaaaaatacaaaaaaattagacrggcatagtggcacgtgcttgtaatcccagctactcaggaggctgaggcaggagaatcatttgaacccgggaggcggaggttgcagtgagccaaaattgcg

SEQ ID NO: 70763 - DNA, 201 bp, Homo sapiens
tttgtttagtttttactaaattggctctacaaatcttttttctctagcttacttgtcttctgtaccacctagcttagttcttgatgttctctaatagttcrtgtgttccaggtttttcctgtctttctaataacatgtaagtatcttgaggtcagagagattgatacagtttggctgtgtccccaccaaaatctcatctca

SEQ ID NO: 70764 - DNA, 201 bp, Homo sapiens
tgtaatcccagctactcaggaggctgaggcaggagaatcatttgaacccgggaggcggaggttgcagtgagccaaaattgcgccactgcattccagcctgrgcaacaagaacaaaaactccatctcaaaaaaaaaaagtaaaattatatttgtagctcatactatatttcttttgaacaacactgatctaaagtgctatgt

SEQ ID NO: 70765 - DNA, 201 bp, Homo sapiens
tttaatttaggtatatctcctaatgctatccctccaccctccccccatcccacaacaggccccggtgtgtgatgttccccttcctgtgtccatgtgttctyattgttcatttcccacctgtgagtgagaacatgcggtgtttggttttttgtccttgcgatagtttgctgagaatgatggtttccagcttcatccatgtcc

SEQ ID NO: 70766 - DNA, 201 bp, Homo sapiens
gtgaatatgtgccacattttcttaatccagtctatcattgttggacctttgggttggttccaggtctttgctattgtgaatagtgccgcaataaacatacstgtgcatgtgtctttatagcagcatgatttataatcatttgggtatatacccagtaatgggatggctgggtcaaatggtatttctagttctagatccctg

SEQ ID NO: 70767 - DNA, 201 bp, Homo sapiens
atgtgccacattttcttaatccagtctatcattgttggacctttgggttggttccaggtctttgctattgtgaatagtgccgcaataaacatacgtgtgcmtgtgtctttatagcagcatgatttataatcatttgggtatatacccagtaatgggatggctgggtcaaatggtatttctagttctagatccctgaggaat

SEQ ID NO: 70768 - DNA, 201 bp, Homo sapiens
aagtttcaacagtgggcttaaaatatccagtaatcatgctataaacaaagtgttgtcttgcaggcttggttgttccatttatagagacaggaagagtagayttagcatattcttaagagccctaggattttcagaagggtaaatgagcactggcttcaacttatatttaccaactgcattagcccccaacaagagagtcag

SEQ ID NO: 70769 - DNA, 201 bp, Homo sapiens
gtgtctttatagcagcatgatttataatcatttgggtatatacccagtaatgggatggctgggtcaaatggtatttctagttctagatccctgaggaatcrccacactgacttccacaatggttgaactagtttacagtcccaccaacagtgtaaaagtgctcctatttctccacatcctctccagcacctgttgtttcct

SEQ ID NO: 70770 - DNA, 201 bp, Homo sapiens
ttgtttgagtttgacacaggtgacttcattttgattctgataccttttacaatacccagtagtgggattgctgaatcatatggtcattctgtttttacttytttgggtaacctagacattgttttcttaaatggctatactaatttacaatatcactttatattgttttcttaaatggctttactaatttacagtgtcact

SEQ ID NO: 70771 - DNA, 201 bp, Homo sapiens
atgagtagattgcaaaaattttctcccattctgtaggttgcctgttcacgctgatggtagtttcttttgctgtgcagaagttctttagtttattagatccyatttgtcaattttggcttttgttgccattgcttttggtgttttagacatgaagttcttgcacatgcctatgtcctgaatggtgttgcctaggttttcctc

SEQ ID NO: 70772 - DNA, 201 bp, Homo sapiens
gtagttttttccaattctgtgaagaaagtcattggtagtttgatggggatggcattgaatctgtaaattaccttgggcagtgtggccattttcacgatatygattcttcctacccatgagcatggaatgttcttccatttgttcgtatcctcttttatttcattgagcagtggtttgtagttctccttgaagaggtccttc

SEQ ID NO: 70773 - DNA, 201 bp, Homo sapiens
tgattcttcctacccatgagcatggaatgttcttccatttgttcgtatcctcttttatttcattgagcagtggtttgtagttctccttgaagaggtccttyacatcctttgtaagttggattcctaggtattttattctctttgaagaaattgtgaatgggagttcactcatgatttggttctctgtttgtctgttattgg

SEQ ID NO: 70774 - DNA, 201 bp, Homo sapiens
ttcttaaatggagtggtctctgccgcctcaccacttacatactctccctagcctattcctctttgacttccaccccatcattccatggaaactgttcctgrtgtggtctccgagcatctccgtgttgataaaccttacgtgaccacagcaacttttggtattgttgaccattccctccttctcgaaacacttaacttctta

SEQ ID NO: 70775 - DNA, 201 bp, Homo sapiens
tttatttatatgctagatgggaaaaaaaagaactttcttccaaaaagcataccactgtcaatgagtatgacatgcataaaataagtgtaatataaataatyctattttcttctcactctatgttatgtgctaatggtatacttattggttactcacaaggacctatcttcatctgccccttagctagctacagattgtcaa

SEQ ID NO: 70776 - DNA, 201 bp, Homo sapiens
tgtcagctgcttgtgcatcagctgcttgtggatttggtttagagctttagagaggactggcattgactagctttcactgtcattgtggcccacatgacttygaaaacactatcattgtgaattttagttatatttgatggtagaattattcttttaaaaaaatttctccattctgtctactgaggctagttcaatgtaatc

SEQ ID NO: 70777 - DNA, 201 bp, Homo sapiens
tgatgattagtgatgttgagcacttaaaaaatatacctgttggctatttgtatgtcttctgagaaatgtctattcaggtcttttgcccattttttaatcargtcatttgttgctgttgagttccttataaattttggtattttagattttaacaccttatcaggtttggtttacaaacatattctctcattttataggttg

SEQ ID NO: 70778 - DNA, 201 bp, Homo sapiens
gatcacaaggtcaggagatcgagaccatcctggctaatatggtgaaaccccatctctactaaaaatacaaaaaactagccaggcgtggtggcacgcgcccrtagtcccagctactcaggaggcttaggcagaagaatcgcttgaacccaggaggcggaggttgcagggagccgagattacgccactgcactccagcctggt

SEQ ID NO: 70779 - DNA, 201 bp, Homo sapiens
aaaaaacatggtatatatacatagggtttggtactatctgcggttacaggtgcccactgggggtcttggaacacatcctgtgcagatagggtggaaccacygtaatcatttaatcaaataactcattccacatgaataaactatttgcttagctgtaacaagcaagaaattgggtgaacgtctaaaaagttaattctgctc

SEQ ID NO: 70780 - DNA, 201 bp, Homo sapiens
ggctgaggcaagagaatctcttgaacccaggaggtggaggttgcagtcagttgagatcgtgccattgcactccagcatgggggacaagagcgagactttgwctcgaaaaaataaaaataaaaataattagttgggcatggtagcacatgcctgtagtcccacctactaaggaagctgaggcaggaggatcactgagctggg

SEQ ID NO: 70781 - DNA, 201 bp, Homo sapiens
gcagtggcgtgatctaggctcactgcaagctctgcctcctgggtttacttacgccattctcccgcctcagcctcctgagtagctgggactacaggtgcccrccaccatgcctggctaatttttttttttttttttttttattagagacagggtttcaccgtgttagccaggatgatctcgatctcctgacctcgtgatccg

SEQ ID NO: 70782 - DNA, 201 bp, Homo sapiens
caaagggacaaatcttttgcccattaaataatgactctggctgggtgtggtggctcatgcctgtaataccatcactttgggaggccaaggcaggaggattrcttgaccccaggagtttgagaccagcctgggcaacatagtgggaccctgtctgtttaaaaataaaaataattggctgggtgcggtggctcacgcctgtaa

SEQ ID NO: 70783 - DNA, 201 bp, Homo sapiens
tgggtttacttacgccattctcccgcctcagcctcctgagtagctgggactacaggtgcccaccaccatgcctggctaatttttttttttttttttttttwttagagacagggtttcaccgtgttagccaggatgatctcgatctcctgacctcgtgatccgcccgcctcggcctcccaaagtgctgggattacaggcatg

SEQ ID NO: 70784 - DNA, 201 bp, Homo sapiens
agaaatacctgattatcaaaataatgggctatacagttttgtggtggcatacattccttgtttgtttgtttagagataggatcttgttgtgtcacccaggstggaatgcagtggcacagtcgtagctcactgcaccttcaaactcctggagctcaagtgatcctcctgactcagcctcctgagtagctaggacaacaggtg

SEQ ID NO: 70785 - DNA, 201 bp, Homo sapiens
tctaaatatccatcagtaatagatatatgtgatagtcatacaatggaatactgtggcaataaaaaataattagagctacatatgaaatagggatgaaacayggatgaacaaagaatgttttagaggaatatgatatttaaaatttgaagcatgaaaaatatgtgtttatgggggcacatatagtggaagaataaatgaata

SEQ ID NO: 70786 - DNA, 201 bp, Homo sapiens
cccacacacagcaaaacccaaggatatgaaaagaaaaaaaaatagaaacatagaattcatctatgcttaaaatagggaacaaatataacacgtattacagrtttcaattttacaccaacttaaaaaggatctaggaagttttacacgtactgtgcttgacaacacattcagtgtgacaggaaataccttgtttacttggtt

SEQ ID NO: 70787 - DNA, 201 bp, Homo sapiens
aaacatagaattcatctatgcttaaaatagggaacaaatataacacgtattacaggtttcaattttacaccaacttaaaaaggatctaggaagttttacaygtactgtgcttgacaacacattcagtgtgacaggaaataccttgtttacttggtttcaatacaccatcaattgtaagcctcactatttaaaaacatattt

SEQ ID NO: 70788 - DNA, 201 bp, Homo sapiens
ttgggatctgctgtgtgaaggagactggccccgacttatttgctcatatcagcatgcatcactcagctggtcattgcaaaagtgcttgactgtaacagggsggtctggtactgagactgggctcccttggaatctgctgtgggatggaggttggtgttcttgtcacattggctcagatgggcatgtgtctcccagcaggtc

SEQ ID NO: 70789 - DNA, 201 bp, Homo sapiens
gttttatattctgcttttttcacttaaaattatgtagtaaacattttacattagaatttgttggcaaaactttttaaatgactacaccaaagacttttatrtggataaactgtaattggttgatccttctttagtctcaaatatttaggcttttgtctatttttccataccattgttataaagatatttgtgtgtaaatct

SEQ ID NO: 70790 - DNA, 201 bp, Homo sapiens
agtaaaattaaatagaatataaattagtattaatagttttgctccaaaatctcaggcagtaaagaggattatctatgatgtcatttcaaacaaatatatayacacacacacacacacacatcagaactgttcataagtatgtttttttcctctacaaatgtatagcggtcctttaatatgttctacaagtggttcatgttg

SEQ ID NO: 70791 - DNA, 201 bp, Homo sapiens
attcagtatgatattggctgtgggtttgtcatagatagctcttactattttgagatacgtcccatcaatacctaatttattgagagtttttagcatgaagsgttgttgaattttgtcaaaggccttttctgcatctattgagataatcgtggtttttgtctttggttctgtttatatgctggattacatttactgatttgt

SEQ ID NO: 70792 - DNA, 201 bp, Homo sapiens
ggtttgccagtattttattgaagatttttgcatcgatgttcatcagggatattagtctaaaattctctttttttgttgtgtctctgccagtctttggtatyaggatgatgctggcctcataaaatgagttaggaaggattccctctcttcctgttgattggaatagtttcagaaggaatggtaccagctcctccttgtacc

SEQ ID NO: 70793 - DNA, 201 bp, Homo sapiens
atccatctggtcctggactttttttcgttggtaagctattaattattgcctcaatttcagagcctgttattggtctattcagagattcaacttcttcctgktttagtcttgggagggtgtatgtgtcgaggaatgtacccatttcttctagattttccagtttatttgcatagaggtgtttataatattctctgatggtag

SEQ ID NO: 70794 - DNA, 201 bp, Homo sapiens
agaattttagaccaatatccctgatgaacatcgatgcgagaatcctcaataaaatactggcaaaccgaatccagcagcacatccaaaagcttatccactaygatcaagtcagcttcatccctgggatgcaaggctgtttcaacatacgcaaatcaataaatgtaatccatcacataaacagaaccaatgacaaaaaccaca

SEQ ID NO: 70795 - DNA, 201 bp, Homo sapiens
gagagctttacttccaactatgtggtcaattttggaataggtatggtgtggtgctgaaaagaatgtatattcggttgatttgaggtggagagttctgtagwtgtctattaggtccacttggttaagagctgagttcaattcctgggtatccttgttaactttctgtctcgttgatctgtctaatgttgacagtggggtgtt

SEQ ID NO: 70796 - DNA, 201 bp, Homo sapiens
tgcaacccctgcctttttttgttttccatttgcttggtagatcttcctccatctctttgttttgagcctatgtgtgtctctgtacatgagattttgagatkagtttcctgaatacagcacactgatgggtcttgactctttatccagtttgccagtccgtgtattttaattggagcatttagcccatttacatttaaggtt

SEQ ID NO: 70797 - DNA, 201 bp, Homo sapiens
gattttgagatgagtttcctgaatacagcacactgatgggtcttgactctttatccagtttgccagtccgtgtattttaattggagcatttagcccatttmcatttaaggttaatattgttatgtgtgaatttgatcctgtcattatgatgttagctggttattttgctcgttagttgatgcagtttcttcctagccttga

SEQ ID NO: 70798 - DNA, 201 bp, Homo sapiens
tgtcattatgatgttagctggttattttgctcgttagttgatgcagtttcttcctagccttgatggtctttacaatttggcatgtttttgcagtggctggkaccggttgttcctttccatgtttagtcccagcaccatttattaaagaggaaaatcttaaaagcaactggagaaaaaaaaaagataagatacagattaata

SEQ ID NO: 70799 - DNA, 201 bp, Homo sapiens
acatccaaaagcttatccactatgatcaagtcagcttcatccctgggatgcaaggctgtttcaacatacgcaaatcaataaatgtaatccatcacataaasagaaccaatgacaaaaaccacatgattatctcaatagatgcagaaaaggccttcgaaaaaattcaacagccgttcatgctaaaaactctcaataaactag

SEQ ID NO: 70800 - DNA, 201 bp, Homo sapiens
tttccagaaagttttccgtttactttgcccatattcattagaggaatcactatctatgactgctgtagccctacaagatgtatttcttaataagacttggragtctaaattattctttaattcatgagttgcagaatggatgttgtgttaacaaggcttgaaaacaacactaatctacatctccatcagagttgttggctg

SEQ ID NO: 70801 - DNA, 201 bp, Homo sapiens
ccttgcttattacagtgtctcaacgtattaagtgttcagtaaattttcattgaatggaatagaaggaaaagaggtagtatggaaatagactcaactgattstaattatgcacccaaaacaagaaagcaaaggttacgagagcaggaggagggtgcgcatagcagagggccttcttatcagccaggatatttaacctcccat

SEQ ID NO: 70802 - DNA, 201 bp, Homo sapiens
gagtagctcctttctgtaggcaggtcatctcgttgagtgttgagctctcagcagagaggaggcctggagtgggtggctcctctctgcaggcaggttgtccygacgaatgttcagctcttagcagagagggtagctcctctctgctgctggtcatcctgttgtctgcagctctcagcagagaggaggccctgaagagggtag

SEQ ID NO: 70803 - DNA, 201 bp, Homo sapiens
tggtttgatcttttatccagatcactcgaagtttctccatatcatcagtaagactgttttgctctcttagtattcatgtgttcactagagtagcacaattyccttgaagagtttttccttagcattcacaatttgcttactgattggcagaggaggcctagcttttggcctttctcagttttcaatgcacctgcttcacaa

SEQ ID NO: 70804 - DNA, 201 bp, Homo sapiens
aaattgtgaaagatatgtagaagtcttaaataattttggtttcaggattattttctattgttgtgttagactcatggaggtagtaaattggcattaatttyccttacagtttttctggaagaggaaatatgcttaatgagctaaataagacataacattttgttttcttacattgttgcaaattgaagttgggttttgttg

SEQ ID NO: 70805 - DNA, 201 bp, Homo sapiens
tgatcttttatccagatcactcgaagtttctccatatcatcagtaagactgttttgctctcttagtattcatgtgttcactagagtagcacaatttccttsaagagtttttccttagcattcacaatttgcttactgattggcagaggaggcctagcttttggcctttctcagttttcaatgcacctgcttcacaaagctt

SEQ ID NO: 70806 - DNA, 201 bp, Homo sapiens
acacgtactgtgcttgacaacacattcagtgtgacaggaaataccttgtttacttggtttcaatacaccatcaattgtaagcctcactatttaaaaacatmtttttctagaaaaaagataaagtactataatattgatttgcatgttaatggtattacatcctgattccagaagcattaaaatgtgaacaacatatataat

SEQ ID NO: 70807 - DNA, 201 bp, Homo sapiens
agcatatttccacaattacctgtattggatctagaataagtatcttgtcatgctgggtcatctgtaatgactgaagggataaaccattcaaatacattagrtaaaacttcttaggaaatgtaactgtgtacccatctctttgcactgaagcaggtaattacgggaatggcttgactcaggaaactcagggcttctgctgca

SEQ ID NO: 70808 - DNA, 201 bp, Homo sapiens
agcttttatttacatttttattgcttatgattcagtattaatgaaactatttcataactcttcaatatctactccccaatcttgtatcttacttttagcayatttctctagagaattgaagttttgaaattctttgtttcatctaatttattcttccagagttttcaacattttcatctatacgaaggtacattctagcta

SEQ ID NO: 70809 - DNA, 201 bp, Homo sapiens
agaggctggttcggaatttggggctgcaggtccaagcctggctcttgtgtaggcctagagcctaagtctgcagggatccatcctgggctgtgggggctgaycttgggctgggatagggcaagtactggaatctgtggggagagctggatgcttatgtcatccttcttccatgtggacagtatttctctccacattgtgctg

SEQ ID NO: 70810 - DNA, 201 bp, Homo sapiens
aaattccaattttcttatccagagataacagctgttaacattttgttatagttcctgtaagatttgtgtgtgtgtgtgtgtgtgtgtgtgtgtgtgtgtgtatgtgtgtgtgtgtgtatgtatattagagatggagtctcactctgtcgcctatgctggagtgcagcagcacgatctcagcttactgcagccttcacctac

SEQ ID NO: 70811 - DNA, 201 bp, Homo sapiens
gaaattccaattttcttatccagagataacagctgttaacattttgttatagttcctgtaagatttgtgtgtgtgtgtgtgtgtgtgtgtgtgtgtgtgtrtatgtgtgtgtgtgtgtatgtatattagagatggagtctcactctgtcgcctatgctggagtgcagcagcacgatctcagcttactgcagccttcaccta

SEQ ID NO: 70812 - DNA, 201 bp, Homo sapiens
tgaaattccaattttcttatccagagataacagctgttaacattttgttatagttcctgtaagatttgtgtgtgtgtgtgtgtgtgtgtgtgtgtgtgtgtgtatgtgtgtgtgtgtgtatgtatattagagatggagtctcactctgtcgcctatgctggagtgcagcagcacgatctcagcttactgcagccttcacct

SEQ ID NO: 70813 - DNA, 201 bp, Homo sapiens
gtgaaattccaattttcttatccagagataacagctgttaacattttgttatagttcctgtaagatttgtgtgtgtgtgtgtgtgtgtgtgtgtgtgtgtgtgtatgtgtgtgtgtgtgtatgtatattagagatggagtctcactctgtcgcctatgctggagtgcagcagcacgatctcagcttactgcagccttcacc

SEQ ID NO: 70814 - DNA, 201 bp, Homo sapiens
atgtgcacatattatttttgtgcattaataatagctagtcagtgtttggaactgagacttttgtctagaattgtatagaggtaaagagcatggatttacgyaggcttagtagaagaactaattttaaaataaatggtcacatcataagacctaagtcaggttatcaataaatatttataagtgtctgtaacttgcaaggcc

SEQ ID NO: 70815 - DNA, 201 bp, Homo sapiens
agttttcaatgcacctgcttcacaaagcttcatcacttctagctttttatgtaaagtgagagatgtgggactcttcctttcacttaaatacttaaaggccrttgtagggttattcattggcctaatttcattattattgtgactcagggcataggaaggcccaaggagaggaagaaaagcagggaacaaccagttggtgga

SEQ ID NO: 70816 - DNA, 201 bp, Homo sapiens
gctttttatgtaaagtgagagatgtgggactcttcctttcacttaaatacttaaaggccattgtagggttattcattggcctaatttcattattattgtgwctcagggcataggaaggcccaaggagaggaagaaaagcagggaacaaccagttggtggaacaatcagaatacacacaacatttgtcagttaagtttacca

SEQ ID NO: 70817 - DNA, 201 bp, Homo sapiens
tcttcctttcacttaaatacttaaaggccattgtagggttattcattggcctaatttcattattattgtgactcagggcataggaaggcccaaggagaggragaaaagcagggaacaaccagttggtggaacaatcagaatacacacaacatttgtcagttaagtttaccatcttatatgggcatggtttgtggtgaccca

SEQ ID NO: 70818 - DNA, 201 bp, Homo sapiens
agtgacgccacttgaggccaggagttcaagaccagcctggccaacatggtgaaactgtgtctctactaaaagtacaaaaattagccaggtgtggtggtgcmtgcctgtaatcacaactacttgggaggttgaggcatgagaatcgcttgaacctaggaggtggagtttgcagtgagctgagatcatgccactgcactccag

SEQ ID NO: 70819 - DNA, 201 bp, Homo sapiens
ctaaaagtacaaaaattagccaggtgtggtggtgcatgcctgtaatcacaactacttgggaggttgaggcatgagaatcgcttgaacctaggaggtggagkttgcagtgagctgagatcatgccactgcactccagcctgggcgacagagtgaaaccttgtctcaaaaaaaaaaaaaaaaaaaaaaaggagttccattcca

SEQ ID NO: 70820 - DNA, 201 bp, Homo sapiens
cacggagagtgaactgaaatagggtggggcattgcctcacccaggaactggaaggggttgtgggatttccctctcctagccaagggaagccatgacagacrgtacctggaatatcgctacactcctgcccaaatactgcgcttttcccatggtcttagcaactggcagacaaggagattctctcccgtgcctggcttggca

SEQ ID NO: 70821 - DNA, 201 bp, Homo sapiens
ttgtgggatttccctctcctagccaagggaagccatgacagacggtacctggaatatcgctacactcctgcccaaatactgcgcttttcccatggtcttarcaactggcagacaaggagattctctcccgtgcctggcttggcagatccaacacccacggagccttgcttgctgctagtgcagcagtttgagatcgacctg

SEQ ID NO: 70822 - DNA, 201 bp, Homo sapiens
gcatccgccattgctgaagcttaagtaggtaaacaaagtggccaggaagctcaaactgggtggagcccactgcagctcaggaaggcctactgcctccatgwactgtacctctgtagacagggcatagctgaacaaaaggcagcagtaacttctgcagacttaaacgtccctgtgtgacagctctgaagacagcagtggttc

SEQ ID NO: 70823 - DNA, 201 bp, Homo sapiens
cttcaaatattggttctcttctttcttcttttggtgttgctattacacatgctacacctatttgcttcatagttcttagatattttgttctgtgtggttttattattttttttttaaatctagtccagtattttgttttcataaagttttccttatccttgcttttcagttttggaagtttgtatatacatatccgtaagt

SEQ ID NO: 70824 - DNA, 201 bp, Homo sapiens
ctcaagtgggtccctgacccccatgtagcctaactgggagacatctcccagtaggggctgacagacacctcatacaggcgggtttccctctgcgatgaagyttccagaggaaggatcaggcagtaatatttgctgctcggcagcctccgctggtgatacccaggcaaacagggtctggagtggacctccagcaaactccaa

SEQ ID NO: 70825 - DNA, 201 bp, Homo sapiens
cccatctgtaggtcaccaacatcaaagaccaaaggtagataaaaccacaaagatggggagaaaccagaacagaaaagctgaaaattctaaaaaccagagckcctcttctcctccaaaggatcacagctccttgccagcaacagaacaaagctggatggagaatgactttgacgagctgacagaagtgggattcagaaggtc

SEQ ID NO: 70826 - DNA, 201 bp, Homo sapiens
ttctaatctaggcattcaaagccataaacattcattaagcactgctttagcggcatcacacatatttgatatagtgtattttcatttccatttagttcagyatattttagaatttcccttggtacatctttaaattatcacagtctacctttaagtgttattataccatgtgtacagtataagaaccttagaacaatatat

SEQ ID NO: 70827 - DNA, 201 bp, Homo sapiens
gtgattgtgtttttaattctgtttatgtggtgtatcacatttattgacttgcatatgttaaaccatccctgcatccctggtatgaaacccacttgatcatkgtggattatctttttagtatgttgttggatttggttagctagtagttttttaagtaaggattttagcatcagtgttcatcaaggatattggtctgtagtt

SEQ ID NO: 70828 - DNA, 201 bp, Homo sapiens
acggggtttcaccatgttggtcaggctggtctcaaactcctgacctcatgatccgcccacctcagcctcccaaagtgctaggattacaggtgtgagcaccrcgcccagcctactttaatcttctttcttttttttatagtagtctaggcaaagatttgtcaattttgcttatcttttgaaaaaacaactaatgttgatctt

SEQ ID NO: 70829 - DNA, 201 bp, Homo sapiens
tatttactttaatcttcttcttttttttttttttttttttttgagacggagtctcgctctgttacccaggctggagtgcaatggcaccatcttggctcackgcaacctccgcctcctgggttcaagtgattctcctgcctcaacctcctgagtagctgggattacaggcacccgccacaacgcccagctaatttttgtatt

SEQ ID NO: 70830 - DNA, 201 bp, Homo sapiens
taggtttatttaaacatgttctttcatatgtataagactgaactctggagacttaggattttatcttttattattctatagggcctcctaatctctaaagygctatgctcattcttgtctctatttatatgctgttccccctgcttggaatagtcggctgcctctttggccccaattcccattttatcaggttaacatcga

SEQ ID NO: 70831 - DNA, 201 bp, Homo sapiens
atctgaaggcctgtggcaggggtctccaggatctctcacgtttttatagcttttgcaaatcagtaaacttacctattgttcttttctcctttctaacaatscaccatactttatatcctcacatacctacaaacgaagtaatagagttggatgtaggtttatttaaacatgttctttcatatgtataagactgaactctgg

SEQ ID NO: 70832 - DNA, 201 bp, Homo sapiens
tttgttgtgtaaaataggatacgtttatatagagtccagaatcaatacttcagagtgggaaagaatctgaaggcctgtggcaggggtctccaggatctctyacgtttttatagcttttgcaaatcagtaaacttacctattgttcttttctcctttctaacaatgcaccatactttatatcctcacatacctacaaacgaa

SEQ ID NO: 70833 - DNA, 201 bp, Homo sapiens
ttgcttgaacccaggaggaggaagttgcagtcagccaaaatcatggcactgcacttcagcctgggcaacagagcaagactgtctcaaaaaaaaaaaaaaaagtaattgcaaaaactgcaactagaatagaataatcgactactctttcagagataatttagtacattcccttatttcacagatgaggagagactatgtgat

SEQ ID NO: 70834 - DNA, 201 bp, Homo sapiens
taggggtcctggaaccgataccccatagatactaagggatgactgtatcctatcagacttttccaaagtacacacacacacacacacacacacacacacamgcacgcacacacatgtaatcagatgcattgttggcagtattgatgaagacaatatttattgatatatcgtgctgtggaaatcagggagaaatgtgtactg

SEQ ID NO: 70835 - DNA, 201 bp, Homo sapiens
ccatagatactaagggatgactatatcctactagacttctccagagtatacacacacacacacacacacacacacacacacacacacacacacacacacacggacatgtaatcagatccattggtggcggtattgatgatgacaatatttattgatatattgtgctgtgctgtggaaatcagggagaagtgtaaactggag

SEQ ID NO: 70836 - DNA, 201 bp, Homo sapiens
ccatcgatgctttgaagaaactgcatcaattaacaggcaaaatacccatctaacatcataatgacaggattaaattcacacataacaatactaaccttaartgtaaatgggctaaatgctccaattaaaagacacagactggcaaattggatagagtcaagacccatcagtgtgctgtattcaggagacccatctcatgta

SEQ ID NO: 70837 - DNA, 201 bp, Homo sapiens
actgcatcaattaacaggcaaaatacccatctaacatcataatgacaggattaaattcacacataacaatactaaccttaaatgtaaatgggctaaatgckccaattaaaagacacagactggcaaattggatagagtcaagacccatcagtgtgctgtattcaggagacccatctcatgtacagagacacatacaggctc

SEQ ID NO: 70838 - DNA, 201 bp, Homo sapiens
atggaggaagatctcacaagcaaaaggaaagcaagaaaaatcataggttgcaatcctagtctctgataaagcaggctttaaaccaacaaagatcaaaagaracaaagaaggtcattacataatggtaaagggatcaattcaacaagaagagctaactatcctaaatatatatgcacccaatacaggagcacccagattcat

SEQ ID NO: 70839 - DNA, 201 bp, Homo sapiens
cctatggggttgacaacttttccagttgctctaggaattactgtaatcattttctttctgttatactgccttatagatctgatggaaattttgaaaagagygtgttctcattgtttagctctatatatctgttggcttcatttgcttttaatatttttttctaatagatacctttctggcttgcacagcaaagttcaatta

SEQ ID NO: 70840 - DNA, 201 bp, Homo sapiens
cattcttctcagcaccacgtcgcaattactctaaaatcgaccacataattggaagtaaagcactcctcagcaaatgtaaaaacaggaatcacaacaaactstctctctgaccacagtgcaatgaaattagaactcaggattaagaaactcactcaaaaccgcacaactacatggaaactgaacagaacagcctgcccctga

SEQ ID NO: 70841 - DNA, 201 bp, Homo sapiens
ttatttacatgctgtaagtaatatagtaatgctaactgggctttccttggcttttgtttcattgtgatctgagctcagattatagtttgatctgctatgcrctgacctgggtgccagatgcaagggaagccagtaaataatactataaagagagatgctagctttagttttgaaaggacgatgacttgtaagtgagactgt

SEQ ID NO: 70842 - DNA, 201 bp, Homo sapiens
gacatcacaattaaaagaactagagaagaaagaggaaacatacaaaagctagcagaaggcaagaaataactaagatcagagcagaactgaaggagatagasacacacaaaaaacccttcaaaaaatcaatgaatccaggagctggttttttgaaaagatcaacaaaattgatagactgctagcaagactaataaagaagaa

SEQ ID NO: 70843 - DNA, 201 bp, Homo sapiens
aagaagacatttatgcagccaacagacacatgaaaaaatgctcatcatcactggccatcagagaaatgcaaatcaaaaccacaatgagataccatctcacrccagttagaatggtgatcattaaaaagttgggaaacaacagatgctggagaggatgtggagaagtaggaacgcctttacactgttggtgggagtgtaaat

SEQ ID NO: 70844 - DNA, 201 bp, Homo sapiens
caaccacattgagccgcatggccgcataggggactatgaagatcagctcatgcatttgtgaagcactgcctccttgtgtcttactgttctctttcttaatkggctgtgttctggaatggtgtcttggtgttatgttttaaaacattattttgcgtaatttatgtcattttatagtcagccaggagaaagtacactacatta

SEQ ID NO: 70845 - DNA, 201 bp, Homo sapiens
ttgacccagccatcccattactgggtatatacccaaaggattataaatcatgctgctataaagacacatgcacacgtatgtttattgcagcactattcacratagtaaagacttggaaccaacccaaatttccatcagtgatagactagattaagaaaatgtggcacagatacaccatggaatactatgcagccataaaaa

SEQ ID NO: 70846 - DNA, 201 bp, Homo sapiens
ccataacagatccccaggttttttccttgtctattaggaactgtttaaaaaattttgtttaagaaacaaatgtatctccattcatattcttgaacaacacytctaattaatgaattactcagaaattttgctgatgaaaacatgttatgaaatctgtatattgtataagacctttgcttccctgagagaaatcactcccat

SEQ ID NO: 70847 - DNA, 201 bp, Homo sapiens
atactatgcagccataaaaaaggatgagttcatgtcctttgttgggacatggatgaagctgggaaccatcattctcagcaaactatcagaaggacagaaarccaaacaccacatgttctcactcataggtgggaattgaacaatgagaacacttggacgcagggcagggaacatcacacactggggcctgtcaggtggtgg

SEQ ID NO: 70848 - DNA, 201 bp, Homo sapiens
tactacttacttacttacttacttacttacttacttacttatatatgtctgtaagtacgtgacagagtctcactgtggcacccaggctggagtgcagtatyatgatcttggcttactgtaacctctgcctcctgggtccaagtgattcttgattctcatgcctcagtctcccaggtagctggcaatacacgtgtgcacagt

SEQ ID NO: 70849 - DNA, 201 bp, Homo sapiens
tttgcgtgttgatctttctctactttttagtgttcttaaaggtaaggaccaagtcatatgcttctgtattttcctcacagtgctttgcacaaaaaaaaaamattgtctagtaggtgtctttttagttacttttaaagtatcttgtgggtagttaagacttttttattcaaattttatataaaatctgtttttgttttctga

SEQ ID NO: 70850 - DNA, 201 bp, Homo sapiens
cctggctaatttatttcattttattttatttgtattttagtagagatagagtttcaccatgttgcccaggctggtctggaactcttgagctcaggcagtcygcccacctcagcctcccaaactgctgggattacaggcgtgagccactgcccccaaccaactcacacatactttaagtgggactttatttaatatcttcat

SEQ ID NO: 70851 - DNA, 201 bp, Homo sapiens
gttgtaatatatgtcaccaaattcatggctaaatcatagaaattgatctgtcacagcttgttaaataagtattctttctcttacatgacttcttacgtgattttttccaaactgcttagtcaaagaagataatctttccagatagagaaaattttaaaatatctttattcctctttaaatttactgatttataaatactgg

SEQ ID NO: 70852 - DNA, 201 bp, Homo sapiens
tattgtatttaattcctcctttataaagaagttttaactaaactttaaaattattttttattatctggtgtaccaggattgtgtgggtaatattctttttrtttttaggtctcattcagtatctctgtttttttgataaaacaagggtcagcaaactttctctgtaaaggtctgggtagtaaatattttaggctatgcagg

SEQ ID NO: 70853 - DNA, 201 bp, Homo sapiens
gtgtgtgtgtgtgtgtgtgtggtgtcaaaaaagtatctgaaggggcctgtaatagaaaacctagttcctttatgatatacacaatctagcttgaaattttratgcattaaattcataaaacatgaagagtttaagctttgcaacacttaattgacacatgcgtcagaataagtttggaaaaaaatgaaccttcatacattt

SEQ ID NO: 70854 - DNA, 201 bp, Homo sapiens
ggcctcccaaagtgctgggattacaggtgtgagccactgcgcctggccctcctcctctattttttttttacagccctttaaaaatgtagaagctggccaascacggtgattcacacatggtagttccggcactttgggaggcaaggtggacagattgcttgatcccaggagctcaagaccagcctcggcaacatggcaaaa

SEQ ID NO: 70855 - DNA, 201 bp, Homo sapiens
aaataataataaattaataaaaatgtagaaatgattccaagctaaagtgctctatgaaaataggtttggcccactggctgttttggggcctagttctagaycaagttctgccccaaactaattgtgtgctttggggtagtttgtataattggttttatcttctctggctattttatgaagataatctagtagtcacttcat

SEQ ID NO: 70856 - DNA, 201 bp, Homo sapiens
aggcctcccaaagtgctgggattacaggcgtgagccaccgcgcccggccccagcatgatcatttctaaagtgaaaataaacagtgaaaagccattagtaasttgccaataatgttgattctttggttagcgtgataaatcaaatttcccagaggcagtcacataaattatagcattatgttgctaagatgaatttggccaa

SEQ ID NO: 70857 - DNA, 201 bp, Homo sapiens
tccatagatactaagggatgactatatcctactagacttctccagagtatacacacacacacacacacacacacacacacacacacacacacacacacacacggacatgtaatcagatccattggtggcggtattgatgatgacaatatttattgatatattgtgctgtgctgtggaaatcagggagaagtgtaaactgga

SEQ ID NO: 70858 - DNA, 201 bp, Homo sapiens
ctccatagatactaagggatgactatatcctactagacttctccagagtatacacacacacacacacacacacacacacacacacacacacacacacacacacggacatgtaatcagatccattggtggcggtattgatgatgacaatatttattgatatattgtgctgtgctgtggaaatcagggagaagtgtaaactgg

SEQ ID NO: 70859 - DNA, 201 bp, Homo sapiens
tgtgaggattgcagggacagaaatcagttcggggatctgagggaggaaatttcaccacagagcagcaatgggaaactttttggaatgatgtagatattctrtatcttggctgtagtggtgattacaggactgcatatacagggatacctcgttatattgtggtttattgcactttgcaagtagtgtattttttataaattg

SEQ ID NO: 70860 - DNA, 201 bp, Homo sapiens
actccatagatactaagggatgactatatcctactagacttctccagagtatacacacacacacacacacacacacacacacacacacacacacacacacacacggacatgtaatcagatccattggtggcggtattgatgatgacaatatttattgatatattgtgctgtgctgtggaaatcagggagaagtgtaaactg

SEQ ID NO: 70861 - DNA, 201 bp, Homo sapiens
cggctgctttgtttactgaagcaagcctgggcaatggcgggcgcccctcccccagcctcactgccgccttgcagtttgatctcagactgctgtgctagcamtcagcgagactccgtgggcgtaggaccctccgagccaggtgcgggatataatctcctggtgcaccgtttcctaagcccatcggaaaagcgcggtattagg

SEQ ID NO: 70862 - DNA, 201 bp, Homo sapiens
ctgaagccttcctctctcaacttgtcaaagtcattctccgtccagctttgttctgttgctggtgaggaactgcgttcctttggaagaggagaggcgctctsctttttagagtttccagtttttctgctctgttttttccccatctttgtggttttatgtttgtttggtctttgatgatggtgatgtacaggtgggtttttg

SEQ ID NO: 70863 - DNA, 201 bp, Homo sapiens
ggccattatggtgcttatatgccagatttgttctcagtggcttttcttatctgataacttttaattaataggcagccttctttgcagtggtgtcaagatcrctgtgcacaacttcatatctttctggagacaacagggaaaggaagccagaagggagaacagtaattggtcaagttgcagattagggaagctaaaattggt

SEQ ID NO: 70864 - DNA, 201 bp, Homo sapiens
tagtctcaatggtctttacatttttgcatgattttgcagcagctggtaccggttgttcttttccatgtttagtgtttccttcaggagctcttttagggcasgcctggtggtgacaaaatctctcagcatttgcttgtctgtaaagtattttatttctccttcacttatgaagcttagtttggctggatatgaaattctggg

SEQ ID NO: 70865 - DNA, 201 bp, Homo sapiens
aactccagtctggcccttcagcataacttttccattattcacatatgcctctcttccttctacaagccaaattaaaatttagtattagggactccaaatgrtacaaactcattcattctctttaattgcctaactcctactcattcttcatattgttgcttaaatgtcagaccttttaggaagctatacttgacttagagg

SEQ ID NO: 70866 - DNA, 201 bp, Homo sapiens
ccatcaatacctaatttattgagagtttttagcatgaaggttgctgaattttgtcaaaggccttttctgcatctattgagataatcatgtggtttttgtcwttggttctgtttatatgctggattacatttattgatttgcatatattgaaccagccttgcatcccagggatgaagcccacttgatcatggtggataagct

SEQ ID NO: 70867 - DNA, 201 bp, Homo sapiens
aatgtattttttttcccagactgtaagctccacaatgtagagaccgtgtcagttttattcatttttgtattcttagagccaggccaagcattcaaaacagmcatgcagtaatatgaatatatctgaatcaatgagtgaatacataaataattgagaaaatgaatggatattagatattaaaacctttaccaactctactta

SEQ ID NO: 70868 - DNA, 201 bp, Homo sapiens
ctgtgtgaaggagactggccccgacttatttgctcatatcagcatgcatcactcagctggtcattgcaaaagtgcttgactgtaacagggcggtctggtaytgagactgggctcccttggaatctgctgtgggatggaggttggtgttcttgtcacattggctcagatgggcatgtgtctcccagcaggtccgtacataga

SEQ ID NO: 70869 - DNA, 201 bp, Homo sapiens
gagaaataagaaatattaaagttcagaaatattaatgtcaaaaaatgtgcatcttcagatctggtaagtagacctgcttagagctagccagtggttaggcytgagaaatggctgttccatcttctgtgcctagcaccacatctgatatagtgtaaaaatgtggatagagttatagacagatgatgaataagttgttaaaat

SEQ ID NO: 70870 - DNA, 201 bp, Homo sapiens
cagccactagggaggctgaggcaggagaatcttgcagtgagctgagactgcgccactgcactccagcctgggtggcagagtgagactctgtctcaaaaagaaaaaaaaaaaaacaccaagtgctgggattataggcgtgagccaccatacctgtccttaaaccatattttagtagttatttaaggaagttacaaaaaaaat

SEQ ID NO: 70871 - DNA, 201 bp, Homo sapiens
tgagtgcaaattatttgcacatttttgaaaagagaatagtcatcttttattcacctgataattgctgagaagggcaaacctcccataagtactgcttttctatttttttttttttttttttttttgagacagagacctcctgctccacccacctcagcatcccaaagtgctgggattacaggcgtgagccaccgcgcccag

SEQ ID NO: 70872 - DNA, 201 bp, Homo sapiens
gagtgcaaattatttgcacatttttgaaaagagaatagtcatcttttattcacctgataattgctgagaagggcaaacctcccataagtactgcttttctwtttttttttttttttttttttttgagacagagacctcctgctccacccacctcagcatcccaaagtgctgggattacaggcgtgagccaccgcgcccagc

SEQ ID NO: 70873 - DNA, 201 bp, Homo sapiens
caccatctccctctcaaacaaccagttactttactctaggacaagaatccaccatgcaaggtccctcatacaaaatcactttctttatatccctccccacaaaaaaaaaaaaaaaaaaaaaaaatatatatatatatatatgtgtgtgtgtgtgtatatatatatatatcttttatccacactttcctcacatccctcttt

SEQ ID NO: 70874 - DNA, 201 bp, Homo sapiens
accatctccctctcaaacaaccagttactttactctaggacaagaatccaccatgcaaggtccctcatacaaaatcactttctttatatccctccccacaaaaaaaaaaaaaaaaaaaaaaaatatatatatatatatatgtgtgtgtgtgtgtatatatatatatatcttttatccacactttcctcacatccctctttt

SEQ ID NO: 70875 - DNA, 201 bp, Homo sapiens
ccaaagtgctgggattacaggcgtgagccaccgcgcccggccccagcatgatcatttctaaagtgaaaataaacagtgaaaagccattagtaacttgccartaatgttgattctttggttagcgtgataaatcaaatttcccagaggcagtcacataaattatagcattatgttgctaagatgaatttggccaaattatgc

SEQ ID NO: 70876 - DNA, 201 bp, Homo sapiens
ccatctccctctcaaacaaccagttactttactctaggacaagaatccaccatgcaaggtccctcatacaaaatcactttctttatatccctccccacaaaaaaaaaaaaaaaaaaaaaaaatatatatatatatatatgtgtgtgtgtgtgtatatatatatatatcttttatccacactttcctcacatccctcttttt

SEQ ID NO: 70877 - DNA, 201 bp, Homo sapiens
agttaacctttagctactgagttggtgctgtacctgtttatctcgtttaatttttattctatctcatatgaggtagatgttgttatgcccattttactgtkttttattatctatctagtattcaaaggttcataacatcaaaaaagtcataataactgttacaatagctactgtagatccttatttttgacactacccttt

SEQ ID NO: 70878 - DNA, 201 bp, Homo sapiens
cagttactttactctaggacaagaatccaccatgcaaggtccctcatacaaaatcactttctttatatccctccccacaaaaaaaaaaaaaaaaaaaaaawatatatatatatatatatgtgtgtgtgtgtgtatatatatatatatcttttatccacactttcctcacatccctctttttattcattgattccctcttat

SEQ ID NO: 70879 - DNA, 201 bp, Homo sapiens
atagtgccttttcagaatgaggcaatttgacatcattgtttttgcctaagacagcttttagagtttagtctagaagttgttcaaatagaagttggtgacaygttgaagctgaatgccttcttttcttaaaaggtaggaaatgctcttctcatttgtaagttttagttttctacagtctaataatcttataaaaggtacatc

SEQ ID NO: 70880 - DNA, 201 bp, Homo sapiens
ttgagatggagtctcgctctgtcgccaagctggagtgcagtggcaccatctcggctcacggcaacctctgcctcccgggttcaagcgattcttctgcctcagcctccggagtggctgggactacatatgcccgccaccacgcccggctaattatttgtattttagtagagatgtggtttcaccatgttggccagggtggtc

SEQ ID NO: 70881 - DNA, 201 bp, Homo sapiens
caaagctctaatgaatgccactacatggtggagcttgagaactcactgagctacccaaaagactagtttgtcattgcagtggctcctagacattgctttaygaggaaagaaaagaggaaagaggatgagcctagatacaaagggaaaggcttgggaaaaagaaactacatccatgatttttatagtgcctcttttgttact

SEQ ID NO: 70882 - DNA, 201 bp, Homo sapiens
tgtgcaggtttgttacataggtaaactgcatgtcatgggggtttcatgtacagatcatttcatcatgcaggtaataatcacggtatctgataggtattttwtctgatcctctccttcctccaaccccctagcctcaagtaggccccagtgtctgttgttcccctctttgtgtccatgtgttcttgttgtttaccttcttat

SEQ ID NO: 70883 - DNA, 201 bp, Homo sapiens
aaagaggatgagcctagatacaaagggaaaggcttgggaaaaagaaactacatccatgatttttatagtgcctcttttgttactattgttttgtaaataarataggtagcaaatccagtcattcaaaattataaataaccactaaagggagaagtcaatgctcactttagcttggtttctgctgttgttctttatggtgtg

SEQ ID NO: 70884 - DNA, 201 bp, Homo sapiens
agaagatcaaaccaactacagcattctcttaagccaaagcctaatccagagcaaagccctaatgctcttcaattctgtgaaggcggagaaaggtcaggaarctgcagaagaaaagttggcagctagcagaacttgggtcattaagtttaaggaaagaagctatctgcataacataaaaatgtaaagtgaagcagcaagtgc

SEQ ID NO: 70885 - DNA, 201 bp, Homo sapiens
ccaaaaattttgaaaaaaagaaaacaggcactgtggctcacacctgtaatccctgcactttgggaggctgaggtgggagaatctcttgaaccaaggagttsaagaccagcctgggcaacatggcaaaaccccatctgtccaaaaaatacaaaaattagctgggtatagtggcacatgcttgtagtcccagctactctgcag

SEQ ID NO: 70886 - DNA, 201 bp, Homo sapiens
attgatgaacacttaggttgactccataccctggctgttgtaaatagtgctacaatagacataggagtgcagatatctcttggaaagactgctttcctttyttttggtagtaaacccagtagtggaattgctagatcatatggtagttctgtttttagttttttgaggaacctccccactgctttccgtaaatggctatac

SEQ ID NO: 70887 - DNA, 201 bp, Homo sapiens
cccataactcattttctcataaattgtttcctagagaagcctcctttttcagctagagccctttggatgccttttttcttttcttttttttaatttgactyttccaacgtagttgaaacacagaatctccgttaaccctcaatgtacactggtcttaatcagatcaagtttttaaccacaaggtaaaatgtttcactttgc

SEQ ID NO: 70888 - DNA, 201 bp, Homo sapiens
tcattttctcataaattgtttcctagagaagcctcctttttcagctagagccctttggatgccttttttcttttcttttttttaatttgacttttccaacktagttgaaacacagaatctccgttaaccctcaatgtacactggtcttaatcagatcaagtttttaaccacaaggtaaaatgtttcactttgctcatgaat

SEQ ID NO: 70889 - DNA, 201 bp, Homo sapiens
tttatttttcatgagcccatgtagtatttaaattttttaaaaaatgcaatttatcttattgcaattggtatcagattgtaactctttttgggtaaagactstattttgcatatcttaagtgcttgactgtgcttagcattctaccttataaattgatggtattctatgaatatttattttctaacatttttatttcctctg

SEQ ID NO: 70890 - DNA, 201 bp, Homo sapiens
ttcctccatccctgacccctcactagcctccccttttagatctctcccttgctataatatcaaatcttacatgtatgcacatcactctgaagtttgcttcrctcttgtatttcaaaatcacatttccaactgccacctgaatgtttgcttgcaggtgttttcccagtaccttaaaactttgtaattctagtttgaatgtat

SEQ ID NO: 70891 - DNA, 201 bp, Homo sapiens
ctcttccacatggcctttctacagcatgggcttctcacagcatggcagccgagttccaaggcagaacatttcaagccttggaaaggaaaagctgcagatcyctgaaggctcactctgaatttatactatgtcactttgccaattctcttgtcctttgttttgatagagcatctcacagggctagcccaaatttcatgtaga

SEQ ID NO: 70892 - DNA, 201 bp, Homo sapiens
ctctgtggaatctcctctctcaccaccctctatactctcttcctcctccccctctttttttttttttttttttttatttgagacggagtctcactctgtcrcccaggctggagtgcagtggcgcgatctcggctcactgcaaactccgcctcccaggttcgcgccattcttctgcctcagcctcccaagtaggtgggacta

SEQ ID NO: 70893 - DNA, 201 bp, Homo sapiens
aaagcctacttgatcatggtggatttgctttttcttgtgctactggattcggtttgctagtattttgttgaggatttttgtatcgatgtctatcaagtatrttggccttaagttttctttttttgttgtgtttctgccaggtttgggtatcacaatgatgctggcctcatagaacgagttggagagggatccctcctccct

SEQ ID NO: 70894 - DNA, 201 bp, Homo sapiens
atgtcaaagaaatctgaaatgttttaatttttctcctactgtgagtttgcttcatctctacttgaaaaatgaagagtttcttttaggccaggcgcggtggytcatgcctgtaatcccagcactttgggaggccaaggcgggtggatcaccttaggtcaggaattcgagaccagcctggccaacatggtgaaaccccatctc

SEQ ID NO: 70895 - DNA, 201 bp, Homo sapiens
aggaaatcacttgaactcaggaggcagaggttgcagtgagccaggatcatgccacggcactccagcctgggtgacagagcaagactccatctcaaaaaacaaaaaaaaaaagcttttatagaactaatgtatataaaatatacatacaagttggaagtatagcaaagagataaataactcagtttctgaaattaggaaaag

SEQ ID NO: 70896 - DNA, 201 bp, Homo sapiens
gaaggactggaggactgatgtggtttctcaaggccgacctcattcctgctgattctaacacctagcccttcagtgtttctgctggcatgtgtggtttcaacccctgtcacattcagacactctcatctaacagggcccagggtatttaatcagtttcatttgctaatcaggcctcattggtcccggcctttggtatctgtt

SEQ ID NO: 70897 - DNA, 201 bp, Homo sapiens
tgttttttgtctttttagtaacagctattctgaccggggtaagatgatatctcattgtggttttaatttggagttctctgatgaatagtgctgctaagcatttttttatacggttgttggccatttgtatgtctttttttgtgtgaaaaatgtccatctgtgtcctttcccacttttttttttaagttccagggtacatgt

SEQ ID NO: 70898 - DNA, 201 bp, Homo sapiens
agaaaaaggataattttaaacttataagaagtttaaaaataagcacattttattgttgggtttaattttttattcatggataaattagctgatgtagagaractagttttttctttctatctcaattcctttttgaatgaaatttagaggtgaaataaatattacaatgtcatgtctgtaatacttttaaaaatatttgta

SEQ ID NO: 70899 - DNA, 201 bp, Homo sapiens
tggtggacagaagtcccagccttgacagaagcaactgggggagctctccttgaaaggcactgaggtctttgcaggagaaagggagggagccacctcagctyctcttccagaccagcacgaaagcaatctgcctccctgtcacactcatgtcgcaatgttctggatattcagatcagacgaggcacttctgtggatctgcag

SEQ ID NO: 70900 - DNA, 201 bp, Homo sapiens
ccaaagtgctgggattacaggtgtgagacaccacgcccagcttcatttgaatattggaaatacactgttcctaagtaatggtcctgggaactttacaacartactgtgactattctcttttcaaaaatgtgtatcggcttaaatatttaagagatgggaaagagaagttcctgatgacattgtatgcaccacggtagcagg

SEQ ID NO: 70901 - DNA, 201 bp, Homo sapiens
gcaactcctacttgatgtgaagcatatcctggtaatctgctgggcccttctctcagccacagagtcaacgttgatgaatccgattctgcgtggtgaaagcrgaagcccagggaagcagcaggggcaataaatcggctttggaggatgggaatgtgcagccatacagctgttctaccttctgatcgccattgctgtactgca

SEQ ID NO: 70902 - DNA, 201 bp, Homo sapiens
ggatgatatctgtggcctagaaatcagttgtatagcccaaaatgttacctagactactaatgaacagcaaggtctaaggaaatggcaactagaggccgggygtggtggctcatgcctgtgatcccagcactttggggggccgaggctgtcagatcacaaggtcaggagatcgagaccatcctggctaacggtgaaagcctg

SEQ ID NO: 70903 - DNA, 201 bp, Homo sapiens
atgcagctaaacccactctggactcttttttttttttggcaactacctagacgcacagtggttccatagtgcctgctctaccatgctataagcttagggarggctttgctccagaaaaggaacctgtaattagctcatgtgagtgagtagatagccacatctaataaaaggttaagtattaggaaattcttgtgactatac

SEQ ID NO: 70904 - DNA, 201 bp, Homo sapiens
tgaggcaggagaatggtgtgaaccccagaggcggagcttgcagtgagccgagattgtgccactgcactccagcctgggggacagagtgagactccatctcaaaaaaaaaaagaaaagaaaaaagaaaatggcaactagaaacaagcagccccattgcagcacgctgaacaccgttttttggaagcatgcaccactgagcag

SEQ ID NO: 70905 - DNA, 201 bp, Homo sapiens
attgcagataaactattattacaggttattcctaataaacttttagttgctgaatgttaacaataacaatctttacttttaaagcactatagacaaaagtktaatttttatttagcaccaataaataaatgatttaacattttaaagtatttaataagactgaaacccacagcaaagctgttctctggtgtacaattactg

SEQ ID NO: 70906 - DNA, 201 bp, Homo sapiens
ctatccagccctcctaaggatcttcacttcctccccctagaaaactacagagttgctctgttgtcacagtgtgaaaacacacacacacatgcatgcgtgcrtacacatacacacacacacacacacacacttgatttggtgcataggaagtgacctaattcagtttgtcctcatcatagtgacaactagactgagccaatc

SEQ ID NO: 70907 - DNA, 201 bp, Homo sapiens
ttcaattttttgatatgtactcagaagtgaaattgctagatcatatagtatttctatttttaatgttttgaataactgccatactattttccacagcagcygcaccattttatattcattccaatagtgggaacaaggttttaaatttctgattcttttcttttttcttttttgatagtatgtatcctaatgggtatgagg

SEQ ID NO: 70908 - DNA, 201 bp, Homo sapiens
ccctcctaaggatcttcacttcctccccctagaaaactacagagttgctctgttgtcacagtgtgaaaacacacacacacatgcatgcgtgcatacacatacacacacacacacacacacacttgatttggtgcataggaagtgacctaattcagtttgtcctcatcatagtgacaactagactgagccaatcagagactt

SEQ ID NO: 70909 - DNA, 201 bp, Homo sapiens
ccagcttccctatatttttccccatcctaccagcaaactttgtttatataaaatgcagccaaatacaattaagccaaatacaagtcaaatcttcctcatcmttccattcatttcctcattctttcatttgttaccatccttgtttttttttttttattgagacggagtctctgtcacccaggctggagtgcagtggtgcat

SEQ ID NO: 70910 - DNA, 201 bp, Homo sapiens
cttttcccaacccttaggtcccaaccattctattctctgttaataggagttcagctgttttttagattccacatataagtgagatcatgtagtacttgtcyttctgtgtttggcttatttcacttagcgtgatgttttcagagttcatccatgttgtcgcaaatggcaagatttccttcttttttatggctgaattatatt

SEQ ID NO: 70911 - DNA, 201 bp, Homo sapiens
ctgaattatatttgtgtgtgtgtgtgtgtgtatacatatatgtacattcacaatagccaagctatggaaacaaccagtgttcattgatagaagaatggacraagaaaacatgatgtgtgtacatatatatatatatatatatatgtgcatatatatttgcatgtgtacacacacatcacattttctttattcattctctgt

SEQ ID NO: 70912 - DNA, 201 bp, Homo sapiens
tataaaatgagttgaaaagattattaataatcttacacagaatgatgtccttcagttcaaagatgttaccagtattaacagtggcacttgttttaaaagartaaatatcctactcttgtttttcattagaactctaagcaagactacaaacaaagttttcattgcaataataaatctttttgaaagggttttctgaaacca

SEQ ID NO: 70913 - DNA, 201 bp, Homo sapiens
tggtgcgatcttggctcactgcaagccccgcctcctgggttcacgccattctcctgcctcagcctccccggtagctgggactacaggcgcccaccaccacrcccggctaattttttgtagttttagtagagacggggtttcaccgtgttagccaggatggtctcgatctcctgacctcatgatccgcccgcctaggcctcc

SEQ ID NO: 70914 - DNA, 201 bp, Homo sapiens
aaaagtgaataagaatatacaaaacaataataataacagaaacagtgcattagatgaaagttcaaagtcttttgtggctgattgaaaaatgtaataggacygctaatgccttttatggaaagaagcaatataaactagtaatttaatgctttactccatttctacatagcatcttttaaaatttatttttagtatatcttg

SEQ ID NO: 70915 - DNA, 201 bp, Homo sapiens
cagctggaaacctccatggccagtggctccttctgcctgagtactgctcgcacccactgagcttgttctgcccactcagcccagcaggctgcactctgctygtgctactggccttaatcccacacctgccaagggcgagcgaggcgtggagcggtgagggttgtgtgggcaagtgagcccaggttcctgccactatgcaca

SEQ ID NO: 70916 - DNA, 201 bp, Homo sapiens
ggcaaattatttatagaagctatgtggaataagctgtatctatttagattttatataatttggtaattagcatacaatagcttacatgaaataaattcttkaaatagtagaaattatgagtaattccactgggcttactcttgtcttagattacatagatataagtattcttgggcattttgatgctagaccaatgattta

SEQ ID NO: 70917 - DNA, 201 bp, Homo sapiens
agctggaaacctccatggccagtggctccttctgcctgagtactgctcgcacccactgagcttgttctgcccactcagcccagcaggctgcactctgctcstgctactggccttaatcccacacctgccaagggcgagcgaggcgtggagcggtgagggttgtgtgggcaagtgagcccaggttcctgccactatgcacag

SEQ ID NO: 70918 - DNA, 201 bp, Homo sapiens
tcactacaacctccgcctcttgggttcaagtgattctcctgcctcagcctcctgagtagctgggattccaggcacctgccaccacgcccagctaatttttwatttttgtatttttagtagagatggggtttcaccatgttggccaggcttttatatcccccactatgtctagcaaaaaatgtaattgtataattatctaat

SEQ ID NO: 70919 - DNA, 201 bp, Homo sapiens
ccccaccaaaatctcatctcaaattatagttcccataatccccacatgtcatgggagagacctggtgggaggtaattgaatcatgggggtgcttacctccrtgctgttctcatgatagtcagtgagttctcatgagatatgaaggttttataaggggcttttccccttttgctctcattcttctccttcctgccaccatgt

SEQ ID NO: 70920 - DNA, 201 bp, Homo sapiens
ttatatgagatttttacccaccctaaccttagactcagtgccacaacacagcatgctaaattaggttacatccttaaaaaataataataataattcacttkgggtggagtacagacctgcccgtagccatcagttttactgcaggcaaaataaagacacacctcttcctgaaaacacagacaacacaaattactgtggcca

SEQ ID NO: 70921 - DNA, 201 bp, Homo sapiens
cctcctaaggatcttcacttcctccccctagaaaactacagagttgctctgttgtcacagtgtgaaaacacacacacacatgcatgcgtgcatacacatacacacacacacacacacacacttgatttggtgcataggaagtgacctaattcagtttgtcctcatcatagtgacaactagactgagccaatcagagacttt

SEQ ID NO: 70922 - DNA, 201 bp, Homo sapiens
ttaaatctctttattaaaatgaataccaataccaaattttattttataaggagtcatcatggcatagtatgaagagctgtgggttgacatcaggcataccyaaatttgaaaccagctctgctacttactcgctattttaactttagcatgttatttggcccctctgggtcatggtttaatcatctataaaacaaggatata

SEQ ID NO: 70923 - DNA, 201 bp, Homo sapiens
tttttttactgttgtattccccagtgtctgcttccttgtaggtgatcaataaagatttcttgaataaatgaaagaataaggggctcccaacatctgtttgctctcttatccctctccttccctacccagtggttcctgttctctccattcccttaccaactggtatgttatttttaaaactaaaaatactctgttttatca

SEQ ID NO: 70924 - DNA, 201 bp, Homo sapiens
ctgggaaactttgggagaccttgtctctacaaaaattgaaaaatcagctgtagccctggctactcaggaggttgaggcaggaggattgctagctagatccyagaggttgaggcctatggtgatccgtgatcttgccactgctctgtagcctgggtgacagggtgagactcttgtctctaaaaataaataaacataagacac

SEQ ID NO: 70925 - DNA, 201 bp, Homo sapiens
ttttttactgttgtattccccagtgtctgcttccttgtaggtgatcaataaagatttcttgaataaatgaaagaataaggggctcccaacatctgtttgctctcttatccctctccttccctacccagtggttcctgttctctccattcccttaccaactggtatgttatttttaaaactaaaaatactctgttttatcat

SEQ ID NO: 70926 - DNA, 201 bp, Homo sapiens
aagtatacaatatattgttaacgatagtcaccctacagtacaatagacctcttgaacttatttctcctgtttaactgaaggtttgtatcctttgaccaatwtcttcccaactcccttagacctccaggccctgataaccaccattctactttctgcttttgtgagttcgactttttaagactccacatataagcaagatca

SEQ ID NO: 70927 - DNA, 201 bp, Homo sapiens
gtctagctctgacagtgagatcttgggcccactctgctatttttttgtcttattttctcattttcacaaacagataatgttttacctttgcaaaaagctgtatatatatatatattctaaagcttggatatcaatttttttttcttttttttttctgagatggggcttcactcttgttgcccaagccagagtgcaatgtca

SEQ ID NO: 70928 - DNA, 201 bp, Homo sapiens
tctagctctgacagtgagatcttgggcccactctgctatttttttgtcttattttctcattttcacaaacagataatgttttacctttgcaaaaagctgtatatatatatatattctaaagcttggatatcaatttttttttcttttttttttctgagatggggcttcactcttgttgcccaagccagagtgcaatgtcac

SEQ ID NO: 70929 - DNA, 201 bp, Homo sapiens
taccaaattttattttataaggagtcatcatggcatagtatgaagagctgtgggttgacatcaggcatacccaaatttgaaaccagctctgctacttactmgctattttaactttagcatgttatttggcccctctgggtcatggtttaatcatctataaaacaaggatataattcctctctctagggttattatacagat

SEQ ID NO: 70930 - DNA, 201 bp, Homo sapiens
agaagcaatataaactagtaatttaatgctttactccatttctacatagcatcttttaaaatttatttttagtatatcttgtcttagtggtttatgctggkgttaatattctggagataatattacatcagaattctatatcacacattttgtttttcactgtttaagaaaggtaagtaaataatacttcagaacagtgat

SEQ ID NO: 70931 - DNA, 201 bp, Homo sapiens
tcagcaaacataccttgactatttacatagccagagcacaagtaagtgctttggctgctaccactgttgctgccctttgacccattaaacacactggcctyccttccgtctctcatgtcctctccccatcttctcagaaacacaaggaatatgtctatatgtctattccttgtgtttctgtcctccacccgcttccttttt

SEQ ID NO: 70932 - DNA, 201 bp, Homo sapiens
atagttggattctcccatcttcttttctctgtcctctggcaaccactagtctgtgtccatctccacagttttgtcattctaaaaatgtcacagctgggcaygatggattgcatctgtagtcctagctactcgggaggctggggtgggaggatcccttgagcctaggggttcgaggctgcagtgagccgtgatcgtactgct

SEQ ID NO: 70933 - DNA, 201 bp, Homo sapiens
aacataccttgactatttacatagccagagcacaagtaagtgctttggctgctaccactgttgctgccctttgacccattaaacacactggcctcccttcygtctctcatgtcctctccccatcttctcagaaacacaaggaatatgtctatatgtctattccttgtgtttctgtcctccacccgcttcctttttctattt

SEQ ID NO: 70934 - DNA, 201 bp, Homo sapiens
ggattctcccatcttcttttctctgtcctctggcaaccactagtctgtgtccatctccacagttttgtcattctaaaaatgtcacagctgggcacgatggmttgcatctgtagtcctagctactcgggaggctggggtgggaggatcccttgagcctaggggttcgaggctgcagtgagccgtgatcgtactgctgcactc

SEQ ID NO: 70935 - DNA, 201 bp, Homo sapiens
gttgtttggtatctcccaaagtatgtgccaaagatcaccattaaaccatttatagatattctgccagaaataggaggggaagagttctatgggaaacaacragtgtcgtagtccattctggctgctataaccaaataacttagactgggcaatttttaaataatacaaatttattgctcacacttctgaaaactgggaagt

SEQ ID NO: 70936 - DNA, 201 bp, Homo sapiens
atccacatacaaacttttatgtgaacataagttttcatttctttagaataaagagtacaattgttgaatcatatgatatattagtttcctgttgctgctakaacaaattaccacaggctggaagcttaaacaacacaaatgtatcacagttgtatagcttaacaatccaacatatgtctcatcgggctaaaatcaaagtgt

SEQ ID NO: 70937 - DNA, 201 bp, Homo sapiens
taaaccatttatagatattctgccagaaataggaggggaagagttctatgggaaacaacaagtgtcgtagtccattctggctgctataaccaaataacttrgactgggcaatttttaaataatacaaatttattgctcacacttctgaaaactgggaagtccaggatcaaggtgccaacagatttggtgtctggtgagggc

SEQ ID NO: 70938 - DNA, 201 bp, Homo sapiens
taaagctgtgtttgaagtaagactttgtgctgatttggatgtagttagagttggacccagtgatgtgcttgaactggctcttcccagtttgcaagaggcaygttctgaagtccaagaatgttgcaagttagtttttaaacagtcagtagccatgttgggagtatgtatacaatggaaattggcaatcactataaatcagtg

SEQ ID NO: 70939 - DNA, 201 bp, Homo sapiens
gctgtgtttgaagtaagactttgtgctgatttggatgtagttagagttggacccagtgatgtgcttgaactggctcttcccagtttgcaagaggcatgttytgaagtccaagaatgttgcaagttagtttttaaacagtcagtagccatgttgggagtatgtatacaatggaaattggcaatcactataaatcagtgctcc

SEQ ID NO: 70940 - DNA, 201 bp, Homo sapiens
aatcagatagacttagcttacatcccacctcaatttagtagctgtatgaacctggcaatattgtcttatatgtaaaattatgacagttattatacataatrcagtcagccccccaaatttacaggtttcaaatccgtggattcaacgaatcaagggtcaaaaaaaattttaagaaaaaaaaacagtaaaaaataatgcaac

SEQ ID NO: 70941 - DNA, 201 bp, Homo sapiens
gacaatacagtatagtaactatttacatggcatttacattgtgttagctattacaagcaatctagagatgattttaagtatagggaggatatgcagaggtyatacgcaaataactacaccattttatataaaaaggacttgagcatctgtggaatttggtatcctggtgggggttagggaggggattggaaccaatcctct

SEQ ID NO: 70942 - DNA, 201 bp, Homo sapiens
atatcctaggaaatcagatgtcctacttgaaaattctaaccaggaacccattcccccaaatccccaaccaatttcctaaaagctaactaaatgcagtgaawtatttttaaagtaataaattataatttggggatgtaaaatgcttaaacagtggtttcctgatgacctaacaaatctagccttaaggaaccattgctaggt

SEQ ID NO: 70943 - DNA, 201 bp, Homo sapiens
cctaggaaatcagatgtcctacttgaaaattctaaccaggaacccattcccccaaatccccaaccaatttcctaaaagctaactaaatgcagtgaaatatytttaaagtaataaattataatttggggatgtaaaatgcttaaacagtggtttcctgatgacctaacaaatctagccttaaggaaccattgctaggttgat

SEQ ID NO: 70944 - DNA, 201 bp, Homo sapiens
attcccctcaatgaatgaatatacttttaagatagggatgtgctacttttcctggttaattggcagttgagcagtggaaagaatatatgacttgtctgtgraaagagtcagtggtagaattgagacttttaacctttgcattcttgccctttccagtgacagatgctatcttggagtgttggtttgggtgtgccattttca

SEQ ID NO: 70945 - DNA, 201 bp, Homo sapiens
ttcttattaactatattaatcaatttagaaagcatcagcttttcacttgctggctatattttgctaattcaaaatgcaaataatttgctgagctaaattgkatatcttttaatttgttttctctgttcttcattgagaaagttagtattttctgtttttaacttctcactttagctacatgtagttttttcttgggggtga

SEQ ID NO: 70946 - DNA, 201 bp, Homo sapiens
aatggttgtaatatatgtcaccaaattcatggctaaatcatagaaattgatctgtcacagcttgttaaataagtattctttctcttacatgacttcttacrtgattttttccaaactgcttagtcaaagaagataatctttccagatagagaaaattttaaaatatctttattcctctttaaatttactgatttataaata

SEQ ID NO: 70947 - DNA, 201 bp, Homo sapiens
atgctcattggagcattttggatttcaaattttcagattacaaatgttcaaccagtaagtagaatgcagatattccaaaatctgtaacatgtctggtcccmagcatttcagataaggaatactcaacctgtatagtgttgcccaaaacttatttgaccatggaatacttctcctgaacacactgatttcttaacggaaatg

SEQ ID NO: 70948 - DNA, 201 bp, Homo sapiens
caaattttcagattacaaatgttcaaccagtaagtagaatgcagatattccaaaatctgtaacatgtctggtcccaagcatttcagataaggaatactcarcctgtatagtgttgcccaaaacttatttgaccatggaatacttctcctgaacacactgatttcttaacggaaatgctggcgtggaccatgagaagagcag

SEQ ID NO: 70949 - DNA, 201 bp, Homo sapiens
aaatgcttttaataaatcatatgaagcattcatgtttttacttatacatattttcagggtaccagtaaactttttagttcaaagataggccaaattgtacttttttttttttatgagacagagtctcgctgctctgtcgcccaggctagagtgcagtggcgtgatctaggctcactgcaagctctgcctcctgggtttact

SEQ ID NO: 70950 - DNA, 201 bp, Homo sapiens
catatagattttgtacacattttgttagagttataactcatttttttggggtgctaatataaatgataatgtgtttttaatttgaaacactttttaattgytgatatataagaatgcagttacttcataggttaaccttgtatcctgcaaccttgctataattgcttattagattcaggagtggttttgttgataatttca

SEQ ID NO: 70951 - DNA, 201 bp, Homo sapiens
taaaatgcttaaacagtggtttcctgatgacctaacaaatctagccttaaggaaccattgctaggttgatacactcagaggacttttcgaaatgtctacayatgatcagacctttctaccagttgtgtttggaatgtaacaggagacttccctccatacattcttttgtttaaaatgttatgttaaatttgaggaatgtaa

SEQ ID NO: 70952 - DNA, 201 bp, Homo sapiens
gttaaaaccaagaggaattctatcagaaaatgttaaccacggagactctgtaagtgtgcccgatttttatttcctggtttatttactagatgaagtggatrtaactaacaggaaaacacctgattagtgctgcagactctgtgttcttatttaattctcatacaactttggaagttaaaagaccttaaattaattttgcaa

SEQ ID NO: 70953 - DNA, 201 bp, Homo sapiens
ctggaagtcctagccagagcaattagacaagagaaagaaataaaaggcatcctaataggaaaggatgaagtgaaattatctttgtttgctgactacatgawcttatacagttacacctctgtatctgtgggttctgcatctttggattcaaccaaccacagattgaaaatactcagaaaaaaatggatagttatgcctgct

SEQ ID NO: 70954 - DNA, 201 bp, Homo sapiens
ttataaattcttttttttctcatctgacagtagcttttttctatacaatcagttacctttcactgtgtttttcacccatcctttttaaaatatttctgatrtcaggatttgctgcaaaagaattaacgaaaagtatcaagaagtttgctagagctttctttctactcttgcttctctcatggaatcaagtggaaaattggg

SEQ ID NO: 70955 - DNA, 201 bp, Homo sapiens
tgtggatataagttttctattccttttgataaatatccaggaatgcaatagctggaacctgtggtaagagtatttttagttttctgagagtttatttttgsaacttccaaactgtcttcaagagtggttgtaccattttttaccccatcagcagtgaataaaagtttctgttgcttcacagcttcatcagcctttggtgtt

SEQ ID NO: 70956 - DNA, 201 bp, Homo sapiens
atttctgatatcaggatttgctgcaaaagaattaacgaaaagtatcaagaagtttgctagagctttctttctactcttgcttctctcatggaatcaagtgraaaattgggctttcttattttatttcattcactgagtaactactcacaagaatgtctacttcagtaaggtagttgaaccaagcatatcctgacagcctca

SEQ ID NO: 70957 - DNA, 201 bp, Homo sapiens
ttatatgtgaattggccacagctaagagtaaatgattgaaatcttttaaaacttttagttacattgtttacaatttggggtaaatgtctagataagtcatktaaattttttcacctaaactcataattttgcttctagagtcctaacgagtagtgaaatggagattaatcttgaaaatcccattagcttacatcactagaa

SEQ ID NO: 70958 - DNA, 201 bp, Homo sapiens
gtctagataagtcatttaaattttttcacctaaactcataattttgcttctagagtcctaacgagtagtgaaatggagattaatcttgaaaatcccattascttacatcactagaagcactttgtccacctgcttcctggacctagaagagtaaacctgtggttgtccagttctaggtggtagctttaagatactgcaggc

SEQ ID NO: 70959 - DNA, 201 bp, Homo sapiens
ccgactgcttgcttcaaatcaaactgcactttcactgtgcttaacctcagtcaagttacttgcttcttttggctttaatgttatcttgcataaaaatcagkatatttaaaatacctcactagtttgttacatgattaaatgagacaatgtatataaaataacacagagcctgttatatggttacttttagccattaacagc

SEQ ID NO: 70960 - DNA, 201 bp, Homo sapiens
aaggagttcttctctatgggccacctgggtgctctaaaacaatgatagcaaaggctttggccaatgagagtggactgaattttctagctataaaggtaggrtgttaaattttttaatcgctactctctcttggcctcccccaacccccattctctgactcctacctttaggagaacgaataaaggcatcttaaggagcagt

SEQ ID NO: 70961 - DNA, 201 bp, Homo sapiens
gtcaagttacttgcttcttttggctttaatgttatcttgcataaaaatcagtatatttaaaatacctcactagtttgttacatgattaaatgagacaatgyatataaaataacacagagcctgttatatggttacttttagccattaacagcataatcataaaatatcacattataaagttgcaagagattctttccatac

SEQ ID NO: 70962 - DNA, 201 bp, Homo sapiens
attaatagaacagctggacaaatattttcacatgtgtttatgatatttttgttattttgtaaacttggatacttgaaatattggccatggaatgttaaaartaatgctattaaaaataactcaattaatggtacttattaatggcagtttttcttgatcattcttatcagtaaagcacatgctatctaggaggtaaaatat

SEQ ID NO: 70963 - DNA, 201 bp, Homo sapiens
ggaaaaatttttggacatttttgataatgaggaaaaaccatgtggcctagaaatataaaaaaaattaagaaaaaatgtcatgaatgtattaaatatgtatrtactagtctattttaccatttactaacatgaaatatacacaaatctattataaaaagttaaaattatcaaaacctacacacacaaacactactcagcctt

SEQ ID NO: 70964 - DNA, 201 bp, Homo sapiens
atgtttgctttgactggactacttctatctcttggtagccattgctttgattgtgctttgtcttcaagatctgtagagctgtgtttcatttcctgttacarttctttgaagcagtacgtcaaaatcttgatcccacttgtttacagttttgattgaaagctctgcccttgtatgcagctgatctgggcataaggattttgg

SEQ ID NO: 70965 - DNA, 201 bp, Homo sapiens
tcacgaggtcaggagatcgagaccatcctggctaacatggtaaaaccccgtctctactaaaaaaaaaaatacaaaaaaattagctggggtggtggcaggcrcctgtagtcccagctacctgggaggctgaggcaggagaatggcgtgaacacgagaggtagagcttgcagtgagccgagatcgcaccactgcactccagcc

SEQ ID NO: 70966 - DNA, 201 bp, Homo sapiens
ttgtgtatcccaggatgtttactgtggaagtgtttctggtagtgtggggttgaggacaacttaagtgtccatcactatgagaatggtcaagtaaaatgcawcggatgcatcctgtggaacgttctgtaacagagcaataaaataaatgttcaggcaatgccctccagccagagactcctgggaacatacacctggagtgga

SEQ ID NO: 70967 - DNA, 201 bp, Homo sapiens
agggaattataagagctgagcttgtatgagatgatatgggggagagcttaagaaagtgggcattgtactggattgcttactttcaggaggcagagacaacrccatgattgattatcttaattaaatcatctgtaaggagggaagaattgagtgaagctaatggtgtagttggtgaagaagcagtcactcttactagctgga

SEQ ID NO: 70968 - DNA, 201 bp, Homo sapiens
agcatagattctttaatttaggaaagaagaaaacttaattttgatttttctaactttctgctcagctcttccaacgtgaatatgtaggtctctgtctcccrgggtcctcattatgctttactttgccctttccagtgccctttccagtgtttcaaccacattgagccgcatggccgcataggggactatgaagatcagctc

SEQ ID NO: 70969 - DNA, 201 bp, Homo sapiens
ctaacatgtaagcacatttatgattaatttttatatgagatcttctgaaaatcgtcacaggaaaagtagcagaaaattctatctttcctcaaattatattkttgtgttccataatgcttggattggggagggcatcccattgtggtcctatttataattagtatattattacaacttcatagaaattttgctaacagctac

SEQ ID NO: 70970 - DNA, 201 bp, Homo sapiens
ccatttgtaattaaaattgaaaaaattttaattcttccatttaccttgactatcacaaatacatgtaatgattttttaaacccagtctagagctgaaccarttaagacaaaattgacataacagatttgcccacttttccattaaatatttttatccctaatcaggccctcaagttacctgctaatgctaattgtatgact

SEQ ID NO: 70971 - DNA, 201 bp, Homo sapiens
ctggctttttttcaatatcagacatcaccatattatgcttttttaaacgtatgtagataaaagtgaatgtggaacataaatttgcacagtcttcctggaargtggttaatatataatataaaaacttcaagtactcaccttttgtcctataaattctatttttaaaactttgtcctagataataagacaaataatccaaga

SEQ ID NO: 70972 - DNA, 201 bp, Homo sapiens
agtgactgggcttgttgacttgtacctaataggtttggttctaaatatagttttaaaacaaaccaactacagaattttctagtgtttgctcatctttagcyaatgtggcactctttccaccagaccttccgaaaagcaagagcagtggcgccttccattattttctttgatgaactggatgccttagcagttgaaaggggc

SEQ ID NO: 70973 - DNA, 201 bp, Homo sapiens
ataaatttgcacagtcttcctggaaggtggttaatatataatataaaaacttcaagtactcaccttttgtcctataaattctatttttaaaactttgtccyagataataagacaaataatccaagattgaatctgccttagagagttgctttaaggattattgcatatacactatatctacataacagaatgagaaactat

SEQ ID NO: 70974 - DNA, 201 bp, Homo sapiens
cttttccctggctagtcttagaagcaatcacatttttatataatgaactctgaggggtttaaaaatgagtgagacatggtatcctggagtgcagcatatgwctgctcagcatttacaggtttgtttgtttttttcctctctttacttttccatttagtagacactaggccataaacccgttttaatttattcactgagaag

SEQ ID NO: 70975 - DNA, 201 bp, Homo sapiens
tttattcactgagaaggaaatgacataatattcactgctgtggctgcataggtcatcaattccctgggactcaggattacatctgagctgatatcagactscctcttcccaggatagtaaaatttgaagtctgtgtgtcaggggcctgcagtgtaagtattcgagaaagtttgttcaaagtatttcctttccaaaaagcag

SEQ ID NO: 70976 - DNA, 201 bp, Homo sapiens
aagaacaaaattttaaatctctctaagaggtttagtattgagtggcaattattttgtttacttgtctgtcttctctgttgactatgaactccttcgtggtrgagatggtgttgcttatgtttgataagtccaatcccagactcataaatgtttatttggttggataattagcaaattaattaattttgcctgttaatgcag

SEQ ID NO: 70977 - DNA, 201 bp, Homo sapiens
gggtcctcattatgctttactttgccctttccagtgccctttccagtgtttcaaccacattgagccgcatggccgcataggggactatgaagatcagctcrtgcatttgtgaagcactgcctccttgtgtcttactgttctctttcttaatgggctgtgttctggaatggtgtcttggtgttatgttttaaaacattattt

SEQ ID NO: 70978 - DNA, 201 bp, Homo sapiens
tatgcagctgatctgggcataaggattttggccctaatcatgtggaaagtttgcacaactttaatttttcagtcagaattgtttaacctgaaccaattgcrgtggctctggtggtgggtattgtttgtgctgttaatcatttatcttcttcaattagggaacaaacaagatgagttttttccttgcaaactgatgtggaag

SEQ ID NO: 70979 - DNA, 201 bp, Homo sapiens
tgtctgtatgctggagaataggaaatggttaactatggccagacctataccctagcatatctaaatctattacaaaagtgaattaaccactgtattaaagktttctagagagacagatccaataggagccatttattatctagatctatatatgagtttattagggagcactggctcatgtgataacactgtgaagtccca

SEQ ID NO: 70980 - DNA, 201 bp, Homo sapiens
ggtcaagctatatggcatgtgaattcagtgtcagaaagtctgaatttgggtccttgatttgctacttactagactctctggttgcaggtaagctctgaaastctgagtttctacttcctgttcatcaaattgatgaaatgacactaactctgcctacctcttaaaattctttaattattttttaattgaaatgtgaaacta

SEQ ID NO: 70981 - DNA, 201 bp, Homo sapiens
gggtattgtttgtgctgttaatcatttatcttcttcaattagggaacaaacaagatgagttttttccttgcaaactgatgtggaaggtcagctgctggggkcttcatcttcaacatagtcttgttctttcagttatccatttgtaaactgctatctcattagggcattgtctcatgaacttttcataaagcatcaatagtt

SEQ ID NO: 70982 - DNA, 201 bp, Homo sapiens
tgtgtataaaatatttctcaaagtagtactctgtaacaagaaaaccttgaccctgtttcttcaaatgaatataagctctaataaatagacatttgttcaawctctgaactatttaactgtaatgagttgaaaaaaaatttttttttttttgagacagagtttcgctcttgttgcccaggctggagtgcagtggtgagatct

SEQ ID NO: 70983 - DNA, 201 bp, Homo sapiens
cccaatggtatcaaatgctctctggaatatagataatgaagctcttaacatagtgcctcccacatagtaggcactcagaaatttgctgactaattctaggwcttccatctgcctaggtattagatgtttccatttacctctcagctgtaaatactgcattttttgtgcttaaagtataaaactgttgtctttccttcttag

SEQ ID NO: 70984 - DNA, 201 bp, Homo sapiens
tacttcagtgaaaggacttcctctaatagattaatggacagaggttaataataaaggtattcacaggaatgaaagaagaattgactaagacagaaggagaytaggtgctactatggggtaggtttatcagaattatgacttccatagtgtactgtatattgaggcatttcattattcatattttttaacaaaacactctat

SEQ ID NO: 70985 - DNA, 201 bp, Homo sapiens
agtctagcttctctccccctgtggcccagaagtgtattgaaaagtcagctgccttcctattcctcaatagcttcttcaaggaatttttgcccacaggcagyatatttttcttcccagatccaaatctagcttttattctacctttgatttggtctatcaagtaaataaactggcttatttaaaaatatgtcatattcagtg

SEQ ID NO: 70986 - DNA, 201 bp, Homo sapiens
tctggtgtacaattactggagaagttcactaggtcagagtaaaagcgaagaagatgtattttaacatctaatatgcaatgtactttttgtttcttaatcaraatgtgaaaaagaacataaaatacagaattttattttcattacaacttaaaccagagtttaacatctataaaatatgcttcaaaaattagaagtttaaga

SEQ ID NO: 70987 - DNA, 201 bp, Homo sapiens
aatgcctccctttctatgtcttatcatgaatttatttttttccctttaatagtagatcaaatatagatagccaggaaagagtaaaaggtcagttatggtamtatagtgaagatgtttcattcatactttaatattatacaagtattagttttgtattatacttcttcttcttcttcttcttcttattcttattattattat

SEQ ID NO: 70988 - DNA, 201 bp, Homo sapiens
gatagtattagaaacaatgtcactgtaatttccattttcaggcctatgtatagtgttaataagattcttgccatgagtctctttactatttatagattagyaggagccatttttatggcaatccaaagctctctgttaaacttaaaacactgtataaaatgagttgaaaagattattaataatcttacacagaatgatgtc

SEQ ID NO: 70989 - DNA, 201 bp, Homo sapiens
aaatatagatagccaggaaagagtaaaaggtcagttatggtaatatagtgaagatgtttcattcatactttaatattatacaagtattagttttgtattawacttcttcttcttcttcttcttcttattcttattattattattattttgagacagagactcaccctgtcgcccaggatggggtgcaatggcatgatctct

SEQ ID NO: 70990 - DNA, 201 bp, Homo sapiens
caagtggaaaattgggctttcttattttatttcattcactgagtaactactcacaagaatgtctacttcagtaaggtagttgaaccaagcatatcctgacrgcctcatggaagcaatgaatcttttaatttatattagagaggaaaacgaattaatgaggaagaaaatcataagtagatggttaggcattctagagaatta

SEQ ID NO: 70991 - DNA, 201 bp, Homo sapiens
ttgcaacccctgcctttttttgttttccatttgcttggtagatcttcctccatctctttgttttgagcctatgtgtgtctctgtacatgagattttgagaygagtttcctgaatacagcacactgatgggtcttgactctttatccagtttgccagtccgtgtattttaattggagcatttagcccatttacatttaaggt

SEQ ID NO: 70992 - DNA, 201 bp, Homo sapiens
tatagagacataggaaatgttagtttgcattgttttcactttgcccctatagttttttaaaaagcagattcactttttacaagaggaagaatttggattastgctggatacatactgttttgacttgtaaaatgactctttaatagaaatggacaaagaaaatatgctaataaaataacttaagtatgtgtatgtgtgtgc

SEQ ID NO: 70993 - DNA, 201 bp, Homo sapiens
tacaagaggaagaatttggattagtgctggatacatactgttttgacttgtaaaatgactctttaatagaaatggacaaagaaaatatgctaataaaatamcttaagtatgtgtatgtgtgtgcatgctaaatttttttttcttctgttctcttcattttgtgctcatcatcaattgctgctatttactgtggtgcatttt

SEQ ID NO: 70994 - DNA, 201 bp, Homo sapiens
agccagcatggtccctgcaatgtaagttctgaagaaatgtgtcatttttctttttcctgaatagaatgaatgaatttggggaaggattgtattatactttwtgagaggaacagctcgaattctgttctcttccctgccagcccctcttgcatttcagggtttttacttgcccacagcattcttgcctagtaattaaaacct

SEQ ID NO: 70995 - DNA, 201 bp, Homo sapiens
cattgctttgattgtgctttgtcttcaagatctgtagagctgtgtttcatttcctgttacagttctttgaagcagtacgtcaaaatcttgatcccacttgtttacagttttgattgaaagctctgcccttgtatgcagctgatctgggcataaggattttggccctaatcatgtggaaagtttgcacaactttaatttttc

SEQ ID NO: 70996 - DNA, 201 bp, Homo sapiens
aaaagtttttgaccatcaagcagcagttgtcagtaggagtttataataccaagaatgtgctgcatatcttgtctcattaagttttaagtaacatttaaaamtattaaagcatgttacttgacctaattttatagcatttgagttgtcccattaaatggagcatctcgtaaatttcaagtattttatacttggcaatggtta

SEQ ID NO: 70997 - DNA, 201 bp, Homo sapiens
gcttgcaggactgcgccaagacaccctcagcctccctcacatactcattggcacccaaagtctggaggggaccaaggtggaagggagctggactgtcagtrccaccttgagcacatgaacacctaggtgggtcatgacagtggcttggctcagccttaactttggtctgaaatcagagcaggcaaaaagtttttctgggac

SEQ ID NO: 70998 - DNA, 201 bp, Homo sapiens
caatgagttaaggaatcctttcacgtttttcccaactttaaaattaaggattctcagggccctgtgtagagcagtaaaaataagacctcgtgtatgtgtakgtgtgtgtgtgtgtgtgtgtgtatgtgtgtctgtctgtctgtctggaggagaattgattggtgttccacttgggtgagagggttggctgtgagcctcaga

SEQ ID NO: 70999 - DNA, 201 bp, Homo sapiens
tattcctctgggttaagttttcctcttgttcttctttggtttctagctgacttacttgtgagagcagaaaattacctgggtgcttgagacccattgttcaygtgatggaactgtgatgcacatacatttgaatacatttaagttttttatttgccgtttgtaacttacactggaaagctaccctggtcctacagttaaaat

SEQ ID NO: 71000 - DNA, 201 bp, Homo sapiens
tgtgtgtgtatacatatatgtacattcacaatagccaagctatggaaacaaccagtgttcattgatagaagaatggacaaagaaaacatgatgtgtgtacwtatatatatatatatatatatgtgcatatatatttgcatgtgtacacacacatcacattttctttattcattctctgtcaatggacacaggttgtttcca

SEQ ID NO: 71001 - DNA, 201 bp, Homo sapiens
gctttttatttctttttcttgcctaatttccctggctatgactttcagtactatattaaatagaagttgcgagagtgagcattttgtcttgctcttcatcktagaggaaaagtttttagcttttcattgttgggtatgatgttagccgtgagcttgtcatacatatagcgttatgatgttgagatacattctgtctaatgt

SEQ ID NO: 71002 - DNA, 201 bp, Homo sapiens
ggctgggcacggtgactcacacctgtaatcccagcactttgggaggctgaggcgggcggatcacgaggtcaggagatccagaccatcctggccagcatggygaaaccccatctctactaaaatacaaaaaattagcttggcatggtggcgcacacctgtagtcccagctactcgagaggctgaggcaggggaatcgcttga

SEQ ID NO: 71003 - DNA, 201 bp, Homo sapiens
tataatttgtgcccttgatattgagtatgtcacgatgaaaagaacactaagctgggattcacattgcttggatttacttcctaaccttagcactttttagwtttgcagccttaagcaagttctgtaagtctcatttttttcatccagaaaagtataacatttgtacattataagctttggggagcattatgcttaaaaagg

SEQ ID NO: 71004 - DNA, 201 bp, Homo sapiens
ccagcaccatttattaaagaggaaaatcttaaaagcaactggagaaaaaaaaaagataagatacagattaataaggtaataattcttattccctatagaarccatgcaaagcagaacacaaggaaatgacatatttcaagtgctaagtggatgaatctcagtcagattattcggaatactaatagcgttcatttatttagt

SEQ ID NO: 71005 - DNA, 201 bp, Homo sapiens
tctttatccttatggagcttataaatgtctaaggaaaagaaatgtggtaattctaggtacttctgaggatggttctaaggattaaatgatatattaaaaaraaccagcacaatttctggcatataacatttatgttcaataattttaagtatttaaaaaaatagttataagtagtctaagtgttctgaataagtgccaagt

SEQ ID NO: 71006 - DNA, 201 bp, Homo sapiens
agttagttgtttgcgtgttgatctttctctactttttagtgttcttaaaggtaaggaccaagtcatatgcttctgtattttcctcacagtgctttgcacavaaaaaaaaaattgtctagtaggtgtctttttagttacttttaaagtatcttgtgggtagttaagacttttttattcaaattttatataaaatctgttttt

SEQ ID NO: 71007 - DNA, 201 bp, Homo sapiens
caggagaatctggttctatattttgttacatataattattttcttttctaaaggtgttcttttattaagctcccaccataaaagaggggaaaataagcacrcgtcttacatgcctgatgtttagcacttcttacaaaagaaagaggaaaactttaacataatccactgataaaagcatatttgtcttggcttcagacagtt

SEQ ID NO: 71008 - DNA, 201 bp, Homo sapiens
tttcctaattgaatttttgccagctaatttgtacgtaagttaaggattgattgatatatatttgatagacaatcaccctcttctaggtattataacatatrcaaaaagtatacaacagcattttccaaagtggaaaagaaatattagtttttgagatgttccatgattagagtttgggaatttaaaatagaatttttacat

SEQ ID NO: 71009 - DNA, 201 bp, Homo sapiens
gggatatgtgtactttttgatagaaaacatggagactatgaaaagcattcattttgtctcctggttgtcagattctgtctgtaactgacagtatgatcctmtatcttttaaatgtgctattacctgagtttcttttggtaacactaaaggtagaaagaaaaaaagttaacttagggtaaaggctatttgttcctttttcat

SEQ ID NO: 71010 - DNA, 201 bp, Homo sapiens
gactttaagcatagaatctcttctcataagccagcccaggcacatcttactcaacaattcaagcaaaacctttggatctgtcagaaacagcttataggtckgcattaggtgattaattgccaggagaatctggttctatattttgttacatataattattttcttttctaaaggtgttcttttattaagctcccaccataa

SEQ ID NO: 71011 - DNA, 201 bp, Homo sapiens
ttgaatatgattggcagaaagagtcttcatgtagaagtagtaggggatgaagcagaaaaagtaggtcagacttaaatatgaaggaacttgaatatcatccraacttgcttttctcctttcagcaatggaaaaccattgaaaaatgtgatcactgttgtggtcagatttgtattattgaaagatttgtggcatttgtgtcca

SEQ ID NO: 71012 - DNA, 201 bp, Homo sapiens
gcaaggagtaatattgaatattcaaaaataaaatctattccttgacttcaaatcattaaagtagagctgcctatttaagaacttttatttgcacagtcctrttaattttaatgcctaaagcagtgttaatcgcatgacccacgtgaaaagattttaaaaattgctttgttagaaaatgtaatagacttgtcgttaaagttt

SEQ ID NO: 71013 - DNA, 201 bp, Homo sapiens
taaaagaagctgttcaaagatgtatagtttgttttgttttgttgagatggagtctcgctctgtcgccaagctggagtgcagtggcaccatctcggctcackgcaacctctgcctcccgggttcaagcgattcttctgcctcagcctccggagtggctgggactacatatgcccgccaccacgcccggctaattatttgtat

SEQ ID NO: 71014 - DNA, 201 bp, Homo sapiens
ttacctaagaacaagtgtttaactccaatttcttttaattaagttagttcgcatttatgatagagccatacatattgcagaggacaataccatgtgcaatsctaagtaatattttcttatgaggtttagtgtcaggttcttcaggtagaagaagcacaagcagctgcatttagtagacctgggttccaatcctagctctac

SEQ ID NO: 71015 - DNA, 201 bp, Homo sapiens
caccaagatgtccttcaacaggtgaatggatgaataaactttgggaagtccagacaatggaagattatccagtgctaaaaagaaaatgagctataaggccrtgacagtgcatggaagaaccttaaatatatatgactaaatggaagtagccaatccaaaaaggctacatactctgtaattccaaatatatgatattctgga

SEQ ID NO: 71016 - DNA, 201 bp, Homo sapiens
actcctcgaggttttatttatattcccctgttccccaagagcatagaacaaggacttaagcataggttttcctaagtgagttgagttgcatagaatagctmttctcccctaaaggaaaatactgactccacagtgttcttaaaagtcagagctggtaagtttgtagctgtctcttcatattttaatcaaacattatcacac

SEQ ID NO: 71017 - DNA, 201 bp, Homo sapiens
tgttccccaagagcatagaacaaggacttaagcataggttttcctaagtgagttgagttgcatagaatagctattctcccctaaaggaaaatactgactcyacagtgttcttaaaagtcagagctggtaagtttgtagctgtctcttcatattttaatcaaacattatcacactaaaaaaaatcattgttacattttgtca

SEQ ID NO: 71018 - DNA, 201 bp, Homo sapiens
gaattccgctgtgaatccatctagtcttggacttctttttgttggaaaattttttttttcttttttttttttttgagacggagtagttttgctcttgttgmccagactggagtgcaatggtgcaatctcggctcatcgcaacctctgcctctcagattcaagcgattctcctccctcagcctcccaagtagctgggtggga

SEQ ID NO: 71019 - DNA, 201 bp, Homo sapiens
atttgatgcataaattatatcagtagtaaaatattcagagaagaaaaattaatatacaaacattaaattgcttttgattttatatgtttgattctgtgtcyatcttatttttgattttgtaaaatcaatgccaactgcaaagttttttagcttaaataaccagcagtttttctttttacatgtttttacttacaaaacctt

SEQ ID NO: 71020 - DNA, 201 bp, Homo sapiens
ggcttcataaaatgacttagggagggttccttctttctctgtcttgtggagtagtgtcaaaaggattgaaggattggtaccagttcttctttgaatgtctrgtagaattccgctgtgaatccatctagtcttggacttctttttgttggaaaattttttttttcttttttttttttttgagacggagtagttttgctcttg

SEQ ID NO: 71021 - DNA, 201 bp, Homo sapiens
gaggggagtgatgttgcgtggagctgaactgaacttcctctggtctcccaaaagcaagtgcaagcaccagctctgatgagggtggcaggggagcgacataractctgtaagatttctttggttttaaatagccctagtgtggctcagtgagtgagaactcactgaatatagttctcagatgccagctatggaagtaatgtg

SEQ ID NO: 71022 - DNA, 201 bp, Homo sapiens
tagttgagtgtggtggtgtacacctgtagtcccagctacagctgaggtgggaggatcatctgagccctggggaatgttgaggctgcagtgagccatggttrtgccactgcacttcagcctgggtgacagagcgagaccctgtctcaaaaacaaaaaacaaaacacccaaaaaactatattacaatactaaaaccaggatac

SEQ ID NO: 71023 - DNA, 201 bp, Homo sapiens
gacattcacctgcagaagcttataaaagcacatgagatacaggcatcgtagcctactcagattgacatctacttgcagattctggtcatcagtgacttcawtgagcactgagagcagtttcattgaaggagcagtaagggcaaaaactagatcgtagagaactgaagtcaaaataatagttgagatttattgtggatatct

SEQ ID NO: 71024 - DNA, 201 bp, Homo sapiens
ggtaactagagagatagtggtgggggcagggtatattcatagaatggaagagacttgaacatgtttataggttgaagagggagagtcagcagagagaatakagtgaaaatatccaagagaaaaatgagaaaggggataactaatgaaggaagatcacagaggactgtggtcatggacacaaagaaaggttttgccttcagc

SEQ ID NO: 71025 - DNA, 201 bp, Homo sapiens
aggacttgagtatgtgtgcattttggtattcacagtggtcctggaaccagttcccgtagataactgataaatgactatatatacccttggataatgtggtkataatagcactttacttctgttgtcttcctcctgagtgctcataacccctctccaaccatgagaaaaattttaggcaaacccacgttaaaagacattctg

SEQ ID NO: 71026 - DNA, 201 bp, Homo sapiens
cacagtgaattagtctatatagtgtattagttataactcagtgtattcttaaagggtttcctcaattattttaatatttgacctgcaataatctgagaacsattttcattttctatacataatggctttgtagttcagtgttaaagctttggaatcttcagagtgaattgattgataaaagaaaactaatagtgcctggcc

SEQ ID NO: 71027 - DNA, 201 bp, Homo sapiens
gacttgagtatgtgtgcattttggtattcacagtggtcctggaaccagttcccgtagataactgataaatgactatatatacccttggataatgtggtgawaatagcactttacttctgttgtcttcctcctgagtgctcataacccctctccaaccatgagaaaaattttaggcaaacccacgttaaaagacattctgta

SEQ ID NO: 71028 - DNA, 201 bp, Homo sapiens
gacattctgtaaaatcactgactagtactcctcaaaactgtgaaggttatcaaaaacaaggaaagtttgagaaactgtcaccaccaagacagtacccaagraagcatgatagctaaatgtaatgttacaatatcctgtgtaggatgctggaatgaaaaaaaaaaaaaaaggacattagggaaaaattaaggaaatctgaat

SEQ ID NO: 71029 - DNA, 201 bp, Homo sapiens
tttgactagcccttcattcacacactgacagcctagtactccattttatgaggacacaacaatttatttactcatttttatgttaatgaatttttaagacrcttccaccttttatttttattgttgttataaacagtgctcagtaatattcttattcattttcttttgtatattggtaagagtttctgtagggtatacgta

SEQ ID NO: 71030 - DNA, 201 bp, Homo sapiens
ttctgcctcagcttcccaagtagctgggattacaggtgcccgccaccacgcccagctaattttttttttttttttttttttgtatttttagtagagacggsgtttcaccgtgttagccaggatagtctcgatctcctgacctcatgatccacccacctcggcctcccaaagtgctgggattacaggcgtgagccaccgcgc

SEQ ID NO: 71031 - DNA, 201 bp, Homo sapiens
ctggattctgtcagtctgaactttgagatgttcttcctatccctttcttatttttgctcttaacttttctaccctgattctcatatcttctaacctactcrtctgttaccatattatcatatttcaatatttttgaagcagcattgtgaaggtaattgtcttatttcaggctgctataacaaaataccatagactgggtgg

SEQ ID NO: 71032 - DNA, 201 bp, Homo sapiens
acccctataatcccagcactttgggaggcctagacgggcggatcacgaggtcaggagatcgagaccatcctggctaacatggtaaaaccccgtctctactaaaaaaaaaaatacaaaaaaattagctggggtggtggcaggcgcctgtagtcccagctacctgggaggctgaggcaggagaatggcgtgaacacgagaggt

SEQ ID NO: 71033 - DNA, 201 bp, Homo sapiens
attctgtcagtctgaactttgagatgttcttcctatccctttcttatttttgctcttaacttttctaccctgattctcatatcttctaacctactcgtctrttaccatattatcatatttcaatatttttgaagcagcattgtgaaggtaattgtcttatttcaggctgctataacaaaataccatagactgggtggttta

SEQ ID NO: 71034 - DNA, 201 bp, Homo sapiens
aaaaaaaaaatacaaaaaaattagctggggtggtggcaggcgcctgtagtcccagctacctgggaggctgaggcaggagaatggcgtgaacacgagaggtrgagcttgcagtgagccgagatcgcaccactgcactccagcctgggcaacaaaagcaaaattccgtctcaaaaaaaaaaaatatatattagctgggcgtgg

SEQ ID NO: 71035 - DNA, 201 bp, Homo sapiens
ttgccatgacctttgctcttgaccagtccatgtttgctttgactggactacttctatctcttggtagccattgctttgattgtgctttgtcttcaagatcygtagagctgtgtttcatttcctgttacagttctttgaagcagtacgtcaaaatcttgatcccacttgtttacagttttgattgaaagctctgcccttgta

SEQ ID NO: 71036 - DNA, 201 bp, Homo sapiens
tgtttgtgaaagtgactataacttgaacttttttttttaagaggatttgaaagttgtatgggtttttttgttatcttcactttactgcataggaaacaatmtacctcatcatttaaaatgacatgggtgtcggttttgtagacctttggtttttttgtcaggttcaatttcagttaacaaaatgtaaaacatgacattccc

SEQ ID NO: 71037 - DNA, 201 bp, Homo sapiens
aagtagacatacactagaattctctagccagttaggaaacacaagtattttaaacagattgaaaggaaaaactccctatcacttttcacaatggtagttastacttttaatcttcaagatattttgatagacttacacttcttcctctaagtttatgaaagaaccttttagcttcctctatgcatcttttctgaacaggga

SEQ ID NO: 71038 - DNA, 201 bp, Homo sapiens
aagggggaaagcaggtgttattatgaagcattcagaggatttaagaagatttgaaatatagttactatagagcagtgattcctaacccctttttggttttrgatcctttttagactataatgaaagttttgaaccttctctatagaaaaatatataatatgtatacatgggtgtatgttttcataagtttcaatgtattct

SEQ ID NO: 71039 - DNA, 201 bp, Homo sapiens
actgagacttttgtctagaattgtatagaggtaaagagcatggatttacgtaggcttagtagaagaactaattttaaaataaatggtcacatcataagacytaagtcaggttatcaataaatatttataagtgtctgtaacttgcaaggccatgtcaggtaatgttcagcagtccccaacttcaatctagaatggagatgg

SEQ ID NO: 71040 - DNA, 201 bp, Homo sapiens
ggatccaagcagaaattaggtagttgtttaagtcaccttcggacctttgttacccttccacctttctttgaggatatcgataatctctgagaggcagttargaatgtagtggggaaggtcaagttagaatttcggcatccctattggaagggagcggttcttggttcccctactcctcaggcgcacttacagcagcatccc

SEQ ID NO: 71041 - DNA, 201 bp, Homo sapiens
gggagaaaagttgagctgcttcaattgtgtcagtaatgtttcatatcttagggtgggtgatgggaatataggtgctgatttaatatagtctgtactttttstgtacctaaatatttcgtgataatttttaaaagatgggccttaaaccaatacagtcatatcatttaactcaattccatgaatttacaatgcaatccacag

SEQ ID NO: 71042 - DNA, 201 bp, Homo sapiens
aaagaaaatgaaaaataattattaattatatatcttctcctttctataaaagtgttaaatttttagataaaagggtatagctgggccattacttttaatgkattttacagtacatgacagcaggttcttaccttttatttatatccttagtacttagcatatgaatagcacatagtagatacccaatcaatatttgttgag

SEQ ID NO: 71043 - DNA, 201 bp, Homo sapiens
ctaaaatgatattagataaatgaagtagacaatgtggaatgataaggatttgttttcaattttttttttttaaagaggcaggagctctctctgtcttccakgctggagtgcaatggtgcagtcctagctcacttcactgtagcgtcaaatttctctgctcaaacgatcctcctgactcagccttctgagcagttggaatag

SEQ ID NO: 71044 - DNA, 201 bp, Homo sapiens
ctgcactctagcctgggcaacacacaccccgtctcaaaaacaaacaaacaagcaaaatcaaaacagtggtagagacatagccatattatgagtgacgttaygtttgaccaagttatagaccaatatcctaatactcattacagtgtaacattgaaatctaaattccctgagctcaagtgatcctccccctgtagcctccca

SEQ ID NO: 71045 - DNA, 201 bp, Homo sapiens
gacctaagtcaggttatcaataaatatttataagtgtctgtaacttgcaaggccatgtcaggtaatgttcagcagtccccaacttcaatctagaatggagrtggctaccaaaaagtatctttggattcctaggacccacagagattgactcagtgggtttgattgttaccctggattcatgggtaacactaaatggttacc

SEQ ID NO: 71046 - DNA, 201 bp, Homo sapiens
aatttcctctgcagtgcttttccctcaggcagacccttgagtgattgtcttttttacctcctccaatttccaccattctcattttatgtgttcaagttaamtgtgaacaacagcaaacagctacactctgtaaaacataccatttctttccttgagtcaatgcattcacttttctggtaaatgattttgggggcctgcaga

SEQ ID NO: 71047 - DNA, 201 bp, Homo sapiens
aatggcgtgaacacgagaggtagagcttgcagtgagccgagatcgcaccactgcactccagcctgggcaacaaaagcaaaattccgtctcaaaaaaaaaawatatatattagctgggcgtggtggcacattcctgtaatcctcgctacttgggagactgaggcagaagaatcgcttgaacccaggaggcagaggttgcagt

SEQ ID NO: 71048 - DNA, 201 bp, Homo sapiens
ggtatttggttttctgctgctgcattagtttgcttaggataatggcctccagcttcatccatgctgctgcaaaagacatgatcttgttttttatggctgcrtagtattccatggtatatatgtaccataatttctttacccaatctactattaatgagcatctagattgactccatgtctttgctattatgaatagtgcta

SEQ ID NO: 71049 - DNA, 201 bp, Homo sapiens
taatcaaatgcgaaaacaattggttggtcagatttggtctgtgcctatagtttgcctaccccagttttaagataccgtaatatccctttgatctgtggtcstatatgtcttttgaatagcaataatttggaaagggggcttgacttttgaaaggaaaagaaagttaatgctttgggaatgtctggcttatatattagctgt

SEQ ID NO: 71050 - DNA, 201 bp, Homo sapiens
ttggttggtcagatttggtctgtgcctatagtttgcctaccccagttttaagataccgtaatatccctttgatctgtggtcgtatatgtcttttgaatagsaataatttggaaagggggcttgacttttgaaaggaaaagaaagttaatgctttgggaatgtctggcttatatattagctgtacattttcccctattgtgt

SEQ ID NO: 71051 - DNA, 201 bp, Homo sapiens
ccagttttaagataccgtaatatccctttgatctgtggtcgtatatgtcttttgaatagcaataatttggaaagggggcttgacttttgaaaggaaaagaragttaatgctttgggaatgtctggcttatatattagctgtacattttcccctattgtgttgcctatgtctagcagataataaagtcttatgaaatcattt

SEQ ID NO: 71052 - DNA, 201 bp, Homo sapiens
ggttttcatggcaaaatttaaggaaatttgatactttgaaccatattgtaagtaaggctaagtaaggaactgactgttaatctggatgcatctgttgaccyatgctgtttgaagcttctgaaaatcttctaccagacatcacattcttgctcttttcagcaaatatttatgtatcacacacccgttagtttaatttataac

SEQ ID NO: 71053 - DNA, 201 bp, Homo sapiens
ttaaattgatatagttgaaactctaaagatacaactgcaagaatatatgtgggcaaatttttgaactattttgtggataaagggaaaaagggtaggaatcrgatgtttttcatcagtttttaggagtaattacaaagctaacaggaaaatatgtctcccttctaagataaaaggaacctgaatatttgtccctaatattag

SEQ ID NO: 71054 - DNA, 201 bp, Homo sapiens
tgtgatattggaaatgatttattcaaaatgcatttgtttatggaagaacaaacttctttcctagggatagagattgtattctataggtaaatttattactrtaatattaacctgttttatttggagtgatatgtaatgtttgtgttcacattttttaattgacaaaaattgtgtgtacaatgtgatgttttgctatatgta

SEQ ID NO: 71055 - DNA, 201 bp, Homo sapiens
atatgtaatgtttgtgttcacattttttaattgacaaaaattgtgtgtacaatgtgatgttttgctatatgtatacacataaaatgataacataaagctamctgacgtatctggcacctcacatatttgacactttttgtgtgatgaggacatttaaaatctactgtcttagcattttcaaatatgtaatacattattatt

SEQ ID NO: 71056 - DNA, 201 bp, Homo sapiens
aatgtttgtgttcacattttttaattgacaaaaattgtgtgtacaatgtgatgttttgctatatgtatacacataaaatgataacataaagctacctgacrtatctggcacctcacatatttgacactttttgtgtgatgaggacatttaaaatctactgtcttagcattttcaaatatgtaatacattattattaattat

SEQ ID NO: 71057 - DNA, 201 bp, Homo sapiens
tttttcaaaaaatttcttctttcatttatagaatttagggtttcgaggaatgggatgaatagagatgtctatgcttttgttgataacatggtattttgggyttttctcaattgttccatctcttttttgggggcggtgggaacggagtcttgctttgtcgcccaggctggagtgcagtggcgacatctcagttcactgcaa

SEQ ID NO: 71058 - DNA, 201 bp, Homo sapiens
taatagcaattatggtataaatagcattttgtatacaacttttatctattaatacatttggcctaaaaaagttttcagtttttgtaattttttcctcttayacccattaaattatttcatgtaattactgtatagtacttttatctatattggataaaaaccactgatacctgtctgggcatttgagttaatttttatagt

SEQ ID NO: 71059 - DNA, 201 bp, Homo sapiens
gaggccaaaagctaggcctctttcaccaaatgtttagccaagttgtaaatgctaaggaaaagttcttgaaggaaattaaaagtgctacttcagtgaacacrtgaatgataagaaagcaaaacagccttattactgatatggagaaagttttagtgatctggatagaagatcaaaccaactacagcattctcttaagccaaa

SEQ ID NO: 71060 - DNA, 201 bp, Homo sapiens
attgctgaggaaaaaaaaagattccttttgagatgttactgttcattgacaatgcacatggttactcaaggctctgatggaaatgcacaaggagaattaaygtttttgtgtctgctaaaacagtatctattctgcagcctatggatgaaggagtaatactgactttcaagtcttatgatataagaaatacgtttcttaagg

SEQ ID NO: 71061 - DNA, 201 bp, Homo sapiens
ggaacctgaatatttgtccctaatattagaaagcaaatggctcgcaaaaattctcaaagatagtgtgaatcatattcttttataacactggataaaggggraaaaaagtgacatttggggtattaaacctgagatgaacatcctaatccagagagtagctgatctttagacctacaggctgccagtgaggtgttgtcagat

SEQ ID NO: 71062 - DNA, 201 bp, Homo sapiens
gataaagggggaaaaaagtgacatttggggtattaaacctgagatgaacatcctaatccagagagtagctgatctttagacctacaggctgccagtgaggkgttgtcagatgttggagtttaggcatagacaaatgcactgggaagagaacagtgccactggctagtcacttcacttctgggcctcagttttctcatacct

SEQ ID NO: 71063 - DNA, 201 bp, Homo sapiens
ataccatgtttcttgtatcaagcctatcaagacacctaccaggatgttttataagattttctttgacacagaaggggaaagtcagtgtttcttctgtatcrgaacacttaatatatgaaaatgattttgcttcacaaaaactgtgaatataagtgtcttgcacttttatgttttgtccctggaagtctaggtcagatgctc

SEQ ID NO: 71064 - DNA, 201 bp, Homo sapiens
aaaaaaagtgggagtaagtgattggtgtcgcatgctgctgatagattaaatagattgagaactgaggattgaccataggattagtgaccttgacagagcamttcagtgggggagtgttcagaagtgtcatttcaatgggtttaaatgagaatgggaagagaggaaatagaaaatggaaaatgaagagagctcttccaagga

SEQ ID NO: 71065 - DNA, 201 bp, Homo sapiens
agtcttctcacctgggcatcccaaattgccgggattacagatgtgagctactgtgcctggcctgtttccttatttttgttctccacccaggtactctaatmtctcacttggattccttagctgttgtgaaggtattttcaagtgtgggcaattgttcaagctgatatttctgtgaggaaagagcagtagaaaactcctatt

SEQ ID NO: 71066 - DNA, 201 bp, Homo sapiens
ttcaagccattttcatgcctcagccacttgagtagctgggattacaggcatgcaccatcacgcctggctaatttttgtatttttagtagggaagggttttygccatgttagctggctaggctgttctcaaattcctggcctcaagtgatctgcccacctcagcctttcaaagtgctggaattacaggtgtgagccactgcg

SEQ ID NO: 71067 - DNA, 201 bp, Homo sapiens
tatttgaaaatagacatgatttctcttgttatagactatagaacctttaaaaattaatagataatagtatttgaagataagtaaagatattttttaaaccrtactttcaaaatcagttctttaggtgctgggaatgtagccgatcgtgttttggctcagctcttaacagaaatggatgggattgaacagctaaaggatgtg

SEQ ID NO: 71068 - DNA, 201 bp, Homo sapiens
atcttttaatttgttttctctgttcttcattgagaaagttagtattttctgtttttaacttctcactttagctacatgtagttttttcttgggggtgataygtgtttagtagaaggtagttcagtaatatatttactgaatagcaaaacgaacactaagattaaagctcatgttaactactctgatggccttgaggaagta

SEQ ID NO: 71069 - DNA, 201 bp, Homo sapiens
ttcatttctctttcaggtagaactccctgtggaacatgaattttttttaactatacttttgttactactcagatgatatatactgtatcaaaagtgtatgyccttgtcaagttctctaaagtttgtgaaatacaagagaatatgcagtaaaattttaagtctgtttcctttccagatactttttctctgaagaactactgt

SEQ ID NO: 71070 - DNA, 201 bp, Homo sapiens
tgatttaaggatgtgatttcttttatagtcagtatttttaacatatcacatttgagtcttttaaaacttaactgcttccttctttcacatatcagtttctmttccatcagagagaatagtgatatggaatcattttgtctgaatggttggctaaaagtacataccgtagaaggtagaaacttaaatacaggataatgaatt

SEQ ID NO: 71071 - DNA, 201 bp, Homo sapiens
taaggtttgatagttaagactccttcatgtgaaataccagatgttttgagtccttgatataaaggtcagaagaaaagaaggatattggtttcataataaaytaacatgtttacagtaatgactatgcagtgtaagctgtggatattttgttatataagaatggcagggggtcctagaactgggggctggaaggcccattta

SEQ ID NO: 71072 - DNA, 201 bp, Homo sapiens
ttgactcaggtaaaaggaaatggaaccccatgcataaatagaaggattgatcttggcagcacagatacttcatctattgaaacaggaaagaaagttgagtrtgtacatacaagtagagggaaaggggtagactcaatggtgatagcatgttgaaagttcttctctgccacatgaacaaactttctttccagtgcttaaaca

SEQ ID NO: 71073 - DNA, 201 bp, Homo sapiens
tgtgcagaagtgttttagtttaattaaagttccatttgtctatttttgcttttgttgcttgtgcttttgaggttttagtcatgaattctttgcccagaccmatgtccagcaatcttccttaggttttctttagtatttttacagtttcagttcttacatttaagtatttgatccatcttgagttctttttttatacagtga

SEQ ID NO: 71074 - DNA, 201 bp, Homo sapiens
ccttctaaatgattgatatatgatgatatgttaggcttatttattgagtcaatgcttcacacctgttctgtgtcacaacacctcccttagaggataaggttttttttttttttaaaaaagcgattctttcttgtaatgccacaggcattataaatctctcaattgaaaaatactgaattaaatttgcttcttatttaaaac

SEQ ID NO: 71075 - DNA, 201 bp, Homo sapiens
ccaatggtttttttttttttttttttttttttttgagtcggattctcaccctgtcacccaggctggagtgcaatggtgcaatctctgctcactgcaacctytgcctcccaggttcaaatgattcttctgcctcagcctcccgcgtagctgggcttacaggcgcccaccaccacgcccagctaatttttgtatttttagtag

SEQ ID NO: 71076 - DNA, 201 bp, Homo sapiens
gccctgaagagggtagactcctctctgatgttgatcatcctgacctcagcagctctcagcagagagggtagctcctctctgcagccggtccctccactggstctgctctgctctggctgagtccagggcttttatgagcctcagaggggaggaagtgcatgccgattggtccatgggcctgcggtaaaggcaccacaagtc

SEQ ID NO: 71077 - DNA, 201 bp, Homo sapiens
atgccgattggtccatgggcctgcggtaaaggcaccacaagtccccactctggtccgcagggctggcagcctggcccccagccttcaggcctgccctgttytgaagatgaggcctcaccagggacctgccctgccccttcccacccaggaacctgtctgcatcctgctgctgcccatcacacccaggctgctcacacccgt

SEQ ID NO: 71078 - DNA, 201 bp, Homo sapiens
atatatagttgattctcattatttgtggttagttatgttctattaaagttgccttgaacaccgttagcaaatactgaaccatttctcctagagggaaataygtatgtgtgtgtatatacatacatgcaacacacacaatatatgtagcgtatgtatatatataatatatatacatacacacacattttacatagattataa

SEQ ID NO: 71079 - DNA, 201 bp, Homo sapiens
gactctgatgtagaaaaagtttcttagatagctaagtctattttgaaatgtatcaggaagagggatgatttttttcaaccacattttaatccatatttgtaaaagtaatatggaactggcatagaaacagatgattacactaatgaaacagaagagacaggtcaaaaacagaaccatggtggggaaaaggaatgttgctta

SEQ ID NO: 71080 - DNA, 201 bp, Homo sapiens
actttatataatcagtttgtaaatacatttcaaagctcttcagttggtaagctgatagaattgtattactgtttagccacggaaggtaaacagtttttttwaataaatttaaataaaaggaattaatttttttagatcatgaaatgctttattatttggtgtttttgatggatggccactttacatagaaatttgtttttt

SEQ ID NO: 71081 - DNA, 201 bp, Homo sapiens
accatgtgaactccacagagaacaaggacttaaaagtgacaggtataaccacagagctaatagaagaaaatgtaagagaatatttttctgatctttttttwaaaaaaaatatatatatatatattattttgagacacagtcttgctttgtcatccaggttggagtgcagtggcacgatcacggctcactgcaccctcaacc

SEQ ID NO: 71082 - DNA, 201 bp, Homo sapiens
aggcgtggagcggtgagggttgtgtgggcaagtgagcccaggttcctgccactatgcacagtcaggcacacaagctgctgcatggggtgggcagctccagrcactgataacaggtgctggctccatgcaaggctgtggctggaccagatgtactgcacacatcttccactctgtgcacccgtgactggacgaggggaacac

SEQ ID NO: 71083 - DNA, 201 bp, Homo sapiens
gaggcgtggagcggtgagggttgtgtgggcaagtgagcccaggttcctgccactatgcacagtcaggcacacaagctgctgcatggggtgggcagctccasgcactgataacaggtgctggctccatgcaaggctgtggctggaccagatgtactgcacacatcttccactctgtgcacccgtgactggacgaggggaaca

SEQ ID NO: 71084 - DNA, 201 bp, Homo sapiens
ctgtacctgtttatctcgtttaatttttattctatctcatatgaggtagatgttgttatgcccattttactgttttttattatctatctagtattcaaagrttcataacatcaaaaaagtcataataactgttacaatagctactgtagatccttatttttgacactaccctttactctgttttacatatcattttatttg

SEQ ID NO: 71085 - DNA, 201 bp, Homo sapiens
ctaatcctttgtcagttatatgttcacacatatcctctcccagtcctatttcttatctttatactttgtttatgttccatgtggccttttattgtaggagygtttaacatcatcagatttatcagtctgtttccttatgatttgtgggttttatgtcttcctaaagaaatccttcagtacacacaaaatcatatagtcttt

SEQ ID NO: 71086 - DNA, 201 bp, Homo sapiens
ccatttaaataacgttaatagaaacagattttgaagcctctaacatcatggtgcattaagagcataagagaaacgagccgggcgtgatggcttacgcttgyaatcccagcactttgggaggctgaggtgggcagatcatgaggtcaggagttcaagaccagcctggcgaacacagtgaaatcccgtatctgctaaaattac

SEQ ID NO: 71087 - DNA, 201 bp, Homo sapiens
atattgttaactgtagtcatcatgacatacaataggtttcttgaacttattgctcctgtctaactgaaattttgtgccctttggccagcactacctaatcyctctgctaaccaccatttactctctctgagttcaacttttttacactccacatataagtgagatcatgggatatttgaatttctgtgcctggtttatttc

SEQ ID NO: 71088 - DNA, 201 bp, Homo sapiens
atagtgctacaataaacatgggagtacagatagctctttgatatactgatttcttttcttttcttttagatatatacccagcagtgggtttgctagactayataatagttatattttttattttttgaggaccctctgtgctgttttctgtaattgcttatagaaattgactagttgacattcccatgtagaaaaagggat

SEQ ID NO: 71089 - DNA, 201 bp, Homo sapiens
agaaacctagggtgagaatacctgtgttaactgtttttaaaaatttccatgacatgtttggtcaggggagaagaatgttctgtgacaagtgccagttttaytggtgaggtagaaaaggccttagaaggtgctagtaagacagaaaaagaactgtaggaagaaatcagtatcggagagcacagagatcctcaatccttggat

SEQ ID NO: 71090 - DNA, 201 bp, Homo sapiens
atatcttcccaataacaaccacatgtatctgattatcaaagaattttcctcttgattacttttgtcattcagatatttattaattcttccattatctcagygggcaattgagtcatgtcctagcttcctcttttaggtggaaacttgacaggcctagaatgtccacagtggctcacctatatgtctggcttatctgggact

SEQ ID NO: 71091 - DNA, 201 bp, Homo sapiens
gaggcacttctgtggatctgcagaaatgctgacattcatgtagagagggattgtgaacctaccccaaagtgctccagaaaggccatccataggtgcacccmagccaagctcctgtggaggagtcccagccacgtctgcagtgataggcaaagggtagaagtccccttctccaggtcccttcacgagcactggggctgccca

SEQ ID NO: 71092 - DNA, 201 bp, Homo sapiens
atttaagtaaaagaggacactccaacaaaactagtattcactgcacctctgagcatagcacacatcctttctgagttcaggtgggtacaattagctgctastaaaaatgaaccattagtgaagtcagtgaatattaaatgtgggacttacaaggctaggaatgacaaataatgggaaaaaacattttgtactctaatttta

SEQ ID NO: 71093 - DNA, 201 bp, Homo sapiens
cttgtagaggcatttgctccattgttgagggttggtactgtctaaagttaaaccatttcagtgatgcctagcatggaacacttgacaaccaaccttccagstaggaaatgagacgtccttgccagcaagtccatataatactacaatttttatgactagactatttttgcagaagtacttattgcttaattgacattaaac

SEQ ID NO: 71094 - DNA, 201 bp, Homo sapiens
aagaagttcatgcatttattaactggaaaagtagattacaaaactataaataacacaacatttatgtaaaactatgtatgttacaatggtctggaaaattrttccccaaactgctaacagagccatcacgtttattatttttactttttttttttttttttaaagaaacaaagcctcactctgtcacccaggccagagcac

SEQ ID NO: 71095 - DNA, 201 bp, Homo sapiens
agccttaacccccagcaagggcaagacctctggaacatcatcttctagttcagattctggttcagagtcagaggtgaatgcttgatgtcatcgagcacccyggagtgtgctgtggatttctaaaagacagtaggcctttttgcaggaagaggttgtccaggccctgggctgtcatcacagactgcaggtgctactggatgg

SEQ ID NO: 71096 - DNA, 201 bp, Homo sapiens
atagcgttcatttatttagtacatattgtaaaccagaaattatgctgattattttaatatgcattatctcatttaatccttacagcaacccggagaggcarctagaattaacacattttagaggtgaagaaaatgaggctaagagaagccaagggacttggctaataaatgttacacacttagcaaatggaaaattcagga

SEQ ID NO: 71097 - DNA, 201 bp, Homo sapiens
agagaagccaagggacttggctaataaatgttacacacttagcaaatggaaaattcaggatttcaaaccagatatgattaacataagccatgtctcctctyactattaaccataactggtagaacatatacataacttaaatttgataggtaagctgattggaggctatttgttgtggtacgaatgtttgaaaattgctgt

SEQ ID NO: 71098 - DNA, 201 bp, Homo sapiens
ttttctttctatctcaattcctttttgaatgaaatttagaggtgaaataaatattacaatgtcatgtctgtaatacttttaaaaatatttgtaaaagtttwacaattggaatagcaaaaataacaccttctgtgtgtcaggcactgtgcatagtaaacaaagatatattagatgggctcctcgttatgtatcaactcatta

SEQ ID NO: 71099 - DNA, 201 bp, Homo sapiens
cttgatcattcttatcagtaaagcacatgctatctaggaggtaaaatatgtggcaagactaacatacattcttaaaagtaacataacttatgagcaaataygggactgagactatactatatatacctaaactctgtagttagatataaatggtctcttgtttataacgggtactaataaaattcttattttcaaattagc

SEQ ID NO: 71100 - DNA, 201 bp, Homo sapiens
tatgcatcatattccttagttcccaaacatgttcccttatttcttttcatgtaacttttaattactcatttgtccgagtctgaatcctgaatattaccctwgataccattttgtttcaccacccctctccaaatgtagctttaagtttttcctgtttctttttctactcccagaacccacaattatagctctgaagtatcc

SEQ ID NO: 71101 - DNA, 201 bp, Homo sapiens
tatgttttaaaaaatcttatgtttaaaaaatcttaagtatagacaagaaagttaacttccagttgggaaaatcagtcattttagtctgcttaaatccttcmgttgcaactgtaagattttattattaatagtaatgttagagctccttctagtggaaattattttatgtgcaactattatttttttaaaagcaaaattggt

SEQ ID NO: 71102 - DNA, 201 bp, Homo sapiens
aacaaaagtgtagttcatcttttccaatcctgctgaaaattagggcaagatacagacagaaaaggcatttcttaaaattttaacaacctggaattcattcrtgattttaacaagaatcattttggtggagtgagagggacagatttgagtcagctgagaaaagtgtgacaaatgaggaaccagagacagagcttaaacaat

SEQ ID NO: 71103 - DNA, 201 bp, Homo sapiens
aggagccagcaagtaacaatgcatgaataggaatatctagagaaataagaggtataatgtggagtgtcagaagccaaaagcgaagtgtgttaagaacaaargtgtagttcatcttttccaatcctgctgaaaattagggcaagatacagacagaaaaggcatttcttaaaattttaacaacctggaattcattcatgattt

SEQ ID NO: 71104 - DNA, 201 bp, Homo sapiens
tgaggcacttcaacttttaaatttagccagagggggaggagccagcaagtaacaatgcatgaataggaatatctagagaaataagaggtataatgtggagygtcagaagccaaaagcgaagtgtgttaagaacaaaagtgtagttcatcttttccaatcctgctgaaaattagggcaagatacagacagaaaaggcatttc

SEQ ID NO: 71105 - DNA, 201 bp, Homo sapiens
gtatctaattataaccaatattttatctcttctttgccctgtttaatagattctttgggacttgaagaataaataagcctgatatttacttctcttctgtrtgttcatttaaattacggcacctttgaataagaatttttgtcatattttatattgtaagaggaaatgctgcatgattcttttttcaaagtattttactac

SEQ ID NO: 71106 - DNA, 201 bp, Homo sapiens
aattttttacataacagaatgcattttctttagcgtgatcttggctcactgcaagctccgcctcccaggttcatgccattctcctgcctcagcctcccgartagctgggactacaggtgcctggcaaattttttgtatttttagtagagacaggtttcactgtggtcttgatctcctgacctcatgatccgcctgcctcgg

SEQ ID NO: 71107 - DNA, 201 bp, Homo sapiens
agtagagacaggtttcactgtggtcttgatctcctgacctcatgatccgcctgcctcggcctcccaaagtgctgggattacaggcgtgagcgactgcgtcyggcccagaatgcattttctgtcttagaacattgaaatcattggcagtttgaaagcacaaaacttcagagtagtttgtcaacttttggctttacttaagat

SEQ ID NO: 71108 - DNA, 201 bp, Homo sapiens
atttttagatttagggatactcaacatgtactattcgttcaactctcctataggtttaaaatttttttaaatacaaagttgggaatatgaaaataatttgycttctactagcattttcattggtccttttattttcatctattcagtgtttgtgaggaaagttttaaagtaacaataccatacagcttatgtatgagaaaa

SEQ ID NO: 71109 - DNA, 201 bp, Homo sapiens
tttttagatttagggatactcaacatgtactattcgttcaactctcctataggtttaaaatttttttaaatacaaagttgggaatatgaaaataatttgtyttctactagcattttcattggtccttttattttcatctattcagtgtttgtgaggaaagttttaaagtaacaataccatacagcttatgtatgagaaaat

SEQ ID NO: 71110 - DNA, 201 bp, Homo sapiens
ttcaagatattttgatagacttacacttcttcctctaagtttatgaaagaaccttttagcttcctctatgcatcttttctgaacagggattaaaagatacrtactgtactcagggtggagacttcagcttggcttgtgtgagctcttaatgccctctggcatatatatgtgtttttgtgtagattgtgacatttgacatac

SEQ ID NO: 71111 - DNA, 201 bp, Homo sapiens
cttggcttgtgtgagctcttaatgccctctggcatatatatgtgtttttgtgtagattgtgacatttgacatactgtgtaagtttagtttgttatctgggmcagttacgtaaaatactttccagttgaaatttcctttctgcttctctcttgcttttgtctggagtgctacaatagattaattgccctgggatagctgcat

SEQ ID NO: 71112 - DNA, 201 bp, Homo sapiens
ggccaacaaaggatagcagcagtgatgagcattatccattttaggccagtgagaacacattttgaaaaagactgctgccatccatgatatattaattaatktgtagaaaggtctccatgttactctctgcacaaaaggccattcagtcacacttattttattgtagggtaatttaacagtctttttttgcgtaaacaagca

SEQ ID NO: 71113 - DNA, 201 bp, Homo sapiens
acgtaaagtactctaattaccaatgtcttaacaatctcctagtaatacagcaacaaaatctctattaggagtgtattaaaggctgactgttctgggcatgmctcatagttatgaaggatttcagaggagcagttctgatcttagtattcgcttggtggttttcatggcaaaatttaaggaaatttgatactttgaaccata

SEQ ID NO: 71114 - DNA, 201 bp, Homo sapiens
cccttcctcggatgtgccagcggggcaaaccgcccatctggccatgtgaatcaaaacccagaaacgttgagaggttccaggcagccttttggttacctctytttttctcaaccctgctctttttccaacccccgccctggccaccatggtacacatgctcatctggccactctgttggatgtgtttccatcagactttaca

SEQ ID NO: 71115 - DNA, 201 bp, Homo sapiens
tagaggccccaagttacaaacattcacatttcaggtggtcactacttctctgaccataactgatcactaaagccgctttgtcattaccatgtaagccaccmcaaaacaacaatttatagctcatagaaaaatctatagaagcaggctgggctcgggggctcacacctgtaatcccaggactttgagaggccaaggcgggcg

SEQ ID NO: 71116 - DNA, 201 bp, Homo sapiens
ttgacatgtaaacatgctcatttctcttccatcttaaatcagaacaaaagctccacattttcttcctgcaaccgtctctctatccattgccaagcttcttraatggagtggtctctgccgcctcaccacttacatactctccctagcctattcctctttgacttccaccccatcattccatggaaactgttcctggtgtgg

SEQ ID NO: 71117 - DNA, 201 bp, Homo sapiens
ttgaactagatccttcccattgacatgtaaacatgctcatttctcttccatcttaaatcagaacaaaagctccacattttcttcctgcaaccgtctctctrtccattgccaagcttcttaaatggagtggtctctgccgcctcaccacttacatactctccctagcctattcctctttgacttccaccccatcattccatg

SEQ ID NO: 71118 - DNA, 201 bp, Homo sapiens
gtaactgcacactagtgttagcagtatatatagctcatctaatttctacagaagccgtgaccgatgggtatagtaatgacagttttatagagggaggaaasttaacgtgattccattcaggctacacaggtgctaagtggcagagccgatatttgagtccagatgtgtttgacttaaaagccattcctagatgacagctcc

SEQ ID NO: 71119 - DNA, 201 bp, Homo sapiens
aactgttctaatttattgttagttactgttaatctcttactgtgcctaacttataagttaaactttatcataaatatgtgtgataggaaaaaacatggtawatatacatagggtttggtactatctgcggttacaggtgcccactgggggtcttggaacacatcctgtgcagatagggtggaaccaccgtaatcatttaat

SEQ ID NO: 71120 - DNA, 201 bp, Homo sapiens
aagtaaaattaaatagaatataaattagtattaatagttttgctccaaaatctcaggcagtaaagaggattatctatgatgtcatttcaaacaaatatatatacacacacacacacacacatcagaactgttcataagtatgtttttttcctctacaaatgtatagcggtcctttaatatgttctacaagtggttcatgtt

SEQ ID NO: 71121 - DNA, 201 bp, Homo sapiens
cccaaaggttttacagacgtgagccactgcgcctggcccgagtttatttcttaaaaacttatatttagtaatttttttgtggtcaaaggacatgaagttaraggatagtgtgtttagaactggctttgtaatggacttggtacgtaaaccaaaggaaaaaaaactagcctgctttctttgcctgtttctcaagaaatcggg

SEQ ID NO: 71122 - DNA, 201 bp, Homo sapiens
ggatggtcttgatatcctgacctcgtgatccgcccaccttggcctcccaaagtgctgggattacaggtgtgagccaccgcgcccggccacatccttgtttyttaaacatcaaatggtgacttgaggagttaaacaagttaataaaacaaaagcattaatacttgacatatttctcttatcactaagacatcatgccagtta

SEQ ID NO: 71123 - DNA, 201 bp, Homo sapiens
aaaagttaaaattatcaaaacctacacacacaaacactactcagccttaagacgataaggatgaagacatgaagacctttatgatctgcttccacttaatraatagtaaatatattttatcttctttatgattttattaaccttttttctctagctcactttattataagaatacagtatataatacatataaaatacaaa

SEQ ID NO: 71124 - DNA, 201 bp, Homo sapiens
aactccacagagaacaaggacttaaaagtgacaggtataaccacagagctaatagaagaaaatgtaagagaatatttttctgatctttttttaaaaaaaawtatatatatatatattattttgagacacagtcttgctttgtcatccaggttggagtgcagtggcacgatcacggctcactgcaccctcaacctcctgggc

SEQ ID NO: 71125 - DNA, 201 bp, Homo sapiens
cacataccaatagagtgagggaagaaaatttagaaacatactcatgactattttatgtaccattctttttaatgtacacttttgtgttgtatacaatataytaatacaagaaggcatgtgtatgctttctgactaaacattaaaaaatgggggaaaagtgctcacatagtttttactaatatgaatgaatgatcaaaaaac

SEQ ID NO: 71126 - DNA, 201 bp, Homo sapiens
aaagttaaaattatcaaaacctacacacacaaacactactcagccttaagacgataaggatgaagacatgaagacctttatgatctgcttccacttaatgwatagtaaatatattttatcttctttatgattttattaaccttttttctctagctcactttattataagaatacagtatataatacatataaaatacaaaa

SEQ ID NO: 71127 - DNA, 201 bp, Homo sapiens
ttatcaaaacctacacacacaaacactactcagccttaagacgataaggatgaagacatgaagacctttatgatctgcttccacttaatgaatagtaaatmtattttatcttctttatgattttattaaccttttttctctagctcactttattataagaatacagtatataatacatataaaatacaaaatatgtgtcag

SEQ ID NO: 71128 - DNA, 201 bp, Homo sapiens
tatcaaaacctacacacacaaacactactcagccttaagacgataaggatgaagacatgaagacctttatgatctgcttccacttaatgaatagtaaatayattttatcttctttatgattttattaaccttttttctctagctcactttattataagaatacagtatataatacatataaaatacaaaatatgtgtcagg

SEQ ID NO: 71129 - DNA, 201 bp, Homo sapiens
tcaaaacctacacacacaaacactactcagccttaagacgataaggatgaagacatgaagacctttatgatctgcttccacttaatgaatagtaaatataytttatcttctttatgattttattaaccttttttctctagctcactttattataagaatacagtatataatacatataaaatacaaaatatgtgtcaggct

SEQ ID NO: 71130 - DNA, 201 bp, Homo sapiens
gctcactgcaacctccgcctcccgggttcaagcaattctcctgcctcagcctcccaagtcgctgggattacaggcacccaccaccacgcccagctaatttytgtatttttattagagacagggtttcaccacattggccaggctggtcttgaactcctgacctcaggtgatccgcccaccttggcctcccaaagtgctggg

SEQ ID NO: 71131 - DNA, 201 bp, Homo sapiens
cacttaaaattatgtagtaaacattttacattagaatttgttggcaaaactttttaaatgactacaccaaagacttttatatggataaactgtaattggtygatccttctttagtctcaaatatttaggcttttgtctatttttccataccattgttataaagatatttgtgtgtaaatctttgcatttatgatttttaga

SEQ ID NO: 71132 - DNA, 201 bp, Homo sapiens
ttctgaaggctaaagtagggaaggagtggttgtgctattccgatctgaacttctgtaataggagagtagcaaagcagtgaggagttgaaaggcctttaaaraaaaaaaaagtatatgttcacatggagtccctctgaataagtaccagcaccccaaagtcactaaaattactccccaaatcaagcattcatcactcagaaa

SEQ ID NO: 71133 - DNA, 201 bp, Homo sapiens
tctttcagcattttggaaggcagataaagcaagtgggtatttgtaagatgtcctaaagaagtgacttgctgtctttaggaagcaggggatctatttttggwgtatgtttgtactattcactgctttttcttggtagagaaagatactcaaccctctgttttgtggagttttgtatcttctttttattaatgcttctgttta

SEQ ID NO: 71134 - DNA, 201 bp, Homo sapiens
aaaatgatgtgaatagtctttggtgagccatattaagattaaagctggaaagcctcctgtacggttgttttccaatttcagctttgccatctttacacaaractctcataagtgtttttgttattgttgctggattcttcttttgtttgtttttaaaactccaggtgttttaacttctatgacagttattattcttatctt

SEQ ID NO: 71135 - DNA, 201 bp, Homo sapiens
aatgaaccattagtgaagtcagtgaatattaaatgtgggacttacaaggctaggaatgacaaataatgggaaaaaacattttgtactctaattttaaaaasaactatttaggagacagctgtagctggggtagctttctcttgtagaggcatttgctccattgttgagggttggtactgtctaaagttaaaccatttcagt

SEQ ID NO: 71136 - DNA, 201 bp, Homo sapiens
cactgcactccagcctgggtgacagagcgagactgtctcaaaaaaaaaaaagaagaagaagaaggtttcaagaatttagtttctaaattcaggatgtttcrcaattgagcaaagaatcatgatatttgctagtctttactgtcttgctcatgctaaatcaaattattttgactacttaaaattactgaaaagataagacat

SEQ ID NO: 71137 - DNA, 201 bp, Homo sapiens
ctatatgtttctgaaaaatgcccatcatttcaaaattgtatacattatttattttaaggttgcaggtggattattcttttgactaagtctatattataacyatatacatgtaattttacatcacagtttagtttctggtgtacctaatgctgatttctgttcccttcttatccttttacagtgacaaagatatggaaatta

SEQ ID NO: 71138 - DNA, 201 bp, Homo sapiens
acccaggctggagtgcagtggcactatctcagctcactgcaacctctgcctcccgggttcaagcaattcttgtgcctcagcctcccaagtagcttagtagrgacagggtttcactatgttggcaaggctggtcatgaactcctgacctcaagtgatccacttgctttggcctcccaatagaaaaagtaattttttttgtat

SEQ ID NO: 71139 - DNA, 201 bp, Homo sapiens
ccttccagcatttgaagctatgtcaccagtggcagtctttttgacttcatataccttccaaataagtagttttattttcaaaaagctgaatgctatagtartggtgtttatcaaatatgttaccaatatttgaagttttgataccatttcttatatgcagattgatcttcgtgtacaagctaaagctaaaccatgctaaca

SEQ ID NO: 71140 - DNA, 201 bp, Homo sapiens
ctatagtagtggtgtttatcaaatatgttaccaatatttgaagttttgataccatttcttatatgcagattgatcttcgtgtacaagctaaagctaaaccrtgctaacaatatttaatgggtatacatcctgtatagaataaaatatttcctgaatttcattttccttttccagaattttatacatacatgctcatggaaa

SEQ ID NO: 71141 - DNA, 201 bp, Homo sapiens
tgttaccaatatttgaagttttgataccatttcttatatgcagattgatcttcgtgtacaagctaaagctaaaccatgctaacaatatttaatgggtatayatcctgtatagaataaaatatttcctgaatttcattttccttttccagaattttatacatacatgctcatggaaacacacacaagcacacctctctgtgc

SEQ ID NO: 71142 - DNA, 201 bp, Homo sapiens
attaggtatgcagtatgcattaagtctatgctatgtgttttacatatgatgtctagttaattttagtcaaatatgagcactttacatgtattttacacaayactagtgcattccttgtttaattgtgcaagtttagaagtacggtgtgtgtttgttctttcttaaaaaaattatgacgtatcatcagccagtgtagtagct

SEQ ID NO: 71143 - DNA, 201 bp, Homo sapiens
ttgacacagttaactccagctttttttttcttttccttcttttttttttttttttttttttgagatggagttttacccttgttgcccaggctggaatgcartggcgaggtctcagctcactgcaacctacgcttcctgggttcaagcgattctcctgcctcagcctcccgagtagctgggactacaggcgcccactaccac

SEQ ID NO: 71144 - DNA, 201 bp, Homo sapiens
tgttttacatatgatgtctagttaattttagtcaaatatgagcactttacatgtattttacacaacactagtgcattccttgtttaattgtgcaagtttaraagtacggtgtgtgtttgttctttcttaaaaaaattatgacgtatcatcagccagtgtagtagctttattcataatttaagtgatactgtttcattttta

SEQ ID NO: 71145 - DNA, 201 bp, Homo sapiens
acattccatttaaataacgttaatagaaacagattttgaagcctctaacatcatggtgcattaagagcataagagaaacgagccgggcgtgatggcttackcttgtaatcccagcactttgggaggctgaggtgggcagatcatgaggtcaggagttcaagaccagcctggcgaacacagtgaaatcccgtatctgctaaa

SEQ ID NO: 71146 - DNA, 201 bp, Homo sapiens
aagacctgtttgtaatgtttatagcaactttatttataacacctaaacaacccaaatgtctacctacgtgaatgaataaataagttgcaacatgtccatayagtgaaatactactcagtcatgaaaaggaacaaattattgatatatgcaaagatggataaatttcaaaagcattatgctaagtaaaaatagtcagatata

SEQ ID NO: 71147 - DNA, 201 bp, Homo sapiens
atgctcataccttgttccttctaccactgtaccccaacctttccaccttacttttattagtctcttgtttcttcttccaattttttaacacaaacaaaaawtatgcaaatatatatgcaaatataaatatatgtttatgtgtgtgtatatataatatatattatatataattatattatatataatatatatattatatta

SEQ ID NO: 71148 - DNA, 201 bp, Homo sapiens
agacctgtttgtaatgtttatagcaactttatttataacacctaaacaacccaaatgtctacctacgtgaatgaataaataagttgcaacatgtccatacrgtgaaatactactcagtcatgaaaaggaacaaattattgatatatgcaaagatggataaatttcaaaagcattatgctaagtaaaaatagtcagatataa

SEQ ID NO: 71149 - DNA, 201 bp, Homo sapiens
gaacaggctgtggaatggcccttaaaacatccagagtctttcattcgaatgggtattcagccacctaaaggagttcttctctatgggccacctgggtgctmtaaaacaatgatagcaaaggctttggccaatgagagtggactgaattttctagctataaaggtaggatgttaaattttttaatcgctactctctcttggc

SEQ ID NO: 71150 - DNA, 201 bp, Homo sapiens
gtttcaacatacgcaaatcaataaatgtaatccatcacataaacagaaccaatgacaaaaaccacatgattatctcaatagatgcagaaaaggccttcgaraaaattcaacagccgttcatgctaaaaactctcaataaactaggtattgatggaaatatctcaaaataataagagctatttatgacaaacccacagccaa

SEQ ID NO: 71151 - DNA, 201 bp, Homo sapiens
ttcttcttctgccagtttgattactgtgtgttgagagtgaaagcctgtctgacaattggttcccttcctcggatgtgccagcggggcaaaccgcccatctsgccatgtgaatcaaaacccagaaacgttgagaggttccaggcagccttttggttacctctctttttctcaaccctgctctttttccaacccccgccctgg

SEQ ID NO: 71152 - DNA, 201 bp, Homo sapiens
tcactacttctctgaccataactgatcactaaagccgctttgtcattaccatgtaagccaccacaaaacaacaatttatagctcatagaaaaatctatagmagcaggctgggctcgggggctcacacctgtaatcccaggactttgagaggccaaggcgggcggatcacaaggtcaggagatcgagaccatcctggctaat

SEQ ID NO: 71153 - DNA, 201 bp, Homo sapiens
tactagaggccccaagttacaaacattcacatttcaggtggtcactacttctctgaccataactgatcactaaagccgctttgtcattaccatgtaagccmccacaaaacaacaatttatagctcatagaaaaatctatagaagcaggctgggctcgggggctcacacctgtaatcccaggactttgagaggccaaggcgg

SEQ ID NO: 71154 - DNA, 201 bp, Homo sapiens
ccgccctaggacatacagacagctgcactccttcctctacacagaagaagtcacgttcatattgaggtccttgagtacccatgtttctcttttcattaacwctcagaagttctctaggtcatccctatctcatccaaccattagtgatctggtcaaaactctgtccaagttttctatatctcaagtttcgtagttctccaa

SEQ ID NO: 71155 - DNA, 201 bp, Homo sapiens
gactggctaattatttgtagtgtcctggttacatttccctcagttactggcagtatattgctaagtaaatgtgataggaaagtaagagtggcagaagaagrtgaccttattgactagttcttcagagcatcctttataaataaaaagaaacagagtaatgtttattgaagcaagtgttgaattcaggcagtgtttctcccg

SEQ ID NO: 71156 - DNA, 201 bp, Homo sapiens
catctgtagatggacatttaagttgtttccacatcttggctcttgtgaatagtgctgcatgaacgtgagggtgctaatatgtctttgagatcctggttttrattcttcttgacaaatacccagaagtgggattgctggattaatatggtaattctattttaattttttgaggaacgttcttactcttttccatagcaggtg

SEQ ID NO: 71157 - DNA, 201 bp, Homo sapiens
agagcagcaccaaggggaacattctcccccatggtccaatcacctcccaccaggccccacctccaacactagggattatgatttaacatgagatttgggcrgggacccaaaccatatcatgggttattggggtattttttaaattgagttgtaggggttccttatatattttggagactaacccctaatattggatacatg

SEQ ID NO: 71158 - DNA, 201 bp, Homo sapiens
gagttttacagctttaagtcatatgtttaaatctttaatcctttttgagttgatttttgtatatgatgtaagataagggtccaatttcattgttttgtttktgggtatctagttttcccagcaccatttatttatttatttgttttgttgagtcatctctcctttttctttttttcttttctttttttaaattatacttta

SEQ ID NO: 71159 - DNA, 201 bp, Homo sapiens
ggcaaaataaagacacacctcttcctgaaaacacagacaacacaaattactgtggccagcttcttatattataatttttacatcagctcatccctaactgytaatcacctaatactacaatgtaaacactgccccttccaaagaccaggcttcctttggtggtattctgtgataacctgtcattctgtagtatccttgaca

SEQ ID NO: 71160 - DNA, 201 bp, Homo sapiens
gcttcctgagtagctgggactaccagcatgtgcccctgcacctggctatcaacaggaacttagaaggtggaaggagaaagaggtcaggatatgtattccckctccctccctgccctagaacctcaattctagtattggctgtatccctttataactgtatctcttgtcctttgagccttcaccccacttcttcaacagctt

SEQ ID NO: 71161 - DNA, 201 bp, Homo sapiens
ttacaacctgtctcctttttaccaccaaagttcttaaaagtctagcacacctactgcctctacttcctcactcataattcgcttctcaaaccctggcagtmtgggctttccctccctctgcacactgctaagctgacctcactatttccttctctccaattataataaccagctctaagtcctcagctttcctgacctttt

SEQ ID NO: 71162 - DNA, 201 bp, Homo sapiens
aaagaaaaaggggcatatttccagtgtgttgaagccaacatgcctgggagtatagtgtatcactgaaacactatactctgaaacactgagttagtagggcwggcagttttcaaatcaagatgacacatctaatgttgaacactgtgggttgtaagtacccaacctgagctaaagatgaatatttcacagttatttgcatag

SEQ ID NO: 71163 - DNA, 201 bp, Homo sapiens
agctgacactctcattacctgacacaatgggagacattatgtctgggaataagacatctatttccatagcactgtagtcctgcaaaggagttggaagttaygaatttttaaagattttagaacattatatctttagtctctcataagccaattatttatatctccacatagcccattattaccattgaaaaggcatgcaat

SEQ ID NO: 71164 - DNA, 201 bp, Homo sapiens
tacatatgaaatagggatgaaacacggatgaacaaagaatgttttagaggaatatgatatttaaaatttgaagcatgaaaaatatgtgtttatgggggcayatatagtggaagaataaatgaatagaaaagaaaagcaccaaatactggtgaggaatttcctcaggggagaaaagttgagctgcttcaattgtgtcagtaa

SEQ ID NO: 71165 - DNA, 201 bp, Homo sapiens
taaactttttagttcaaagataggccaaattgtacttttttttttttatgagacagagtctcgctgctctgtcgcccaggctagagtgcagtggcgtgatytaggctcactgcaagctctgcctcctgggtttacttacgccattctcccgcctcagcctcctgagtagctgggactacaggtgcccaccaccatgcctgg

SEQ ID NO: 71166 - DNA, 201 bp, Homo sapiens
gcttttattcatcataaccatacacatttattgttgcataccataagaagcgtaaagctttaaaagccttttctggactaggccacctctaccccctactktgtatggtttacattggtttctatgtgaatcatttgattattgcattcatgttttatctcccaaatactgctagctcccttaggatgaggttattgtttt

SEQ ID NO: 71167 - DNA, 201 bp, Homo sapiens
ctgcactgtgcaaaaacagggagatatcagtcatatagcaaatgaaatagtacagtaattaatatttgtccactcacatagtaggtgctcaataaatgttyccaaccattatgtgccaggctctctattctctgagggagtctcagctatgaggggtgggggaggtatgcaggagagagaaagagagctccgtcacctggc

SEQ ID NO: 71168 - DNA, 201 bp, Homo sapiens
tgatttgcaaggcttagaaatgtaatgaagaaatagctataaaccttgtgtgctttgtgcatcaaggaatttaggtgcatgttgctttcccatttacttaytctttttaggttcttcagcgaaataatgcaaaaaacatagctcatggaattaaagaggaatacttaagcaggaaaaaaaataaagattttaaaaagaaag

SEQ ID NO: 71169 - DNA, 201 bp, Homo sapiens
catgaaaatgtaaaagataaaatagtagagcatgacaataactatttagtctgaaaaatgatttatcattggtggatatttaaaaaatgccaactctgtgrcctttactacatgtataccttctgtggggaagggtactccctaactgaacattttgtgaattgattaatgtttaatattgatttgcaaggcttagaaatg

SEQ ID NO: 71170 - DNA, 201 bp, Homo sapiens
actgaccatcattagtagcctttgtaaaacctttaaaattctattgtgcaccatggggaacagaatatatacaggttgagtatcactaatctgaaatccasagtgctccaaaattcaaaacttttgagtaccaacataacacacaaaggaaatgctcattggagcattttggatttcaaattttcagattacaaatgttca

SEQ ID NO: 71171 - DNA, 201 bp, Homo sapiens
ccatctagatttgtgtaaggacagtctgtctacacaacagtgaaagcacctaacaatgcacttctcagaacatatccctgttgttgagcaacacatgactrtatgttactgcactgtttgtaaattttctgaagttgtgctccattccagtgcagtttttttctatgacaatacaacaaagaagctcctgttcctgtggga

SEQ ID NO: 71172 - DNA, 201 bp, Homo sapiens
atgtgtagttcctgaaatactttaatagcagaatctttcccctccatcaaataaagccgtatgtgggaagcctattatattggatctactttggtggggtscctgtcctgcatgcctcttcctcctgcccgggcatgctgcatcctgtgaggcaccttggagattccacagagcagtttaaaaactgttactgtagcaaaa

SEQ ID NO: 71173 - DNA, 201 bp, Homo sapiens
tgggtgaaaggacacttacagttttagtatcaatgcaatttgatataaactcattagaaagtctaagtttactaagctatgtattaatttaaataggtatracaatagtagagatgaataaaacatcacttcagtatttcatctctcttcatcttgacaagtgaagttcaggtgtggtaatatctattatgtaggggctcc

SEQ ID NO: 71174 - DNA, 201 bp, Homo sapiens
aactttgataagttctatttatatatttatagatatatatctataaaactagtgtatatatgtaaatagtatatatatatgtgtgtgtgtgtgtgtgtgtrtgtgtatatatatataaagagagagagacagagacagagacagggtcttgctctgctgtccacacctcagtgcagtggtgtgatcacagctcactaaggc

SEQ ID NO: 71175 - DNA, 201 bp, Homo sapiens
ctttgataagttctatttatatatttatagatatatatctataaaactagtgtatatatgtaaatagtatatatatatgtgtgtgtgtgtgtgtgtgtgtrtgtatatatatataaagagagagagacagagacagagacagggtcttgctctgctgtccacacctcagtgcagtggtgtgatcacagctcactaaggcct

SEQ ID NO: 71176 - DNA, 201 bp, Homo sapiens
ctgaaggctgagttcatggatgccacctggcactgaggtgggccttgaattcaggaccatagtggtgggtctagagcctgagaccagcctgggtctacagwggctggttcggaatttggggctgcaggtccaagcctggctcttgtgtaggcctagagcctaagtctgcagggatccatcctgggctgtgggggctgacct

SEQ ID NO: 71177 - DNA, 201 bp, Homo sapiens
aaaataatacatcttttacgtgaactttttgaagacccctcatatattaaacctcttaatattgttgttattaagggacctgtgtctctgaggatgtcatktttttttttgtcaatcttttttgtttctatgcttactttgaatggttgttctgtctccaaatttactgatttttttcttcagcttgtaagcttatttagt

SEQ ID NO: 71178 - DNA, 201 bp, Homo sapiens
gaaggaagggtagagacatggagagaagcggtggggatgcttgccccccaggaaagtggagaaggggtgggtagagacatggagagaaggggtggggggcrcttgtcccccaggaaagtggagaaagggtgggaggtgcttgccccccaggaaagtggaaaaggggtagagacacagagagaaggggtgggggtgcttgtc

SEQ ID NO: 71179 - DNA, 201 bp, Homo sapiens
agttgtacatattttgcaggcacatgtgatattttgatgtgtatacaatatgtactgatcaaattgggataattggagtcttcatcacctcaaacattgawcttttcttggtttcgggaacattacaattctcctcttttagttatcttgaaatatgcagtaaattgttgttaactatgatgtctctactgtactactgaa

SEQ ID NO: 71180 - DNA, 201 bp, Homo sapiens
cagaccactgttgtatagcatttcctcagtgatttccccaagttttcttctagtagtttcatagattcaggtcttatgtttaagtgctttttttttttttycttttgagacagggtctcactctgtcacccaggctggagtgcagtggtgtgatcttagcttacttcagccttgaactccagggttcaagcaatcttcctt

SEQ ID NO: 71181 - DNA, 201 bp, Homo sapiens
ctttcagggcttccagatgagcttggaaactgatttacagagataattaagaccatttgccatgaacttccttatgtatccccatcattaacaagacatarcttggctctattattatctgctgctcctttcctacactgtcagagaaggacattttttgcctaaagttaattgttccatctagtttctgtagctcatctc

SEQ ID NO: 71182 - DNA, 201 bp, Homo sapiens
ctgcatccctggtatgaaacccacttgatcatggtggattatctttttagtatgttgttggatttggttagctagtagttttttaagtaaggattttagcwtcagtgttcatcaaggatattggtctgtagttttctttttttggttatatccttttctggttttggtagtagggtgatgctggcttcataaaatgactta

SEQ ID NO: 71183 - DNA, 201 bp, Homo sapiens
tgtgggacattatccttcatatagacctgttttcataaatctgctctgatgaattctgaaatatggaggctactgcattttcaattaaaaatcttaaaggsaatactttaagacaaaagagctaagtaattcaaacaagtattaactaatatggtagtttcatggtatcagaaattcagattacttctgtgccatccctta

SEQ ID NO: 71184 - DNA, 201 bp, Homo sapiens
aagtgatcctctctaatcctttatactctaggttttttttgtaaggatataatgccaaaaattttgaaaaaaagaaaacaggcactgtggctcacacctgyaatccctgcactttgggaggctgaggtgggagaatctcttgaaccaaggagttcaagaccagcctgggcaacatggcaaaaccccatctgtccaaaaaat

SEQ ID NO: 71185 - DNA, 201 bp, Homo sapiens
acctaatttttcttctatttctttgtcctccttgactcctttacatatttattctggtctgcctagccacagaatgttgcagtttgtcaaggctgggcacrggacccatcttctctcatccacatccatggcttcagttgtcagctgtgattcagtgcctaattcagctcagatctttgctctgaccgattcaaccatcta

SEQ ID NO: 71186 - DNA, 201 bp, Homo sapiens
atacttttaactattttttaatgaatatgaatgtaaaaataatgttgagttagaatagaaatatctaactgtatgattaaagttgaatcacttataaattkgaaaaagcttcttgtcttctattgttaatgctcctagaatctcatgtttgagaacgaatgttcagtgtagccaaaacctaaatctggggctatatgttga

SEQ ID NO: 71187 - DNA, 201 bp, Homo sapiens
gtggtgcaatcatagctcattgcaacctcaaactcctgggctcaaaccatcccccacctcagtctcccaagtagcagggactataggtgcaggccacagtkcccagctaatatatatatttttttaatttatgtagatatgaggtctctctatgttgctgaggctggtttcaaactcctggcctcaagcagtcctttcacc

SEQ ID NO: 71188 - DNA, 201 bp, Homo sapiens
tgaggctggtttcaaactcctggcctcaagcagtcctttcacctcagcttcccaaagtactgagatgacaggcgtgagacacgatgccaggttcagttctrtcagttttgataaatgcatagaattgggtaaccaccaacacaatcacaatgcaaaacaatttatttactccaaaaatttattcttgcagccaccactggt

SEQ ID NO: 71189 - DNA, 201 bp, Homo sapiens
cactggtgggatgtcttctttccaccactgacccctggcaactactgatctgtcctgtagttttgcccatttcccaaatgtcatataaatgtaatcatgcmcatgtcatctttgagtataacctcttttatttcacatgttttcgagattcgtctgtgttactgtatcagtagtttgttccttttttattattgggtatta

SEQ ID NO: 71190 - DNA, 201 bp, Homo sapiens
tgaaagttttgaaccttctctatagaaaaatatataatatgtatacatgggtgtatgttttcataagtttcaatgtattcttagatccatctagatatccrtagactctcagttaagaatctttactatgtggccaacaaacacacaaaattagtgaaataccaattgaaatagtatctagttcatgtaacaaagattgct

SEQ ID NO: 71191 - DNA, 201 bp, Homo sapiens
ttccttctgaaactattccaatcaatagaacaagaaggaatcctccctaactcattttatgaggccagcatcatcctaataccaaagcctggcagagacamaacaaaaaaagagaattttagaccaatatccctgatgaacatcgatgcgagaatcctcaataaaatactggcaaaccgaatccagcagcacatccaaaag

SEQ ID NO: 71192 - DNA, 201 bp, Homo sapiens
gaataagctttctacccctttgtctttctcagtttttttctttcatttcagtaacctgaatatttgttcttttgatgttgtctcatagctcccataaaccrttcatttcttttcattccttttgcttttttctcctctgactgtgtattttcaaatagttgggcttcaagctcactgattctttcttccttttcatcagtc

SEQ ID NO: 71193 - DNA, 201 bp, Homo sapiens
tcttaatcctgtctatcattgttggacatttgggttggttccaagtctttgctattgtgaatagtgccacaataaacatacgtgtgcatgtgtctttatascagcatgatttatagtcctttgagtatatactcagtaatgggatggctgggtcaaatggtatttctagttctagatccctgaggaatcgccacactgact

SEQ ID NO: 71194 - DNA, 201 bp, Homo sapiens
accatttttccctcctaggtttgcaggcctgtgatgggaggggctgcagggaaggtctctgatcttccctggagacattttccccattgtcttggcattakcatttggttccttgttacttaagcaaattactgcagctggcttgaatttctccccgggaaatgagtttttcttttctactgtatcttcaggctacaaaat

SEQ ID NO: 71195 - DNA, 201 bp, Homo sapiens
cttacttataaacctggatgatgtagccttctacactatataccatatggcctattgctagatagtataacaatcatctgcagtactttgattttgttttyaaacatcatattaccagcctttatttttatgaaataaagattttttttaaaactatcatttttttctgataataatggccagtatttctgttaacatagt

SEQ ID NO: 71196 - DNA, 201 bp, Homo sapiens
tgaatcttatgtagtttgttttttgtaaccataaaactctcataaagtgactttctgttttcaggtcttcgtctttttttcctaattatatgatggatcaktattgcctataagtgattgttttatctaattagtttgctgttacttgaaatctaaaacaaaaggtattttgttcatttttttgttctttggctatttgaa

SEQ ID NO: 71197 - DNA, 201 bp, Homo sapiens
ttccattggaacatttgttgatgtgtgtggggggtttaaattccacaaatattattaaaatgagcaatcagcagcaagatgttttaaaatattttgtttcmgcatgtaaaatctcgttttattacagaattattttgttaaaggcacagctatgccaggttgctgccagagtgataggatcataacagcccagttaatttt

SEQ ID NO: 71198 - DNA, 201 bp, Homo sapiens
attcagtgcagtgttggagataggattacagtgtagatgcaacaaaattggtcatgagttggtcattgttaaagctgggtagcaggcgagtgatttcactstatactgttctctgtactgttgtatgtgtttgaattttctatcgttaaaaaatattaagaagaaaacaaatagcattatcttttccctaagtgttcacaa

SEQ ID NO: 71199 - DNA, 201 bp, Homo sapiens
aaaaaaaatcaaacctgaaactccccaagcctctagatcttaatacaagttaataagaaatacaggaggcaggagatgttaaataacaccagagggatgcrggaagcaaaataaggaatatgggagactggataggatatataattctgtttcttgaacataaattttaagggaaaagagaaagagaaatcccttagatat

SEQ ID NO: 71200 - DNA, 201 bp, Homo sapiens
aggatagcatcattttgcagcccttcatgaatcaaaagacctggacaatcataagtggctactaacacatgaaaagaagagcagccatacattatgtgcawctcagcaatacctatgaagtacttgttcaaaaaaaaaaaaaatcaaacctgaaactccccaagcctctagatcttaatacaagttaataagaaatacagg

SEQ ID NO: 71201 - DNA, 201 bp, Homo sapiens
aaggatcctgagcagaacaaagtcccacaacctatgtgcacgaatatggcagccgctactacagctcaggcctagggcaagagggaagggacactatgcaracaaggcagtgccctcaagaagtccccaaatcgcaatccactcctgtacttgtgcttacaagggcagagacactctgcctgagttcagatgccagcagtc

SEQ ID NO: 71202 - DNA, 201 bp, Homo sapiens
tgacattcatgtagagagggattgtgaacctaccccaaagtgctccagaaaggccatccataggtgcaccccagccaagctcctgtggaggagtcccagcsacgtctgcagtgataggcaaagggtagaagtccccttctccaggtcccttcacgagcactggggctgcccaactgctggggtagaatgacagtctttcta

SEQ ID NO: 71203 - DNA, 201 bp, Homo sapiens
ttttaaaaccatcatatctcatgagactcattcactatcacaagaacagtgcaggaaagacccacccccataattcaatcacctcccaccgggttcctccyacaacacaagggaactgtgggagttaaaaatcaagatgagatttgggtggggacacagcctcaatgatccatctactgctgttggtggagcgtttaagtc

SEQ ID NO: 71204 - DNA, 201 bp, Homo sapiens
tttgaaaatatttacgatacctgtttttaagatcttgtttgccaattttatcacttcttttatttctatatctatttgtattgaactttttttctccaatrtttttatatttggatcaagtttttgtttatttctttaagatctctaaactttacagaaaatttgcaagaacagtcacaaacatttttttcttcaaccatt

SEQ ID NO: 71205 - DNA, 201 bp, Homo sapiens
ctatctacctcaaagggttgttaggaggattaattactatttataaagatcctaaaacatctaccattaagtgcaacaaaatttgttttattgaaaaaatrtaacaagtatttggtacttaagtttacaaattagtttcatctttgatcaacgcatctatccagtaattagagctggcgttattcacaaaaagcaagctaa

SEQ ID NO: 71206 - DNA, 201 bp, Homo sapiens
ctagaaagttttatgacatggggaaaagttaattaacaatatttaggaatgtccacaaataaaaagctaaatatacgtatctttcgatattcaaatgactrgtattccaaaaataccctcagaagaaaggctacaaatgtttcttcattctccatttttcctagttataactattgctcttctaatattactcttcttagc

SEQ ID NO: 71207 - DNA, 201 bp, Homo sapiens
caatcttccttaggttttctttagtatttttacagtttcagttcttacatttaagtatttgatccatcttgagttctttttttatacagtgagagacaagrgtccaatttcattctcctgtgtatggcaatacaattttcccagcaccatttattgaaaaaggtgtcccttctccagtgtacgtttttgtcataaaagatt

SEQ ID NO: 71208 - DNA, 201 bp, Homo sapiens
tgtgagggggttctagagcccagttgaaaaaaagtgggagtaagtgattggtgtcgcatgctgctgatagattaaatagattgagaactgaggattgaccrtaggattagtgaccttgacagagcaattcagtgggggagtgttcagaagtgtcatttcaatgggtttaaatgagaatgggaagagaggaaatagaaaatg

SEQ ID NO: 71209 - DNA, 201 bp, Homo sapiens
atcattgttactcttgggttacaacctgtctcctttttaccaccaaagttcttaaaagtctagcacacctactgcctctacttcctcactcataattcgcytctcaaaccctggcagtatgggctttccctccctctgcacactgctaagctgacctcactatttccttctctccaattataataaccagctctaagtcct

SEQ ID NO: 71210 - DNA, 201 bp, Homo sapiens
atttgatttatacattatttaatttcctcctgaaaattggaagcaggactttcaggaatagaagtcagtatttttcatttgttttagaatacttctaggtstaatataatcatcagtggtagatgtcagcatgattagggggtgacttaaggtaaagcaaataaaatgtgaatacaaaggaaaattatttgacaatggaga

SEQ ID NO: 71211 - DNA, 201 bp, Homo sapiens
accgacacacatattcttcctatcatctctttctccttccttcccttcttctcttcctcttcacacacacatacctcattttgaatttggcaattatgatyacttacagtaaaggtaagcggaaatacattttaattttcctttgtcatttctctcctccctgtctgctttccctttcctctactgcctttatatagaatg

SEQ ID NO: 71212 - DNA, 201 bp, Homo sapiens
attatgaagattggaaataatatatagggtacttagtaaataatagctattggtgttattctaccactactttttttaaattaataaactgtgtactaccrccattttaattaataaagttcggttcctttacaaataaacattagttttctatccctgctgtaacaaattgccatacacatagtagcttaaaacaacaaa

SEQ ID NO: 71213 - DNA, 201 bp, Homo sapiens
agtataatatatagaaagtctgatccctctttttaaataatatatagaaatccaaactttatcagtgtaaacatactgagtttgaggtgtctatagatcakcttaatggagatgtcatacagattagttttcatttttaaatttctccctatttcattgaaaatatgattcactatataaaattgtaattaatatagatat

SEQ ID NO: 71214 - DNA, 201 bp, Homo sapiens
ctacgttaacattgggttttactgtacattatgcgtagtataatatatagaaagtctgatccctctttttaaataatatatagaaatccaaactttatcartgtaaacatactgagtttgaggtgtctatagatcatcttaatggagatgtcatacagattagttttcatttttaaatttctccctatttcattgaaaata

SEQ ID NO: 71215 - DNA, 201 bp, Homo sapiens
atttaagaagatttgaaatatagttactatagagcagtgattcctaacccctttttggttttggatcctttttagactataatgaaagttttgaaccttckctatagaaaaatatataatatgtatacatgggtgtatgttttcataagtttcaatgtattcttagatccatctagatatccatagactctcagttaagaa

SEQ ID NO: 71216 - DNA, 201 bp, Homo sapiens
ggctttccatccctagcagttcagccctaatatacagcagatgtcacaactgatttcacatatttggagaaataggagtagctgagacagaatttagtctrccttgctcagagacattcacagatagtgtgaaaaccactcatgagtcccctttgcttaaagttaccctggtcatgtttattacagcatgtaaaggtacat

SEQ ID NO: 71217 - DNA, 201 bp, Homo sapiens
ggaagtaatgtgctgggcacatgaacagtctcaccattaagtttttatctaatgtgtttatccttaggatgaggccaaggacaaagtacaaccatcaaagratcccttccaaacctatctttacccattagttaaccccatctagacaggattgtaatttctaagtattcacatgatcccaggtaaatcaacatcaaaacc

SEQ ID NO: 71218 - DNA, 201 bp, Homo sapiens
tggacaggtctgcaggatgtgcagtggcttgggctctgctcttagcttcagaggggagtgatgttgcgtggagctgaactgaacttcctctggtctcccaraagcaagtgcaagcaccagctctgatgagggtggcaggggagcgacatagactctgtaagatttctttggttttaaatagccctagtgtggctcagtgag

SEQ ID NO: 71219 - DNA, 201 bp, Homo sapiens
gaggaaatagaaaatggaaaatgaagagagctcttccaaggagagttgctaatgggaatgaaagcagatatggagacaaggaagggactagattacatctrtaaggtgagaaattacaacgtgtttttatggtggtggtaaagcttgactcaggtaaaaggaaatggaaccccatgcataaatagaaggattgatcttggc

SEQ ID NO: 71220 - DNA, 201 bp, Homo sapiens
ccagcctggtcttaaactcctggcctcaagcaatcctcctatctcagcctcctaaagtgttgggattacaggcctgagccactgtgtctggcctctgtagwtattttaatatgagcagctgcctcatctccccaaacacagattctctagggcagagatcagttcttgtacttcttaaagtctggcaaaacagctgtctca

SEQ ID NO: 71221 - DNA, 201 bp, Homo sapiens
ctgttgggaaagacagacagtaaacaaacacacaaatacacaataaagaagaatgggtagaagtgacaggtttaagagagatttaagtagtgttagccagrtctatgcattagttggatttagaggaagaaatagatacctagaataaatccaaggtttctttgagataattcagagccgttaccaaagatccacctttct

SEQ ID NO: 71222 - DNA, 201 bp, Homo sapiens
caacataaaattaatactggcagacttgaggcacaatagtactggtgatgctgtgagtgagtggtagagaaggagtggtctcttgagcccattgatgaagsctggcggtctggggaagtgaatctaagtccaagtgtacagaattcatacttaacctctttggaaaagggcagactcctccacatcagagctactccttga

SEQ ID NO: 71223 - DNA, 201 bp, Homo sapiens
agatttctttaacagcggttataatagctaacatttattgaatacttaagtggcatgcagtgtcttgaatgcttatgttaaattatatatcttcccaatarcaaccacatgtatctgattatcaaagaattttcctcttgattacttttgtcattcagatatttattaattcttccattatctcagtgggcaattgagtca

SEQ ID NO: 71224 - DNA, 201 bp, Homo sapiens
cctttgaatttggcaactttctctttgcattccctttcctgattctgtagcaatcactgtcttgttcttaatgaactggtactcaaaggtcattcagaaasattcattaaaaccagtagggaaataattctacagacttcctttaaccaacctgtagttttgttttctttcttaatagcctcaggtctcagacacaaccat

SEQ ID NO: 71225 - DNA, 201 bp, Homo sapiens
agagcaaccccaagacacataattctcagattcaccaaggttgaaatgaaggaaaaaatgttaagggtagcctgagagaaaggtcagattacccactaacrgaagcccatcagactaacagcggctctctcgggcagaaatcatacaagccagaagagagtgggggtcaagattcaacattcttaaaagaattttcaaccc

SEQ ID NO: 71226 - DNA, 201 bp, Homo sapiens
cacaattgtacatgcacatgcagcccattttccattcctagatatatcatttacgttttctacatcacctacactcttgggtccagggttatagagcatartaagaagccgaaaagaatgaataccttttgaagaactattttcaagctagtgtacctaattagatgaggaccataggcagtttttccttcagatgccagc

SEQ ID NO: 71227 - DNA, 201 bp, Homo sapiens
ataatccattctctttgtgtatgtatgtatgtaatgaaaatagccaccgtgagctcagtaaacccctccttactaaatgtacacaaaagtccattttcagrtgtttgttatttgtgaaacttggttatgtacaatatcatgaacatataaacttcccccttcatgctcatttgctgtttaccaatatgattccccttgaga

SEQ ID NO: 71228 - DNA, 201 bp, Homo sapiens
cagaagctctaaaatagaaggctcaattgttccttaattgaaaatgtaaaacattcaggtagaaataaaaaataaatggaagaattggatgatcaagttgmaagtctcccagaaagtcaaacaaaaagacaaagagatgagaattgtagacatggtaacatctgactaatagaggtctcagaaggaacaaagaaatcagaa

SEQ ID NO: 71229 - DNA, 201 bp, Homo sapiens
acaaggtgtcttatttttgtcttctccacctttatctccctcacaatgcctagcatagcaccttatatagagttattgtcattaaataaacaaatggagaytttacatctcaaatatataaactactttctgtaactttaacatttacctcatgagcccttggataaaaataaattgggactattaaagatgtcttttgta

SEQ ID NO: 71230 - DNA, 201 bp, Homo sapiens
atacaagctttacatctgtacaaggtgtcttatttttgtcttctccacctttatctccctcacaatgcctagcatagcaccttatatagagttattgtcaytaaataaacaaatggagactttacatctcaaatatataaactactttctgtaactttaacatttacctcatgagcccttggataaaaataaattgggact

SEQ ID NO: 71231 - DNA, 201 bp, Homo sapiens
ggggacactgcagtgacagggaggagccgattgggacaggcccttcctgggagcaggcatgcaactcatgatgtggcagtcaggagcaaaaaaaacacctycttttctttaaaatgtaaaaatttgcttactatagtggtttttttattgcaatcttatgaatgtagctctagaagatctttttaaagcaattcattagag

SEQ ID NO: 71232 - DNA, 201 bp, Homo sapiens
ttggtctgaataggtaggcagttcacacagttgttttaggaaaattattatttctttaaaagtcttaaagttaataaacaggagatttaggagacgttaaktaatgcttaagataaaaggtttcatttctctctctctgtttctctgtcttcacacagaaccttctacatggtgtgtgtttaacaagcacttgataaactg

SEQ ID NO: 71233 - DNA, 201 bp, Homo sapiens
ttgttttggtctgaataggtaggcagttcacacagttgttttaggaaaattattatttctttaaaagtcttaaagttaataaacaggagatttaggagackttaattaatgcttaagataaaaggtttcatttctctctctctgtttctctgtcttcacacagaaccttctacatggtgtgtgtttaacaagcacttgata

SEQ ID NO: 71234 - DNA, 201 bp, Homo sapiens
ggcgtgagccaccatacctgtccttaaaccatattttagtagttatttaaggaagttacaaaaaaaattccttttgatataatgagtgcaaattatttgcrcatttttgaaaagagaatagtcatcttttattcacctgataattgctgagaagggcaaacctcccataagtactgcttttctattttttttttttttttt

SEQ ID NO: 71235 - DNA, 201 bp, Homo sapiens
aggtaccttttgaagagaaattttgttttgatttttgtaaagaccagtttgtccatgtttttcttttatacttctagaagttttatagttttagctcatamatttcaagtttatttttcagtatggtgtgaggtaagggtcaatgttcatttttttcatatggatttctagtattcacagtaccatttcttaagataattt

SEQ ID NO: 71236 - DNA, 201 bp, Homo sapiens
caataaaatactggcaaaccgaatccagcagcacatccaaaagcttatccactatgatcaagtcagcttcatccctgggatgcaaggctgtttcaacataygcaaatcaataaatgtaatccatcacataaacagaaccaatgacaaaaaccacatgattatctcaatagatgcagaaaaggccttcgaaaaaattcaaca

SEQ ID NO: 71237 - DNA, 201 bp, Homo sapiens
gggtgagaaatgctatacttgaacttggacttttttctttgatgtgcaattaaatgattagaaaataggaagttaaggtatttgcagttaaaatgatcacrttagccatgatgtagataaagcaaggaaaaagaaggaaagaataagactgcaggcagaaaaacaactagcacagcagttatgatattctagacaaatgat

SEQ ID NO: 71238 - DNA, 201 bp, Homo sapiens
caagcatgtttcttctatctattaggaaagggttatgaattgagcatttcagaggctatggtaagaagcagggagagaagggggcaagtagagaattgctraatatcaattctttttaaatattgagatttagaaataaaaatcaagaatctgtattttgacttgacttttcaatctattattctaacctcgtagctcatt

SEQ ID NO: 71239 - DNA, 201 bp, Homo sapiens
gatttaatatatacaggaatgttctgggcctctgtaagagctgatccctctatcaggtttctgtgcagacaagcatgtttcttctatctattaggaaaggkttatgaattgagcatttcagaggctatggtaagaagcagggagagaagggggcaagtagagaattgctaaatatcaattctttttaaatattgagattta

SEQ ID NO: 71240 - DNA, 201 bp, Homo sapiens
ttccaaaaaagttttatgtatgggttaggtaaatgtttctggttttatctcattaaatgattggcttttagtatcagcatgaatcaagtataatttgactyacctcatccttaaattcttacttaatttggtaattattgtgtattttatcattttctactagtgtcttagcctgttgatcaaagcttgctgcagttagtt

SEQ ID NO: 71241 - DNA, 201 bp, Homo sapiens
tgtgtgtgcttacttgcgtgcgtgtgtgtgtgtgtgtgtgtgtatcactactactaatactaacataaatatatatatcattactacccacttagctataytctaaagttaaaagatctcaaaatacttcttgtgaaaaggtttactaagcccaaagttctaagagaaaaattatgaaaattggtttcctttgtttaacag

SEQ ID NO: 71242 - DNA, 201 bp, Homo sapiens
cggagagaaggggtgggggatgcttgccccccaggaaagtggagaaggggtggggagagacacagagagaaggggtgggtgagcagccaaagcaggtgtcyccacaattgacttgccaccaagggaatgtgggtgaatgaccaaggcaggcctccctgcggtgatcagacaccaatgaaatgtgggtgaataatcaggcag

SEQ ID NO: 71243 - DNA, 201 bp, Homo sapiens
taaggttacacctactgtaccaataatgattttgtttttaaaaatacaaataaaaatctcccttccttggctttttggaaacagtttctttcccccgtaarttatattgcccatggtttcataaatacacatctcaaatgggttacttatgtaaagggtgtgtgtgcttacttgcgtgcgtgtgtgtgtgtgtgtgtgtgt

SEQ ID NO: 71244 - DNA, 201 bp, Homo sapiens
gagatctgaaggaaacaatatcttaagcataccctctaatccattcccagtacaaccactgggaaagtctgccctacatgtgaccacagtaaaccttttcrcctcccaggaatggtttgtgcactgcttttcttctttgcttataatattcattctgccttttcacagtttctcaatctggtaaatttcccctccttgtca

SEQ ID NO: 71245 - DNA, 201 bp, Homo sapiens
aaaaactctcaataaactaggtattgatggaaatatctcaaaataataagagctatttatgacaaacccacagccaatatcatactgaatgggcaaaaackggaagcgttccctttgaaaaccggcagaagacaaggatgccctctctcaccactcctactcaacatagtgttagaagttctagcctgggcagtcaggcaa

SEQ ID NO: 71246 - DNA, 201 bp, Homo sapiens
gaccaaactccttggcattacataccatatgtaatgtaattatacctgtggattttttttctcaatctaccttcatgtccccatgtttctaagcatcctcwaccagtgcttcccaaaatttttcatgacatgtcacacatggaataataaccagatgataccactgtctgactgcctgaagtctctggcttctctgagctt

SEQ ID NO: 71247 - DNA, 201 bp, Homo sapiens
tttccattacatttgttaacattcactcgagtattttataaagcactggtatgagatatgatgatatgaccccatggatttgaacagtctgtttggaactstaagtatgaacatggtgaagtacattaaaacaaaacaaaacaaacaaaaataaaacaaattaactatgagattgtgaaatggttgtaatatatgtcacca

SEQ ID NO: 71248 - DNA, 201 bp, Homo sapiens
ttgcacagtgctacaggtttttgcagaactgagcaagcccaacattagacagatagcctaaagactgattgatttatttgttttaatacaaatatacgctmacatgttgacatacagaaatctgtttcaaatgaattattttttaaagaacaaagaactttataaccctagtacctaatcctatgcctgacacatagtaga

SEQ ID NO: 71249 - DNA, 201 bp, Homo sapiens
tttacaagaggaagaatttggattagtgctggatacatactgttttgacttgtaaaatgactctttaatagaaatggacaaagaaaatatgctaataaaayaacttaagtatgtgtatgtgtgtgcatgctaaatttttttttcttctgttctcttcattttgtgctcatcatcaattgctgctatttactgtggtgcatt

SEQ ID NO: 71250 - DNA, 201 bp, Homo sapiens
tatggagagggggagtatttttagaaagaatctctttttatgtgtttgttcctgtccaaacttattttctctcaggtggttgtactcattactacttcttygtcaaagaaaactgactctttctcaagtatataggtttcttaatcttagtaatttattttgaaagaagttcacgtcggatttttcaggtcaactaaagaa

SEQ ID NO: 71251 - DNA, 201 bp, Homo sapiens
attgtttagctctatatatctgttggcttcatttgcttttaatatttttttctaatagatacctttctggcttgcacagcaaagttcaattaatgtaaggrtaaaatgtaaattatctaattcagcttatttacatgctgtaagtaatatagtaatgctaactgggctttccttggcttttgtttcattgtgatctgagct

SEQ ID NO: 71252 - DNA, 201 bp, Homo sapiens
actcattactacttctttgtcaaagaaaactgactctttctcaagtatataggtttcttaatcttagtaatttattttgaaagaagttcacgtcggatttktcaggtcaactaaagaaaaggaaaggcaaaacagaatctaaaacatttagatgtattgttgacatttttaatgagtgagcatttacaggtgtgtatgcaa

SEQ ID NO: 71253 - DNA, 201 bp, Homo sapiens
ttgataagttctatttatatatttatagatatatatctataaaactagtgtatatatgtaaatagtatatatatatgtgtgtgtgtgtgtgtgtgtgtgtrtatatatatataaagagagagagacagagacagagacagggtcttgctctgctgtccacacctcagtgcagtggtgtgatcacagctcactaaggcctca

SEQ ID NO: 71254 - DNA, 201 bp, Homo sapiens
atgtcttttgcactctattctgtttccattcttttttttttttttttgtcactttgtgtattcatttggatgctttctagtaaccagtcttccattttaaraatcctctgttctgttttcactaatctcccattaagactatcttttgagttcttaatttttattatagtttttaggtttaggatttccctttgatggttt

SEQ ID NO: 71255 - DNA, 201 bp, Homo sapiens
tctagtaaccagtcttccattttaagaatcctctgttctgttttcactaatctcccattaagactatcttttgagttcttaatttttattatagtttttargtttaggatttccctttgatggttttctaatggattccaagtccctggtgaaattcaactttttaaaaattttgctgtagttcatgtggatttttgtttt

SEQ ID NO: 71256 - DNA, 201 bp, Homo sapiens
ttgcttgagcctgggaggtggagattgcagtgagctgggatcgcgccactgcactccagcctgggtgacagagtgagactgtgtctcaaagaaaaaaaaaagttaccaataagatattttgcatcctttttttcaagctaagtcttcaaaatcaatgtgtatgttacacttgtagcacatcacagtttggactagccccat

SEQ ID NO: 71257 - DNA, 201 bp, Homo sapiens
atccttttgtaagttcttttgtctaaagtttgttaagaggaaagccaaagattattttgttgtatactaaaagctgtaaatattattaatttatgtcctakacttccctatggaaaagggaaactcagtattaccatgaacaggatccattctttatatgagtagttagaagctaattgtaggttattgagatttaattta

SEQ ID NO: 71258 - DNA, 201 bp, Homo sapiens
gctggagtgcagtggcacggtctcggctcactgcagcctccgcctcccaggttcaagcaattctcctgcctcagcctcccgagtagctgggactacaggcrtgcaccaccatgcacagctaatttttgtatttttagtagagacggggtttcaccgtgttggctgggatggtctcaatctcttgaccttgtgatccaccca

SEQ ID NO: 71259 - DNA, 201 bp, Homo sapiens
cttttcgttttcttaaaggtaccttttgaagagaaattttgttttgatttttgtaaagaccagtttgtccatgtttttcttttatacttctagaagttttrtagttttagctcataaatttcaagtttatttttcagtatggtgtgaggtaagggtcaatgttcatttttttcatatggatttctagtattcacagtacca

SEQ ID NO: 71260 - DNA, 201 bp, Homo sapiens
ctgataactaatgatgttaagtatcttttcacatacttacctcacaaaggaagctgtgtggttagcaagtatgttcaaatttttagtccagttactttggrttattttcttattattgaattatgaggattctttatatattttggatacaagccctttgcaaatatgcatattgtgaatattttatcccagtctgtgacc

SEQ ID NO: 71261 - DNA, 201 bp, Homo sapiens
atctttatttcctaagtcctgtatttgttttaggtagaaagaagtgatttccatgattgaaatggagttttgaattctttgataaaatacattttaaggtrtacagaattgtctgcaaagaattaaaacactcatttttaagcaagggaaatatatttattttatgattttcctaattgaatttttgccagctaatttgta

SEQ ID NO: 71262 - DNA, 201 bp, Homo sapiens
gctacagctaaaaaaaataaataaataagcacacacagatgtatgctgagtgttccagtgacttagctgacatgtatgctgtatatcctttgctgtgttcyttcaactattagaaaggaaattttaaaatagcctagaatttattattccaatagggtgaaaaggacaacttcaactttaaaaaaataaccaagctctcca

SEQ ID NO: 71263 - DNA, 201 bp, Homo sapiens
atgcacataggcacctgtaattaaagagccgccttcattttcacacatgaggaaactgaggctgttacagatgtagagacttgcccaaggtcttgaataasttctcagaaagggagtttgttctatgatttgtgttttttaataaagttttaatggacagaccacgatatccaacatggccttggagccatagggttcaga

SEQ ID NO: 71264 - DNA, 201 bp, Homo sapiens
catttaaaaggtcatccaatacgataatttttagtctggagcacacaagcagagttcaggtgaactccctggaattatttgcaaaattgggagtatttttygtatgtatagtttgaggggaatttctgtcaaatgcacataggcacctgtaattaaagagccgccttcattttcacacatgaggaaactgaggctgttaca

SEQ ID NO: 71265 - DNA, 201 bp, Homo sapiens
acagtaatgactatgcagtgtaagctgtggatattttgttatataagaatggcagggggtcctagaactgggggctggaaggcccatttaaaaggtcatcyaatacgataatttttagtctggagcacacaagcagagttcaggtgaactccctggaattatttgcaaaattgggagtattttttgtatgtatagtttgag

SEQ ID NO: 71266 - DNA, 201 bp, Homo sapiens
ttctcacagggtgagaaatgctatacttgaacttggacttttttctttgatgtgcaattaaatgattagaaaataggaagttaaggtatttgcagttaaartgatcacgttagccatgatgtagataaagcaaggaaaaagaaggaaagaataagactgcaggcagaaaaacaactagcacagcagttatgatattctaga

SEQ ID NO: 71267 - DNA, 201 bp, Homo sapiens
atagaagtttcaataaaagagaagacttttaagctgagacttgaacaagaagtggagcttccctgatagacaaagagataaaatgtcattctgagcagagkgagaaatatgtgcgaaaacagggaggcagaaagcagcgtggtgagttttactaactgggtgtttaggtgctcctaagcaagtccaagttcaagtatagca

SEQ ID NO: 71268 - DNA, 201 bp, Homo sapiens
ggacaggccatttgtccccactgccactactcccttacccccattaagaacccatgggtttatatatttttaaatatcttaaaatatgtaaatatctaagkaagttcttcactcctattctatcttatggagaccctttttaaagagtgaattttatagagacataggaaatgttagtttgcattgttttcactttgcccc

SEQ ID NO: 71269 - DNA, 201 bp, Homo sapiens
aaaactcagtaagtaatagagccagaattttgaactatgaataggtaagattaaaaaaaaagacattattttgtaatgtcttgtattatcagacaaggtaycagagacaaggaaaaagaaaggtgcactgaacagccaaagcaggactgacggaactcagaaatgggctgggaccagcctgggagaaagaaaacgcaaggc

SEQ ID NO: 71270 - DNA, 201 bp, Homo sapiens
gcctgtaatccccgcactttaggaggctgaggcgggaagatcacttgaggtaaggcattcgagaccagcctggccaacctggtgaaatctcatctttactraaaatacaaaaattagctgggcatggtggcaagtgcctgtaatcccagctactcggcagagtgaggcacgagaatcgctcgaacccaggaggcagaggtc

SEQ ID NO: 71271 - DNA, 201 bp, Homo sapiens
taccagtcagtatatattcagtgacattttatgtcttgggttagggatttttttcccctcttaaaggagactttttgcttttgacccccaaaagaaatcartgtagaaataaagataactgcaacactgtctttagccttattttgaactcagacctatctactgagtactatctactatctactgagctcaggtctatct

SEQ ID NO: 71272 - DNA, 201 bp, Homo sapiens
tacatactctgtaattccaaatatatgatattctggaaaaaacaaaactatggagactaaaaaagatcagtggttgtcagggattaggggaagggagggakgaataggcagagcacagaggatttttagggcagtgtaactactgtattcactacagtgctgggtacatctcactatatacttgacaatgtaacaatgtag

SEQ ID NO: 71273 - DNA, 201 bp, Homo sapiens
ataaaagtttatttcatgacagtctcaaattagttatgctacatgtgcattatcagcattttattaatagaaatatgcaggtatagagtattcactctgtrgttttcttacaagacttgacactttttagagtattatgtacatgttgcacataggccaagatgatagtcacattcatttggcaaaaactatttagatttc

SEQ ID NO: 71274 - DNA, 201 bp, Homo sapiens
cttttgcccaatgttttggaattgttctatgatatttctgccagttatatatataaagtgcattccttttagtaaggtccagcatgatcatttcttttttyttttttttttttttttttgagacggagtctcgctctgtcgcccaggctggagtgcagtggcgggatctcggctcactgcaagctccgcctcccgggttca

SEQ ID NO: 71275 - DNA, 201 bp, Homo sapiens
ttttgcccaatgttttggaattgttctatgatatttctgccagttatatatataaagtgcattccttttagtaaggtccagcatgatcatttctttttttytttttttttttttttttgagacggagtctcgctctgtcgcccaggctggagtgcagtggcgggatctcggctcactgcaagctccgcctcccgggttcac

SEQ ID NO: 71276 - DNA, 201 bp, Homo sapiens
tcgcaggttcattataagtatatgaggtaatatgtgtgcaacaggaaagaactggcccaaaatgttagtgttgctgggattaagaaaccctgctctgcggmattctctctttgatatttccctgccttttataggaactctttttcacctaagattttccatttatgttttgttcattctttatcatctgctcagagttgt

SEQ ID NO: 71277 - DNA, 201 bp, Homo sapiens
agatgccttccatttgcctacagccacttttgcatagattaattgtactagtttagtctgagttaattttaatttaatccatttgctaaggtcatttgctytttttttttttttttttttttttggagacagggtcttgctgtcacccaggctggagtgcagtggcaagatcatggctcactgcagcccgggttcaggtga

SEQ ID NO: 71278 - DNA, 201 bp, Homo sapiens
tttcaccatgttggccaggctggtgtctaactcctgagcttaagcaatctacctgccttggcctcccaaagtgctgggattacaggtgtgagccaccaccrctgctaaaatcgtattttattttaagtactttaaagtcttaccttttatatttaggtccttatctgaagttttcgacctgacattcagtgtacagtgaac

SEQ ID NO: 71279 - DNA, 201 bp, Homo sapiens
ttctacctttgatttggtctatcaagtaaataaactggcttatttaaaaatatgtcatattcagtgttaactttaaacaaattataaaagaaagtttgttktatgtatctaaggtactcatgtgaataaatgagaaataagtaggcattaacttgttatctcttgtttatttatttgtatatgttttgcttgctcgatcat

SEQ ID NO: 71280 - DNA, 201 bp, Homo sapiens
cccacagcaaagctgttctctggtgtacaattactggagaagttcactaggtcagagtaaaagcgaagaagatgtattttaacatctaatatgcaatgtaytttttgtttcttaatcaaaatgtgaaaaagaacataaaatacagaattttattttcattacaacttaaaccagagtttaacatctataaaatatgcttca

SEQ ID NO: 71281 - DNA, 201 bp, Homo sapiens
catagaagtttcaataaaagagaagacttttaagctgagacttgaacaagaagtggagcttccctgatagacaaagagataaaatgtcattctgagcagakggagaaatatgtgcgaaaacagggaggcagaaagcagcgtggtgagttttactaactgggtgtttaggtgctcctaagcaagtccaagttcaagtatagc

SEQ ID NO: 71282 - DNA, 201 bp, Homo sapiens
agacagcagctaaagtcaaagatacagcaacattttcaaaagttagctttgtacatctcttggctgagtaatgtgaacccacacatggaaagatttaatakatacaggaatgttctgggcctctgtaagagctgatccctctatcaggtttctgtgcagacaagcatgtttcttctatctattaggaaagggttatgaatt

SEQ ID NO: 71283 - DNA, 201 bp, Homo sapiens
caatggagtggcattgtcaaaaggggaaagtgtctaataataagttgaaaacattgtgcagttatacttcaaagacatctcttaaattgtcctgttcaggwtcactgcctctgctattattcatgttctaatttagggcctcgaaattgtattagttgcctaactggaagttgcacttcgttcctgtgcttcttccacact

SEQ ID NO: 71284 - DNA, 201 bp, Homo sapiens
tttcttgcacagtgctacaggtttttgcagaactgagcaagcccaacattagacagatagcctaaagactgattgatttatttgttttaatacaaatataygctcacatgttgacatacagaaatctgtttcaaatgaattattttttaaagaacaaagaactttataaccctagtacctaatcctatgcctgacacatag

SEQ ID NO: 71285 - DNA, 201 bp, Homo sapiens
gatgacctctgcaagtgcaggcaggcagtatccacagctctgcatcaccactcggcgtcaccactgtgcaacccatcagtcctgtggtgcccgttcaagtyacattgtataaatctgtcctacggcatctgtatcctcaccatctaataactttagcacagaatattgtttaagaatgatggagagggaaaagaagacttt

SEQ ID NO: 71286 - DNA, 201 bp, Homo sapiens
gttaagtgacttttcgaaggtctaagtggtagtgatggcactgaaatttagtctcagaactttctgactcaagagtctgagctcttaaccactgtattatrtatatgctcttccatttccctttttgttttttttaaaaaaatagaactagtgtccaatggcttttttcattaattacacaaagttaccagggaagatagt

SEQ ID NO: 71287 - DNA, 201 bp, Homo sapiens
ggagaccttggcctcccaaagtgctgggattacaggcgtgagccaccgtgctggccagaccttgatttttttaggagtaaagagacttcctacctccactstagtcctcttatcagtgatttctttttaaaaaagtaaatgtccttgtgtcttcacttcatcttccttaataagtatttagaggcagtattttcgatatta

SEQ ID NO: 71288 - DNA, 201 bp, Homo sapiens
tgcctcagcctcccaaaatgctggctgtcttggtgtttaatatcataactactgctcttgaatcagaaaacccaccatttttgaagtttatttttttcccscaatgatagtagatgaagtaagcagtttgtagtcctagtactgtactgaaaatttgaaaactagtggtacaccttattgtttagtatgcttttgttgttg

SEQ ID NO: 71289 - DNA, 201 bp, Homo sapiens
ccaattttctttcaggatatccccataatattattattcctaaatagcaaataaagaaaataagccaaatgcaagtcaagtcactttatatcttcctcatycttccattcatttcctcattcgttcattcattaccctccttgtttcttaaacatcaaatggtgccttgaggcattaaacaagttgataaaataaaacaaa

SEQ ID NO: 71290 - DNA, 201 bp, Homo sapiens
acttaacacagtcctaaaaattaccattaattaggaccattaaaagccaaaacatcttcctgccttaggattgggtcctttaattgaagctaggacttaaycctaaaagttcccaatgattaggaccattaaaatccaaaatatcttcctgccctagcctttccttgacctgaaattacctttgctaaaattgacctgcaa

SEQ ID NO: 71291 - DNA, 201 bp, Homo sapiens
tttcactgtgttagccaggatggtctcgatctcctgacctcatgatccgcccaccttggcctcccaaagtgctgggattacaggtgtgagccactgcgccyggccctcctcctctattttttttttacagccctttaaaaatgtagaagctggccaagcacggtgattcacacatggtagttccggcactttgggaggcaa

SEQ ID NO: 71292 - DNA, 201 bp, Homo sapiens
agaatcattgataacatcattgttttggatttatgaaaggaacatagcagtaatgaaagaaactaaattatggaatcttttcaatgatatactcagaggtktttttttttttttttttttttttttgagatggagccttgctctgtcgcccaggctggagtgtaatggcacgatctcggctaactgcaacctctgtctccc

SEQ ID NO: 71293 - DNA, 201 bp, Homo sapiens
tgtgtgcaatgcaatttgacccctattacagattcatataatcactactacaatcaaggtagagcattatatatttgatcaccacaaggaaactctcttgygtactcctttatagttggattctcccatcttcttttctctgtcctctggcaaccactagtctgtgtccatctccacagttttgtcattctaaaaatgtca

SEQ ID NO: 71294 - DNA, 201 bp, Homo sapiens
tgtgtccatctccacagttttgtcattctaaaaatgtcacagctgggcacgatggattgcatctgtagtcctagctactcgggaggctggggtgggaggawcccttgagcctaggggttcgaggctgcagtgagccgtgatcgtactgctgcactccaacctggatgacagagcgagactccatctctaagtaaatacata

SEQ ID NO: 71295 - DNA, 201 bp, Homo sapiens
tactgctgcactccaacctggatgacagagcgagactccatctctaagtaaatacataaatcaaaatgtcacataaatacaatcatgcaatgagtattaaycttccaagattggcttttatcactaagcacgttgttctttagatctagccaagctgtatgtatcaatagttgtacttttttttttttttagaaggaattc

SEQ ID NO: 71296 - DNA, 201 bp, Homo sapiens
ctggagtgcagtggcatgatctcagctcactgcaacctccgctcccaggttcaagtgattctcctgccccagcctcctgagtagctgggattacaggtgckctccaccacgcccagctaatttttgtatttatttatttatttgagacggaatcttgctctgtcacccaggctagagtccaatggcgcagtcttggctcac

SEQ ID NO: 71297 - DNA, 201 bp, Homo sapiens
cacgtggaaaagttatattatggagattcttttgaaggatgttgatagtgtttggctctgtgtccccacccaactctcatgtcaaattgtaatccccgtakgttggaggagactcctggtgggaggtgattggatcatgggggcagatttccccctttcagttctcatgatagtgagtgagttctcatgagatctgatgat

SEQ ID NO: 71298 - DNA, 201 bp, Homo sapiens
ttggacccagtgatgtgcttgaactggctcttcccagtttgcaagaggcatgttctgaagtccaagaatgttgcaagttagtttttaaacagtcagtagcyatgttgggagtatgtatacaatggaaattggcaatcactataaatcagtgctcccctcctcactggagagtgggtagttaaatatttaccaactctctac

SEQ ID NO: 71299 - DNA, 201 bp, Homo sapiens
ttatatgtaaaattatgacagttattatacataatgcagtcagccccccaaatttacaggtttcaaatccgtggattcaacgaatcaagggtcaaaaaaawttttaagaaaaaaaaacagtaaaaaataatgcaacaatcaaaaatttaaatgttaacacaaatgttgacaatacagtatagtaactatttacatggcatt

SEQ ID NO: 71300 - DNA, 201 bp, Homo sapiens
aagtcttaccttttatatttaggtccttatctgaagttttcgacctgacattcagtgtacagtgaacacactcatacatctcctcatgcagatatgcaccrtctaaagatggaggctactagctacatttaactgtttaattttcaactgattataattaaatagaatttaaaattcagttccttagtttcacagtagcca

SEQ ID NO: 71301 - DNA, 201 bp, Homo sapiens
cctaatctctactgtttttatttggctactagctatttagtgtaaccccatttttgtggaaggctggccaagagcacacttcaactcaatagtagtcaaakccagctctactgaacctacatgaacacatgagcacacaaattgtgtggttctgaagtttgtgggggtattttttagttcttgataaatgttcatctgcct

SEQ ID NO: 71302 - DNA, 201 bp, Homo sapiens
ttagggatatgatttccctcttgttctgctgtctctctgtccctcagtgattacaggtagagcatcacttcaataactcttccagtcagtattggtggtgwcagccagtctgacctgaaaagaaaccaataccccttcccaacctggaaatgctggtaatttatttcaccatccccagcttccctatatttttccccatcc

SEQ ID NO: 71303 - DNA, 201 bp, Homo sapiens
gttacaaacattcacatttcaggtggtcactacttctctgaccataactgatcactaaagccgctttgtcattaccatgtaagccaccacaaaacaacaayttatagctcatagaaaaatctatagaagcaggctgggctcgggggctcacacctgtaatcccaggactttgagaggccaaggcgggcggatcacaaggtc

SEQ ID NO: 71304 - DNA, 201 bp, Homo sapiens
gtttgaagtcaggtagcatgatgcctccagctttgttcttttggcttaggattgacttggtgatgcgggctcttttttggttccatatgaactttaaagtmgttttttccaattctgtgaagaaagtcattggtagcttgatggggatggcattgaatctataaattaccttgggcagtgtggccattttcacgatattga

SEQ ID NO: 71305 - DNA, 201 bp, Homo sapiens
gatttaaacgtgtgtggcacttcccccttcgtgctctctctctctctcctcctgccatgtgaagaaagtccttgcttcctcttctccttcagccataattsttagtttcctgaggtctcccggtcatgcttgctgttaagtggaactgtgaatcaattaaacctgtactcttcataaattacccagtctcagtagttcttt

SEQ ID NO: 71306 - DNA, 201 bp, Homo sapiens
attttagatcttctctaatatatactctcaatactataagttttgctttaagtactgctttctctgcattgacaaattttgataagttctattttctttgyatatttatagacaatagaactttgataagttctatttatatatttatagatatatatctataaaactagtgtatatatgtaaatagtatatatatatgtg

SEQ ID NO: 71307 - DNA, 201 bp, Homo sapiens
tgtagaccaatggaattagaattaagagtctggaactaaatccatgaatacatggatttatgaattaatcgaatatccacaaggatactaagaccattcawtggggaaataatagattcttcaattaatgctgctgggacaactggattttcacatacaaaaattgaagttggacccctaccttataccatatataaaagt

SEQ ID NO: 71308 - DNA, 201 bp, Homo sapiens
cacctgagctccacctcctgtcagatcagcggtggcattagattctcataggtgtgggaaccctattgtgaactgtgcatgtgagggatccaggttgtgcrctccttatgagagtctaatgcctgatgatctgagatggaacggattcatcctgaaaccacccgcactcctccgccccctgtccatggaaagattgtcttc

SEQ ID NO: 71309 - DNA, 201 bp, Homo sapiens
tgtgtgtgtgtgtgtgtgtgtgtgtatatatatataaagagagagagacagagacagagacagggtcttgctctgctgtccacacctcagtgcagtggtgygatcacagctcactaaggcctcaacctccctggctcgagtgatcctcctgtctcagcctcccaactagctacaactacagacatgcatcaccaagcttga

SEQ ID NO: 71310 - DNA, 201 bp, Homo sapiens
ctctgctaaccaccatttactctctctgagttcaacttttttacactccacatataagtgagatcatgggatatttgaatttctgtgcctggtttatttcrctttatgtgatgtcctccagggtcatccatgttgtcaaaacataacagactttccttctttttttaggctgaatagtattccattttgttgcacattttc

SEQ ID NO: 71311 - DNA, 201 bp, Homo sapiens
actggtccgtagcatgtcaggaaccaggccacacggtaggaggtgagcagtgggcaagtgagcattaccacctgagctccacctcctgtcagatcagcggyggcattagattctcataggtgtgggaaccctattgtgaactgtgcatgtgagggatccaggttgtgcgctccttatgagagtctaatgcctgatgatctg

SEQ ID NO: 71312 - DNA, 201 bp, Homo sapiens
atccatgttgtcaaaacataacagactttccttctttttttaggctgaatagtattccattttgttgcacattttctttatccgttcatttgttgatggaygcttaggttgatttcatatcttggctattgtgaatagtgctacaataaacatgggagtacagatagctctttgatatactgatttcttttcttttctttt

SEQ ID NO: 71313 - DNA, 201 bp, Homo sapiens
tgccaaccctaatttttttatcttccaacttaatttttttttcctgttggctaatacaactttggcctgtcaaatcatggtagacattctgtgaatagtaycactgtagtagaagccagaatgttttatagaggaaatgtagaacagaaattaaatctggggagtcagataaatagaggtagattaaaaggatctttcata

SEQ ID NO: 71314 - DNA, 201 bp, Homo sapiens
tttatagaggaaatgtagaacagaaattaaatctggggagtcagataaatagaggtagattaaaaggatctttcatattagtgttattgcatttttctcartgtctccaaagagtttgaaatgttgtatacgttatttagaattgtactcagaagataaagtattttaccaacaactgagcttaatttttatagtttatta

SEQ ID NO: 71315 - DNA, 201 bp, Homo sapiens
cttaactaaatactttaacttataagtctaaatactgtcatttagagatgctgattaccttattattaaatatattacatgatgattatactgaggtgtgyttctttgtcacaggtgctaacaaagttattgggtgtgtatctccttctactttacgtcctcttccacccaagtgcatctaattgaatttacatgtttaat

SEQ ID NO: 71316 - DNA, 201 bp, Homo sapiens
aattccaattttcttatccagagataacagctgttaacattttgttatagttcctgtaagatttgtgtgtgtgtgtgtgtgtgtgtgtgtgtgtgtgtgtrtgtgtgtgtgtgtgtatgtatattagagatggagtctcactctgtcgcctatgctggagtgcagcagcacgatctcagcttactgcagccttcacctacc

SEQ ID NO: 71317 - DNA, 201 bp, Homo sapiens
catttttgataatgaggaaaaaccatgtggcctagaaatataaaaaaaattaagaaaaaatgtcatgaatgtattaaatatgtatatactagtctattttmccatttactaacatgaaatatacacaaatctattataaaaagttaaaattatcaaaacctacacacacaaacactactcagccttaagacgataaggatg

SEQ ID NO: 71318 - DNA, 201 bp, Homo sapiens
catatttgatatagtgtattttcatttccatttagttcagcatattttagaatttcccttggtacatctttaaattatcacagtctacctttaagtgttaytataccatgtgtacagtataagaaccttagaacaatatatttctattgttcccctcctggcctttgtgctattgttgtcatatgtttacttttgcatata

SEQ ID NO: 71319 - DNA, 201 bp, Homo sapiens
ttctcaagaaatcgggattgtggtgattacctaccttctgatgtgttttaaaaatattcttaatatttatgaagaaacatcagaaatatcctagttgctgkggatgcgtaatgagttttttatttcacatagactttaggtttcatgtgaggaatgggtttgcatcttactcagttttttattctaatttctgtcaacata

SEQ ID NO: 71320 - DNA, 201 bp, Homo sapiens
ctggcattacaggcacacgccaccacaccaagctaatttctgtatttttagtagagacggagtttcatatgtggccaggatggtcttgatttcctgacctygtgatccacccgcctcagcctcctaaagtgctggggttacaggcctgagccaccgtgcccagcccattatttctttaagtaaattttctgcccctttctc

SEQ ID NO: 71321 - DNA, 201 bp, Homo sapiens
ttgggagaccgaggtgagcagatcacctgaagtcaggagttcgagaccagcctggccaacatggtgaaaccccgtctctactaaaaatacaaaaaaattakacaggcatagtggcacgtgcttgtaatcccagctactcaggaggctgaggcaggagaatcatttgaacccgggaggcggaggttgcagtgagccaaaatt

SEQ ID NO: 71322 - DNA, 201 bp, Homo sapiens
cttttaaaattttctttatgtatttagatgctccagtgttcagtgcatatatatttacaatcactatatccagttaatgaattgactcttatcattatatratgaccttgtctttttttgacagtttttgacttagtctattttgtctaatataagtatagccacccctgctctattttgattgctatttgcatgaaaatt

SEQ ID NO: 71323 - DNA, 201 bp, Homo sapiens
aggaatagaaggaaactttacaaactagttatatacaaaagcctacaacaaatatcaataccaaagctttaatcaaactttatacaaagcaagacaaatayatattcttgatatagatctgactagtccaataagaaaaaaaaagtgaaataaaggtggacagagaaatggtggagcagaaaagagaaactaaaatagata

SEQ ID NO: 71324 - DNA, 201 bp, Homo sapiens
caaagcatcctttgatattatgtatggattaaattaacactgctttccaaatgtggtccacatagaaattctaatgttacaaatttgcctttcttccttgsattttcattataacagttgtgtgcacacataggccttttgcctaatgtctttatcaaatataccccttactccaacaaatttttgcagaaagagatgtta

SEQ ID NO: 71325 - DNA, 201 bp, Homo sapiens
tggcttctttcatgtagtagtatgcatttaatattcctccatgccttctcataacttgatagcttatttccttttagcacagaataatattccattgtctrgacctacctcagtttacccattaacctactgaaggacatcttggttgcttccaagttatgaagactgtgaataaagcttctgggaacatctgtgtgcaag

SEQ ID NO: 71326 - DNA, 201 bp, Homo sapiens
tatgaccattacagctttgagaagataaaatgacttgttccaaattacttttggcagagaaaataacctgaatctcaggtcaagttgtgctctatttcttytgtacatttaaaagtgtggggatcctcttggaattagcctgtgaaatgtatttgcattgaaaggtcaatctcaggaatttcagagcaaaggttttgtttg

SEQ ID NO: 71327 - DNA, 201 bp, Homo sapiens
cagactttcttgttactgtaacgtttatttcttcaaacagatcataaagcaagcagatattatccaggtgtgcaaaagtgattaaccatgtgattttcagaaaaaaaaaaaaaaaaagaaaaagcaatcaatcagcctttaaggctgttgttgtgtaataaaaaccttgcttgacagttgaagtacaccttaactttttca

SEQ ID NO: 71328 - DNA, 201 bp, Homo sapiens
cccggctaattttgtatttttagtagagacgtggtttctccatgttggtcaggctggtctcgaactcttgatctcaggtgatccgcttgccttggcctccyaaagtggtgggattacaggcatgagccaccacacctggccataaagttgaaaagtcttaagttgaatcctaagtcagggactgtctttatcactgaatat

SEQ ID NO: 71329 - DNA, 201 bp, Homo sapiens
acttataaatttgaaaaagcttcttgtcttctattgttaatgctcctagaatctcatgtttgagaacgaatgttcagtgtagccaaaacctaaatctgggrctatatgttgaatgttttaaagtcactagtagaagggcaatttggtggctaattttaaagtacataaagagtattaacaataatgaagtgtcattttgtt

SEQ ID NO: 71330 - DNA, 201 bp, Homo sapiens
ttggggggagtatgggaaggagtgttccatggtcctgtgattaggtctgagtcttttagtgagtctatacccttggactgtgaacttcacaattttctccygttaggtgggacaggatggctagatggagctggagttttttattttcattctcccatgggaaaggctagagagggctgaagttgggtatttctcttcctc

SEQ ID NO: 71331 - DNA, 201 bp, Homo sapiens
aattttgggggcagtgatttgccctgtgaccttactaatatgatgtatctaagaagagttggtttttcagtttgttcagctttttacttgctgttaggacrgagcgaagacttccgagctcttaacgttctggaccagaaattggaacaatgctgtccttttattgtctcttctctacactgcaggcagccatggtgtttc

SEQ ID NO: 71332 - DNA, 201 bp, Homo sapiens
acaattaaaggcctccgatgtaatttattggcagcctgaaatatttactatgcttgtagtaattatgaaagacctcctaaagcttttgccaactgtgtttmtacttgacagttaaactcccacgtggaaaagttatattatggagattcttttgaaggatgttgatagtgtttggctctgtgtccccacccaactctcatg

SEQ ID NO: 71333 - DNA, 201 bp, Homo sapiens
actatgcttgtagtaattatgaaagacctcctaaagcttttgccaactgtgtttctacttgacagttaaactcccacgtggaaaagttatattatggagawtcttttgaaggatgttgatagtgtttggctctgtgtccccacccaactctcatgtcaaattgtaatccccgtaggttggaggagactcctggtgggaggt

SEQ ID NO: 71334 - DNA, 201 bp, Homo sapiens
cagtgattcctaacccctttttggttttggatcctttttagactataatgaaagttttgaaccttctctatagaaaaatatataatatgtatacatgggtrtatgttttcataagtttcaatgtattcttagatccatctagatatccatagactctcagttaagaatctttactatgtggccaacaaacacacaaaatta

SEQ ID NO: 71335 - DNA, 201 bp, Homo sapiens
aggtccccaaatgtcttgttcacatcgctggcactggaagtaccatgttttatagtaaccaccttgtttatatgatttttccatcagactgaattccttcrgaataaagtcattacactgctgacctttatatccataccaccaaagacaatgcttggcacgtaacagatgttctgtagttttagagtggacaaataaaag

SEQ ID NO: 71336 - DNA, 201 bp, Homo sapiens
ggaattatgggatcaggtccttctcaccttgctctctttgtctgatgacatcttttaaaaattgaggtaaagtacataaagtgaaatgtacaaatcttaastgtacatttcatgcgatttgacatatgcatatgcccataacacactttaacattatagaacatttctatcactccatacatttcacatgtgctccttccc

SEQ ID NO: 71337 - DNA, 201 bp, Homo sapiens
tgtaccggcagagtagctacctgcaagaattagtgcccaaaacagttctcattgactttgcaagtactctttggtcccatatattttaaatactggagaaraccatgttaaattaataaattagcgttgtgatttgtatgacaacctcatgtgcatttgattagtgtgagttagaggctattctcctgtggatacactaag

SEQ ID NO: 71338 - DNA, 201 bp, Homo sapiens
gtggtggcagacgcctgtagtcccagttacttgggaggctaaggcaggagaatggcgtgaactcaggaggcggagcttgcagtgagctgagatcgcgccaytgcactccagcctgggtgacagagcgagactgtctcaaaaaaaaaaaagaagaagaagaaggtttcaagaatttagtttctaaattcaggatgtttcgca

SEQ ID NO: 71339 - DNA, 201 bp, Homo sapiens
cttttgatctttgttggtttaaagtctgttttatcagagactaggattgcaacccctgcctttttttgttttccatttgcttggtagatcttcctccatcwctttgttttgagcctatgtgtgtctctgtacatgagattttgagatgagtttcctgaatacagcacactgatgggtcttgactctttatccagtttgcca

SEQ ID NO: 71340 - DNA, 201 bp, Homo sapiens
ttgtctgatgacatcttttaaaaattgaggtaaagtacataaagtgaaatgtacaaatcttaagtgtacatttcatgcgatttgacatatgcatatgcccrtaacacactttaacattatagaacatttctatcactccatacatttcacatgtgctccttcccaggcaatccttccaatcaaattaaaaggctactttct

SEQ ID NO: 71341 - DNA, 201 bp, Homo sapiens
caagtactagttagactccagttgccatcaacacaagaactttgaagaagtactgtcctaattgttgtttttaaagtaattagaataaaaataatggattmttctatttttttaagaagttagtcaggctgtcacattaaattaagtagtataggtgcaaaaccagtctttttaaactattactaccactttttccctagg

SEQ ID NO: 71342 - DNA, 201 bp, Homo sapiens
ataatttcaggctccacttctaatcctagttctattcctattttcaccccatttgcagttacttccctccactgaagtcttaaacccctcaaagttattcstgagggttggaatcaacttcttccacacccctgttaatgttgatattttgacctcccctgaatcatgaattgaccttctcccctgagtcatgaatgttct

SEQ ID NO: 71343 - DNA, 201 bp, Homo sapiens
aagtcccgtactattattgtgttgctgtctatctcatttcttaggtctcttagtaattgttttatacatttgggaactccaatgttaggtgcatattattytaagtgaagtaactcaggaatggaaaaacaaacatcatatgttctcactgatatgtgggagctaaggtatgaggacacaaagtcataagaatataatgga

SEQ ID NO: 71344 - DNA, 201 bp, Homo sapiens
cacattctttcagttttaaaagatgtgatttttaaaaaagacccctttgaatgtaactattatgtggcaagaaagccttgctttggttaggtattttgctrtgtgataaagatcctttggtaaaattcaggaaagctttggaccttaaaaaatcattcccttcctgatgcagtattttattagaagataggtgagttctga

SEQ ID NO: 71345 - DNA, 201 bp, Homo sapiens
atattatccaggagaacttccccaacatagcaaggcaggccaacattcaaattcaggaaatacagagaacaccacaaagatactcctcaagaagagcaacmccaagacacataattctcagattcaccaaggttgaaatgaaggaaaaaatgttaagggtagcctgagagaaaggtcagattacccactaacggaagccca

SEQ ID NO: 71346 - DNA, 201 bp, Homo sapiens
ttttgttggaaaattttttttttcttttttttttttttgagacggagtagttttgctcttgttgaccagactggagtgcaatggtgcaatctcggctcatygcaacctctgcctctcagattcaagcgattctcctccctcagcctcccaagtagctgggtgggattataagcatgtgccatcacgcctggctaatttcgt

SEQ ID NO: 71347 - DNA, 201 bp, Homo sapiens
aaagggtaacttctgggtcactgccatggaaacgggtggtaacttttgagtcattgccatgacatttgtcaactgccatggttctggtggcagtgtcttakgccaatgagcattgagcgcagctagagatcgcttttgttgccatctgctggctttggccagtttcttcactttgccccatgtggactagatcctgttttg

SEQ ID NO: 71348 - DNA, 201 bp, Homo sapiens
cttttttttttttttttgcttgagattactttgactatatggtgacttttatgtttccttatgaattttagggttgcttttcatattttagagaaaaatgmcattggaattttggtagtggttacattaaatctgtagacaattttgggtagtatgaatattttaatagtgttaatttttaaaattcatgaacattagaca

SEQ ID NO: 71349 - DNA, 201 bp, Homo sapiens
tcatacaagccagaagagagtgggggtcaagattcaacattcttaaaagaattttcaacccagaatttgatatccagccaaactaagcttcataagtgaargataaataaaatccattacagacaagcaaatgctgagagattttgtcaccaccaggcctgccttacaagagctcctgaaggaagcactaaacaaggaaag

SEQ ID NO: 71350 - DNA, 201 bp, Homo sapiens
tacagtttatcatatggatatcatgtggatatacagttttcctgacaccattttttaaagagattgtgctttcgtcattgcgtgttcttcggtacctttgyagatcaattgactgtacatgcgtggatttatttctgggctctctatttgtttcatttatttatatgtctgtttttatgccagtatattgctgtcttgatt

SEQ ID NO: 71351 - DNA, 201 bp, Homo sapiens
ttataaaaaaagatttaatttatagaaccaaacttgaacatatgtttaatttagcctaatcagaaggttacagaaaaagttgctgtaaagatagaataaargtattgtactggtctgtttttactgaagttccagaatgtgaggttattagagtcttggcttattgtgtcatgttttcctgaatgcttcctttgaagatga

SEQ ID NO: 71352 - DNA, 201 bp, Homo sapiens
caacgtaccagaatctctgggacacatttaaagcagtgtgtagagggaaatttatagcactaaatgcccacaagagaaagcaggaaagatctaaaattgamaccctgacatcacaattaaaagaactagagaagaaagaggaaacatacaaaagctagcagaaggcaagaaataactaagatcagagcagaactgaaggag

SEQ ID NO: 71353 - DNA, 201 bp, Homo sapiens
tgttactcagatcctttgcccatttttaatcagattgtttgtttttttttgcttttgagttgtttgagtttcttaatatatattttagtattttggatagyagccccttacctcatatatggttcacacatattttctcccattccataggttgtctctttactctgtttcctttgctgtgcagaactttctggtttgatg

SEQ ID NO: 71354 - DNA, 201 bp, Homo sapiens
gaagataggtgagttctgagtatttatagaatctgggttggtgttaaggcatctctgaagtctatacaaagtataagactgtatcttaacaaggactgtaraaactgctgaaagagcccttaaagtttacctaattctgcctctggtttcacaaataaagggtgctgaatccagaaaaatctttctcctggtaagaattca

SEQ ID NO: 71355 - DNA, 201 bp, Homo sapiens
tattgatacaatccattgatcttactcatattttttcagttttacttgtgtgtatgtgtttatttagttttatacaattttatctcatgaaaaggtttgcrtattcatcacagatactaagtaattccatcaccacaaagatccctcatgttgtcttttataatcacacccacctcattcctcccctcatttctaaatttt

SEQ ID NO: 71356 - DNA, 201 bp, Homo sapiens
aaaaaattcaacagccgttcatgctaaaaactctcaataaactaggtattgatggaaatatctcaaaataataagagctatttatgacaaacccacagccratatcatactgaatgggcaaaaactggaagcgttccctttgaaaaccggcagaagacaaggatgccctctctcaccactcctactcaacatagtgttaga

SEQ ID NO: 71357 - DNA, 201 bp, Homo sapiens
gctgaatactgtctactaatattttgttgaggatttttgcatatatgttcatgagaaatattgttctgtagttttcttagaatgtttttgtctgcttttgwtatcaggataatgttggcacggtgaaatgagttgggaagtattctctttagtttttatttgttggaagaaattgtgtagaattagtattatttttccctt

SEQ ID NO: 71358 - DNA, 201 bp, Homo sapiens
gatctttgacaaacctgacaaaaacaagaagtggggaaaggattccctatttaatacatggtgctgggaaaactggctagccatatgcagaaagctgaaamtggatcccttccttacaccttatacaaaaattaattcaagatgtattaaagacttaaatgtaagacctaaaaccataaaaaccctagaagaaaacgtagg

SEQ ID NO: 71359 - DNA, 201 bp, Homo sapiens
ctacagaggcaggcaggcctccttgagctgtggtgggctccacccagttcaagcttcttggctgttttgtttacctaagcgagcctgagcaatggcaggcrccccttccccagcctcgctgccgccttgcagtttgatctcagactgctgtgctaggaatcagcgagactccgtgggcgtaggaccctctgagccaggtgc

SEQ ID NO: 71360 - DNA, 201 bp, Homo sapiens
ggatgagttcatgtcctttgttgggacatggatgaagctgggaaccatcattctcagcaaactatcagaaggacagaaaaccaaacaccacatgttctcastcataggtgggaattgaacaatgagaacacttggacgcagggcagggaacatcacacactggggcctgtcaggtggtggggggctgggggagggatagca

SEQ ID NO: 71361 - DNA, 201 bp, Homo sapiens
tatggtactgagtatagtaacatgccttacaggtttgtagccttgctgtatagtaggccataccatctagattttcataagtagactctttgatgtttgcrcaatgataaaatcacataaagacacatctctcagaatgtatccctgtcattaagcaatgcatggctgtatctagaaaaagtaaaaaaaaaattttttttt

SEQ ID NO: 71362 - DNA, 201 bp, Homo sapiens
gtgatagttacaaactacatcaatcaaaaacactttctagtttaaaacaatttggaactacagaacatacagtaacattttgaatttaaaattactgccartggggaatgtgtttaaacagcatccactcttggaattgctaaactgatttattcatcataggaactggtactacaactgcatatttaattgctctaatga

SEQ ID NO: 71363 - DNA, 201 bp, Homo sapiens
gcaaactatcagaaggacagaaaaccaaacaccacatgttctcactcataggtgggaattgaacaatgagaacacttggacgcagggcagggaacatcacwcactggggcctgtcaggtggtggggggctgggggagggatagcattaggagacatacctaatgtaaatgatgagttaatgggggaagcaaaccaacatgg

SEQ ID NO: 71364 - DNA, 201 bp, Homo sapiens
ttgtaattattttatgttagtatagtcacggactgcataacgatgttttagtcaaggatgaatggtatatactacagtggctctgtaagattataatggasctgaaaaattcctatcatccagtgacatcataaccattgtaaagtagtagtgtaattagtattattatttttaaatttggtgtagcctaagtggatagtg

SEQ ID NO: 71365 - DNA, 201 bp, Homo sapiens
accctgcctttcataccaaccatattcgtttgtataaaatattctggcaaatcaaaactctttgtgaatactttaaatcatataatctatattttgtattytagtatattttgcacactagtcagcttataaatatgtcctgcaatgattctgagcctgatcaggatttctgtatagaaaattcccaaaactgtttttatt

SEQ ID NO: 71366 - DNA, 201 bp, Homo sapiens
gtgcagtggctcacacctgcaatcctagcactttgggaggccaggccaggagaataatttgaggccaggagtttgagaccagcctgggcaatgtagcaagrctctgtctctaagagaaataaaattagccggtggtggtagtgtgtgtctgtagtcctagctacttgggaggctgaagtgggaggattgcttgagtctagg

SEQ ID NO: 71367 - DNA, 201 bp, Homo sapiens
ttaagcaattagattactgcacacctaataatagtagcaaataatgcactttcaatctgctaatatgttaagcacttttcattatctcttccttttacatraggggaatctgaagtttagggaatttaaaacttccacaaagttagtagtcagtagtttatatactagtattaaatctgtttaaatccaaagccggtgaca

SEQ ID NO: 71368 - DNA, 201 bp, Homo sapiens
tggttactcaaggctctgatggaaatgcacaaggagaattaatgtttttgtgtctgctaaaacagtatctattctgcagcctatggatgaaggagtaataytgactttcaagtcttatgatataagaaatacgtttcttaaggctattgctgctgtaatagtagatatgggcaaagtaaacctccttgaaaggagtcacca

SEQ ID NO: 71369 - DNA, 201 bp, Homo sapiens
ggtagatacagcaaaagagctagaattagaagtggagtgtgaagttgggactgaattgctgcaatctcatgaacaaattagaatggatgaggagttatttsttatggctgagcaaataaagtgatttcttgagatggaatctactggtgaagatgctgtgaatattgttgaaatggtaactgaggatttagtatatcgtgt

SEQ ID NO: 71370 - DNA, 201 bp, Homo sapiens
agaggattgactccatctttaaaagaagttctactgtggtttaccctatcaaatagcattacatgctacaaagatatctttcatgaaaggaagagtcagtygatgtggcatactttattgttgtctttttttttagaaattgccacagccaccccagcctgcagcaactaccaccctgatcagttagctgtcatcaacatc

SEQ ID NO: 71371 - DNA, 201 bp, Homo sapiens
cagcatcacattatttatctgtgtgtttgtgaaataatagctttaagtcttctagaggtttgtaagttatggtgtcttcctcttatgcctgcagcgacttrcaagaaacaggtttaatcctggacagctgtatccagctagtgattctctaatgtttgacagcagtggaggtccttaacaatacctgataggggtccttcc

SEQ ID NO: 71372 - DNA, 201 bp, Homo sapiens
tatggcaaaaccccatctctactaaaaatacaaaaaattagccaggcgtggtggtgggcgcctgtaatcccagctacttgggaggctgaggcaggagaatygctcgaacccaggaggcagaggttgcagtgagcaaagactgcaccactgcacttccagcctgggcaacaagagcgaaactccacctcaaaaaaaaaaaaa

SEQ ID NO: 71373 - DNA, 201 bp, Homo sapiens
aatcaagctatactgggggaaaagtgttcctgtagatctctaaggcaaaacactctagtatcaggccataacagcagtcagaaccagaggagaaacaagtyacaggagctgacaaaaaagctaaaggaaagagttacacaaatctgagaagctttcaaaagaaataaatcacagaattgaaaaagcaaaaattctggtaag

SEQ ID NO: 71374 - DNA, 201 bp, Homo sapiens
tggcacatagtcaaggttcaatatatgttagtacttatgattgcaattatacattttttattttaatcattttggagtacagtatttttaatgagctacgyatttatttttgtattttttattggtgtatcatagttgtacatattttgcaggcacatgtgatattttgatgtgtatacaatatgtactgatcaaattggg

SEQ ID NO: 71375 - DNA, 201 bp, Homo sapiens
tgtagcacactaggctggtgaaataattgcttgtgatgtccctaaatccccgaggcttttttctacctcctgcttagatagtgaagagaagttgaagttgmgtcctctagtgttcattttgcgtaagagtgataggatgcggtaggacagatgaagattaatgagattgtgtgatatcaagtaggctcattgtctttagat

SEQ ID NO: 71376 - DNA, 201 bp, Homo sapiens
agttaaatgcccaaacttttggaatttatgttgttcattgttaacaactgctgtgtggcccctttagaagtgtccagtccatgacattttatacatttgtsttgaatcttaaggaaaacatgatcatgtcttctttctcgggtgataagcatgcctcaaaatagttttaattctgtgaatatctttgaattcagtttattt

SEQ ID NO: 71377 - DNA, 201 bp, Homo sapiens
acttattgcaaagcttatggtgagctctacattcagatgctatcattatactttatcagctgataaacattgagcaagctgttcaacctcttgggttttayatcctcaccagctaagtagggataacactatatggttttaagagttcttatgaggtttagtaatatagcctggcagcagtggtgatggtttatataggcc

SEQ ID NO: 71378 - DNA, 201 bp, Homo sapiens
aataattttggtttcaggattattttctattgttgtgttagactcatggaggtagtaaattggcattaattttccttacagtttttctggaagaggaaatrtgcttaatgagctaaataagacataacattttgttttcttacattgttgcaaattgaagttgggttttgttgtttgtttgttttgagatgcaggtctggc

SEQ ID NO: 71379 - DNA, 201 bp, Homo sapiens
aagtccagggaaataatgggacttattgcaaagcttatggtgagctctacattcagatgctatcattatactttatcagctgataaacattgagcaagctrttcaacctcttgggttttatatcctcaccagctaagtagggataacactatatggttttaagagttcttatgaggtttagtaatatagcctggcagcagt

SEQ ID NO: 71380 - DNA, 201 bp, Homo sapiens
ttaatgagctaaataagacataacattttgttttcttacattgttgcaaattgaagttgggttttgttgtttgtttgttttgagatgcaggtctggctgtkttgccaggctgaagtgcagtgtctattcacagatcattaagttgtgcagccttaaacctttggactcaagcaatctcctgcctcagcctcccaagtagct

SEQ ID NO: 71381 - DNA, 201 bp, Homo sapiens
atttgattcgctgatttaggcaagtggttctccaacctatgtaagaagcatttgtagagctcgtgaaaacacagttctggggtctatcctgctgattcctstaggtccagaaggtccaagtggggccccagatttgcatttctaacaagcttgcaggtatgtcattgctgctggtccaagaactgtactttgagaatcact

SEQ ID NO: 71382 - DNA, 201 bp, Homo sapiens
acctaccacattggattgttggatagattcggtaacttatgtgaaggcagagaacacttggaaatcagtggtggtggaggtggtagtgctaatagtgctawtatcaccatcgtcaatataattatttccacagcagcattttgtttctcatatgtcagttacgtcactgtacttattgtcttgttctcatttcagaatttc

SEQ ID NO: 71383 - DNA, 201 bp, Homo sapiens
gtttaactgaaggtttgtatcctttgaccaatttcttcccaactcccttagacctccaggccctgataaccaccattctactttctgcttttgtgagttcractttttaagactccacatataagcaagatcatgcactatttgcctttctttgtctggcttatttcacttagcataatgtcctccaggttgatccatatt

SEQ ID NO: 71384 - DNA, 201 bp, Homo sapiens
ttcaggtttgtttcacatgtttttaattcaggaccaatcacttagagcaaagagtcttaaacattattatatgagaatcacctgtagaatttactaaactmggttactgaatccccctgacaagagtttctgattcagtaggtctgagctggtgcctgagaatgctaacaagttcccaggtgatgctaatgctggtgctaa

SEQ ID NO: 71385 - DNA, 201 bp, Homo sapiens
cagatgtggtagcacacacctgtggtcccacctattcgggaggctgaggtgggaggaccgcttggaccctggaggtcaagtctgtagtgagccatgatcgygctactgcagtccagcatgggcaacagagcaagaccccatctcaaataaataaataaaactcagtaagtaatagagccagaattttgaactatgaatagg

SEQ ID NO: 71386 - DNA, 201 bp, Homo sapiens
gtagtttttcagttttagctctttattcgtctttaattcattttgagttgaatgagccacagagtttttttttttaaagattgtttaaaatgtttaacacrtacgttttctgaagatacattataagtcgtatttgagtaaaaaatataatactgaacttaaataatagtagggaggctgaattaacttatttcaagcata

SEQ ID NO: 71387 - DNA, 201 bp, Homo sapiens
attcccagtaatctagtgtcattgtccatgtcccatcaggcttccacatgggccgtacatggctgttgtatgggctgtgcactggccttgtaatgcctccytgggctaactccttaacaatccctgtggtttcattatgtccccccagcaggcagtattgcctcagtgctactacttgctgtgtggggttggcaactatac

SEQ ID NO: 71388 - DNA, 201 bp, Homo sapiens
tacagaaatctgtttcaaatgaattattttttaaagaacaaagaactttataaccctagtacctaatcctatgcctgacacatagtagatactcagcaaayatctgtgggactgaactgctctgtgaagcctagctaagcactaaagactcccacaactttttcagctttatggggaagtgattatcttaaatagttttaa

SEQ ID NO: 71389 - DNA, 201 bp, Homo sapiens
gatgtacaggtgggtttttggtgtggatgtcctttctgtttgttagttttccttctaacagacaggaccctcagctgcaggtctgttggagtttgctagargtccactccagaccctgtttgcctgggtatcagcagcgctgtctgcagaaccgcgcattttcatgatctgcaaatgctgctgtctgatcatccctctgga

SEQ ID NO: 71390 - DNA, 201 bp, Homo sapiens
tttcaagcatacaccatcccctcttgaaagctctcttaatctttaattttttaaaatacattttcttccactaaatacttattttttccaactgactccckaaaactcataaatctacaattgttattacatgagtaatgtaaatatttattcatgccacctgaatcttaaagttccattggttattagctttttgtagtt

SEQ ID NO: 71391 - DNA, 201 bp, Homo sapiens
gaaggcattggttaaatcaataacagagtggtagtggtatgtgtccagtgcctctcccaccctctttagaagggaggtgatattgggaacatgtgcatacrttggggggactgccttacttaattcccagtaatctagtgtcattgtccatgtcccatcaggcttccacatgggccgtacatggctgttgtatgggctgtg

SEQ ID NO: 71392 - DNA, 201 bp, Homo sapiens
tcagcagctctcagcagagagggtagctcctctctgcagccggtccctccactggctctgctctgctctggctgagtccagggcttttatgagcctcagargggaggaagtgcatgccgattggtccatgggcctgcggtaaaggcaccacaagtccccactctggtccgcagggctggcagcctggcccccagccttcag

SEQ ID NO: 71393 - DNA, 201 bp, Homo sapiens
tctttcagagataatttagtacattcccttatttcacagatgaggagagactatgtgatacatttaaactcaagcagttagtgagaaataagccttggctyaaggttcagatctggagacaaatgtgccttccacagtgccattacctttaaaagcaacttttgaaagtgatagagggtttggaatagactggctcctttg

SEQ ID NO: 71394 - DNA, 201 bp, Homo sapiens
ttgatgttgtcaacgtgaattgaagtatgtttaatattagagaaagtaataccataataaaatacatgttgctgtcaatacccaaggtctaaaagaaattkgttttttcaagactggagaggacatagaaggctccatggtctagatgacccatctgatacactgacacctgttgtaaaatcccaacccatcatttcttca

SEQ ID NO: 71395 - DNA, 201 bp, Homo sapiens
tctctaaagtgctatgctcattcttgtctctatttatatgctgttccccctgcttggaatagtcggctgcctctttggccccaattcccattttatcaggwtaacatcgattcacttttcagggctaattacttgaacttagatatatgtttcagtttttcatttgtgaaataaaggaatgtactaaatgatttctgtgag

SEQ ID NO: 71396 - DNA, 201 bp, Homo sapiens
tgcaaattggtcttgactctctgcggcaatggggatgctgaagaaggcattggttaaatcaataacagagtggtagtggtatgtgtccagtgcctctcccrccctctttagaagggaggtgatattgggaacatgtgcatacgttggggggactgccttacttaattcccagtaatctagtgtcattgtccatgtcccatc

SEQ ID NO: 71397 - DNA, 201 bp, Homo sapiens
gagcctattgcttattttaagggtaattgatcttttgttttgagacagggtctcaccctgtcacttaggctggagtgcagtggtggatgcctccctaggcstcaacctcctgggctcaagtgatcctcccacctcagctgggactacaggtgtgtgtaccaccacacccggctaatttttatgtttgtttgtttgtttgtt

SEQ ID NO: 71398 - DNA, 201 bp, Homo sapiens
actcctaggagaattaatgctactgctgatctgataggaggcggagctcaggtagtaatgcttgctcgcctgctgcccacctcctgctgtgaagcccagtycctaataggctagtaccagcccatgggccattggttggggacccctgctctaattaatgcattttacaagggacgtattattgtagctagataaataagc

SEQ ID NO: 71399 - DNA, 201 bp, Homo sapiens
agggcctcctaatctctaaagtgctatgctcattcttgtctctatttatatgctgttccccctgcttggaatagtcggctgcctctttggccccaattccyattttatcaggttaacatcgattcacttttcagggctaattacttgaacttagatatatgtttcagtttttcatttgtgaaataaaggaatgtactaaat

SEQ ID NO: 71400 - DNA, 201 bp, Homo sapiens
atttctgtcaaatgcacataggcacctgtaattaaagagccgccttcattttcacacatgaggaaactgaggctgttacagatgtagagacttgcccaagktcttgaataacttctcagaaagggagtttgttctatgatttgtgttttttaataaagttttaatggacagaccacgatatccaacatggccttggagcca

SEQ ID NO: 71401 - DNA, 201 bp, Homo sapiens
gaagaaaaagaaggataggaagaattagaaaaaggaaagggagaaagaaggtaaagaaaaagccctaagcctcttcaggcctcatcggctattttcagtgstcttctcttttgtatctgtgtgaatgacttacacttatgtagttagggttttcccatggtgttcttagaaacagtgctataaagcagactaatgttggtt

SEQ ID NO: 71402 - DNA, 201 bp, Homo sapiens
tcaggcattagattctcataaggagcagacaacctatttccctcacgtgcacaattcacagtggagttcacactcctaggagaattaatgctactgctgayctgataggaggcggagctcaggtagtaatgcttgctcgcctgctgcccacctcctgctgtgaagcccagttcctaataggctagtaccagcccatgggcc

SEQ ID NO: 71403 - DNA, 201 bp, Homo sapiens
aactccacctcaaaaaaaaaaaaaaaatagctgggcatggtggtgcatacctgtggtcccagctacctgggaggctgagaagagagtatcacttgagtgcrggaggtggagattgcagtgagccaagatcacatcactgcactctagcctgggtgacagagtgagactctgtctcaaaaaaataaaatttgtgaacttcca

SEQ ID NO: 71404 - DNA, 201 bp, Homo sapiens
ccttgggctaactccttaacaatccctgtggtttcattatgtccccccagcaggcagtattgcctcagtgctactacttgctgtgtggggttggcaactakactggtgtccatttcgcattccccttggtcacatgcttcaccactctcagtcagaactccccagcagttgtttggagggtcaagcctgataagatatcca

SEQ ID NO: 71405 - DNA, 201 bp, Homo sapiens
ttaagagttcttatgaggtttagtaatatagcctggcagcagtggtgatggtttatataggcccttgataagtgtcacttaatttctccttttcttctttmgcctctggaaaattgatatttaaacattttctaaaaattgtattttacgtatatttatgcatttctctggtagaagcttgtttggattttggcaattttt

SEQ ID NO: 71406 - DNA, 201 bp, Homo sapiens
gagaagagagtatcacttgagtgcaggaggtggagattgcagtgagccaagatcacatcactgcactctagcctgggtgacagagtgagactctgtctcaraaaaataaaatttgtgaacttccatatacaagtctttgtgtagatatgggttttttcttcttaggtaactacctagattatttcacaataattgggttgt

SEQ ID NO: 71407 - DNA, 201 bp, Homo sapiens
ctacatctagttcacaggctgtctctgcacctgaactcacaaggcttgtatttatttcactgtgacttcagctggttcaaaggcctcatccttcttcgtgrattagtctcagtgggcccccttcttgactaaacagtataggggtctaaggagttgggccaaatgaggaataaaatgatgcccataccctaggagtcctaa

SEQ ID NO: 71408 - DNA, 201 bp, Homo sapiens
aacagcattaggctgtttatctgttttcatagtagctgttcctgccactaccaggttgtgccacatttgttggtcagtcaccctgatgggccccttggccrtctcctttcctttggcgcccttgtctttcatcccagcagcacgtaccctttgcctatgcagtttctccatttctcataagttggtggctgcttgggccac

SEQ ID NO: 71409 - DNA, 201 bp, Homo sapiens
gcattgatctgataactaatgatgttaagtatcttttcacatacttacctcacaaaggaagctgtgtggttagcaagtatgttcaaatttttagtccagtkactttgggttattttcttattattgaattatgaggattctttatatattttggatacaagccctttgcaaatatgcatattgtgaatattttatcccagt

SEQ ID NO: 71410 - DNA, 201 bp, Homo sapiens
caaagatcctatgtagtctacctgccaccattgtgctgggctctggccctgggtgatctttctggtatcaggtggcaagggcctggggtgttcctgtgcaygggtaagacattgctgacagatgtgtactgtgtctttgtatcatagtggcaggctccaattctttgctatggcccaaagggtaagttgtcccctatgtcc

SEQ ID NO: 71411 - DNA, 201 bp, Homo sapiens
actccccagcagttgtttggagggtcaagcctgataagatatccattctcaagatgtattccaagatgggagctatacatactaaatagggttttggtggyagtctctcaacttgtaatactcagacagttcaacctttctgatccccatccataaccatcttttgccattttagccccttggaaccaacgaatgtcacca

SEQ ID NO: 71412 - DNA, 201 bp, Homo sapiens
cattgatttttagtatattcacacatatgtataaccatcaccatagtcaattgtacacatcttattcatgctttctcctattaccaagagcaatgtctggkatgtaatacatgctcaccaaatttttctgaataagtgaatccattagttgtaaaataatgtaggcattagcctctagtaaaatattaagaaggctcattt

SEQ ID NO: 71413 - DNA, 201 bp, Homo sapiens
actgctgtcatccactctagcccatcattgtgtacagcctacctacagtggggagtgacattaacttgctcctttaccaggcggaaaatatgccatctcaygttgttggtggtgggaaacttgctgcatgaggtgctgttgtcgctgaaggggaataggtgaaggtcactataccaagtatcgaagtggccccaggtactc

SEQ ID NO: 71414 - DNA, 201 bp, Homo sapiens
gggcaagatggtaaaagtctattgttcttcccaggtgaatgcaaattggtcttgactctctgcggcaatggggatgctgaagaaggcattggttaaatcartaacagagtggtagtggtatgtgtccagtgcctctcccaccctctttagaagggaggtgatattgggaacatgtgcatacgttggggggactgccttact

SEQ ID NO: 71415 - DNA, 201 bp, Homo sapiens
gtacacatcttattcatgctttctcctattaccaagagcaatgtctgggatgtaatacatgctcaccaaatttttctgaataagtgaatccattagttgtwaaataatgtaggcattagcctctagtaaaatattaagaaggctcatttgactgcattcagctctagaactattcttttattagaactctgctattttgag

SEQ ID NO: 71416 - DNA, 201 bp, Homo sapiens
tttcaataaatatattggaaaattttttggagatttgcaacaatttgaaaaagcttgctttttctttagcttactttattgtaagaatacagcatataatrcatataaaaaatatggttaatcagctgtttatattattggcaaggcttcaggtcaacaataggctattagtagttagtttttgggggagtcagaagttat

SEQ ID NO: 71417 - DNA, 201 bp, Homo sapiens
tcttgtctcattaagttttaagtaacatttaaaactattaaagcatgttacttgacctaattttatagcatttgagttgtcccattaaatggagcatctcrtaaatttcaagtattttatacttggcaatggttaagagttaaaaggtagttggatttgtcacagacaatgagttaaggaatcctttcacgtttttcccaa

SEQ ID NO: 71418 - DNA, 201 bp, Homo sapiens
cactgtgacttcagctggttcaaaggcctcatccttcttcgtggattagtctcagtgggcccccttcttgactaaacagtataggggtctaaggagttggrccaaatgaggaataaaatgatgcccataccctaggagtcctaagaagatttatagctgctttggtgtcacacgatgtgagtaggcctgcaccctatccat

SEQ ID NO: 71419 - DNA, 201 bp, Homo sapiens
ttaggaaaattattatttctttaaaagtcttaaagttaataaacaggagatttaggagacgttaattaatgcttaagataaaaggtttcatttctctctcyctgtttctctgtcttcacacagaaccttctacatggtgtgtgtttaacaagcacttgataaactgtggggaaaaaagatttttaaattagatttaggaaa

SEQ ID NO: 71420 - DNA, 201 bp, Homo sapiens
actgaaaaatgtataataaaagtaataaatgtataataaaaatgtattactaataaaagtaattgataggtaatgaaagcgtaagaaataggacttagtakcctggacagttagatgtttcatccttgtctatacagccagtgtgtgcctctcacttttttttttctaactttcagaaaaataaatttattttcattttat

SEQ ID NO: 71421 - DNA, 201 bp, Homo sapiens
tctattcagtgtttgtgaggaaagttttaaagtaacaataccatacagcttatgtatgagaaaatggagccaaagaagttgggaattcatactctgttctytttttttttgagacagagtcttgttctatcgcccaggctggagtgcagtggcacgatctcagctcaccgcagttcccacctcccaggttcaagagattct

SEQ ID NO: 71422 - DNA, 201 bp, Homo sapiens
aacgtcctgtttttcaggaatttacaatctaagtggcagttccgttcctggaacctatcttctttcacagatgccgttacagctgtttcaaagactgctgkttttgaaaacgctcagtccctcccaccacgctgtgcactgctgcgctccactcaggggattacggcgcaggggcggaccctcgctgacttctgccccgga

SEQ ID NO: 71423 - DNA, 201 bp, Homo sapiens
aaaataaatttattttcattttattttgttaggaagtaagtgaaggacaagtgttggttcttggggccacaaatcgccctcatgccttggatgctgctctycgaagacctgggcgatttgataaagagattgagattggagttcccaatgctcaggaccggctagatattctccagaaactgcttcgaagggtaccccatt

SEQ ID NO: 71424 - DNA, 201 bp, Homo sapiens
gatgttgtcaacgtgaattgaagtatgtttaatattagagaaagtaataccataataaaatacatgttgctgtcaatacccaaggtctaaaagaaattggktttttcaagactggagaggacatagaaggctccatggtctagatgacccatctgatacactgacacctgttgtaaaatcccaacccatcatttcttcatc

SEQ ID NO: 71425 - DNA, 201 bp, Homo sapiens
ttacctgtgtgtgatgttgaacaaatttacctaaaggctttcaaatcagtttcttcatttataaattgggggtagggggaaggattttacctaccacattrgattgttggatagattcggtaacttatgtgaaggcagagaacacttggaaatcagtggtggtggaggtggtagtgctaatagtgctaatatcaccatcgt

SEQ ID NO: 71426 - DNA, 201 bp, Homo sapiens
tcccaacccatcatttcttcatcctttgcttattcacccacactgatggggaactattaattcacgaaatagaccatttcatttttgtgtcagactattargaagttctttaatctgatgaacaagcagctgtttgtctccctaaaccctctatacctctacctgattttattccaaagtctgtaaagagcagtttttaat

SEQ ID NO: 71427 - DNA, 201 bp, Homo sapiens
tcttcatcctttgcttattcacccacactgatggggaactattaattcacgaaatagaccatttcatttttgtgtcagactattaggaagttctttaatcygatgaacaagcagctgtttgtctccctaaaccctctatacctctacctgattttattccaaagtctgtaaagagcagtttttaatccttcttctatatgg

SEQ ID NO: 71428 - DNA, 201 bp, Homo sapiens
tcagactattaggaagttctttaatctgatgaacaagcagctgtttgtctccctaaaccctctatacctctacctgattttattccaaagtctgtaaagarcagtttttaatccttcttctatatggtgttcctttattttttaaaactgttagttatcttgtctttacactttatctcactaaccagtcttttgtttttc

SEQ ID NO: 71429 - DNA, 201 bp, Homo sapiens
tattttttaaaactgttagttatcttgtctttacactttatctcactaaccagtcttttgtttttcaggcttgacattttggattatttcatatgccattstttttccgtctaaagcattctcatctttttcttgtgaactatttgtcctttttgctctgaagttgtaacatccaccaacaaatatatattgattggttgt

SEQ ID NO: 71430 - DNA, 201 bp, Homo sapiens
ctctaccctgaataccttgcttctcctaatgcattccaggattttgttagctttgttgtcagctgcacattgagattgctattgaataaagtcatcaggarcaacaacaaaggtgaaaagcccaggtctttcttcaaagtctgctaaataatagttttcacgccttgggcttgtgcagttaatttgatttaagtttcagca

SEQ ID NO: 71431 - DNA, 201 bp, Homo sapiens
agtttttagcttttcattgttgggtatgatgttagccgtgagcttgtcatacatatagcgttatgatgttgagatacattctgtctaatgtattgagagtktttatcatgaaaggatgttgaattttgtcaaatgctttttctgtatctattgatatgattttatgatttttattcttcgtccttttaaggtggcgtatca

SEQ ID NO: 71432 - DNA, 201 bp, Homo sapiens
ctggtgggaatgtaaactagtacaatcactatggaaaacagtgtagagattccttaaagaactaaaagtagaactaccatttgatccagcaatcccactgmtagtatctacccagaggaaataagtcattatatgaaaaagatacttacacatgcatgtttatagcagcacaattcacaattacaaaaatatggaaccagc

SEQ ID NO: 71433 - DNA, 201 bp, Homo sapiens
aatctgaatgttggcctgcctcgctagattggggaagttctctttgataatatcctgcagagtgttttccaacttggttccattctccccgtcactttcargtacaccaatcagacgtagatttggtcttttcacatagtcccatatttcttggaggctttgtttgtttctttttattcttttttctctaaacttcccttc

SEQ ID NO: 71434 - DNA, 201 bp, Homo sapiens
cagggagcccctaggtctgggctccccagagggctgcaactcttctccttctcatcaccctcaatgtggcaagtcagggttgggggtgtttttcagctttstttgtgttactgctctttcagtccctccgtttggtgggtcctgagttcttgtcccgtgtccaggaccagtgaggtatgtggacaactggagggtgagcaa

SEQ ID NO: 71435 - DNA, 201 bp, Homo sapiens
cacttgttgtaaattgctagaatattaaaagtaaggtggattatatcctctgagccatattatgtaactttgaatataaactctaaggacaaaagcacaayctctgcacctgtttagtggctaaaatatggctctctgttgtaaatgaattatgaagggatctttcagagcaaaaatcagcatgtgctaaaagtagatatt

SEQ ID NO: 71436 - DNA, 201 bp, Homo sapiens
tcgttatgtgtgaatttgatcctgtcattatgatgttagctggttattttgctcattagttgatgcagtttcttcctagtctcaatggtctttacattttkgcatgattttgcagcagctggtaccggttgttcttttccatgtttagtgtttccttcaggagctcttttagggcaggcctggtggtgacaaaatctctca

SEQ ID NO: 71437 - DNA, 201 bp, Homo sapiens
agggctgcaactcttctccttctcatcaccctcaatgtggcaagtcagggttgggggtgtttttcagctttctttgtgttactgctctttcagtccctccrtttggtgggtcctgagttcttgtcccgtgtccaggaccagtgaggtatgtggacaactggagggtgagcaaggtggaaaggactttaattgaacaacaga

SEQ ID NO: 71438 - DNA, 201 bp, Homo sapiens
attgaaaatttatatttgatgtgtaatagctttgaaaaatggaccagactagtggcaaaaacttttatgtctaatcagaccttaaagacaatttagagttmacatggtattttcactctgccttaggtatcagaggacaacttgttctgtcctgaaggttcaacttgtttttgaactagatccttcccattgacatgtaaa

SEQ ID NO: 71439 - DNA, 201 bp, Homo sapiens
tgtattattttgaacttttatttctgctactaagtagtgatacatcttgaggaactccaaggggcctaaacataagtttacacaggtatttgaagaatcarttgactcactatctgaactgagtatgtctgtaaagctatgtttaaatatatccctatatttaaactgatcatggcttataagctaatcacccatgaagag

SEQ ID NO: 71440 - DNA, 201 bp, Homo sapiens
ttttttattgcgtctatttgattcttctctctttttttctttattagtcttgctagcggtctatcaattttgttcatccttccaaaaaaccagctcctggrttcattaatgttttgaagggtttttttatgtctctatttccttcagttctgctctgatcttagttatttcttgccttctgctagcttttgaatgtgtttg

SEQ ID NO: 71441 - DNA, 201 bp, Homo sapiens
tgctccattgttgagggttggtactgtctaaagttaaaccatttcagtgatgcctagcatggaacacttgacaaccaaccttccaggtaggaaatgagacktccttgccagcaagtccatataatactacaatttttatgactagactatttttgcagaagtacttattgcttaattgacattaaacttaagtaagtctat

SEQ ID NO: 71442 - DNA, 201 bp, Homo sapiens
tcacaaaaagcaagctaagaagcaaatatttttggtggcaatttgcctaatgcctggctaagcacatggcagaacctggtacttaaacccagaatgtgcayctccaaatcgcacagctttctgctttgtcatgctgactggggtagtgctttgatcacctgtttggtcattgataagtatcagtgggtacaacacctgtgt

SEQ ID NO: 71443 - DNA, 201 bp, Homo sapiens
attatgccacatttctttgtaccattataccacattttctttctctgttcatctgttgagggacacttagattgattccctatcttggatgttgtgaatartgctgtagtgaacatgagagtgcagatatcgctttgagatacttcatttccttttgatatgtacccagtagtaggattgctgaatcttttggtaacttaa

SEQ ID NO: 71444 - DNA, 201 bp, Homo sapiens
agctcagtaaacccctccttactaaatgtacacaaaagtccattttcaggtgtttgttatttgtgaaacttggttatgtacaatatcatgaacatataaasttcccccttcatgctcatttgctgtttaccaatatgattccccttgagactccagcattaggtgctatatggctgtacaaattggtttgggattgctttg

SEQ ID NO: 71445 - DNA, 201 bp, Homo sapiens
gataatcatgtggtttttgtctttggttctgtttatatgctggattacatttattgatttgcatatattgaaccagccttgcatcccagggatgaagcccrcttgatcatggtggataagctttttgatgtgctgctggattcggtttgccagtattttattgaggatttttgcatcaatgttcatcaaggagattggtct

SEQ ID NO: 71446 - DNA, 201 bp, Homo sapiens
attttttttttttaaagaaatagtacatgttctttttggactgtctgaaaacattgactcttaaccataataacaaataatttttatgagtcccaagctakagataaagagacctagttacttcattttaccttgggtatgagttttgatatttgatgataacagatttggatcgttgctggtttgggcaaggttcggatt

SEQ ID NO: 71447 - DNA, 201 bp, Homo sapiens
ttcacgtcccttgtaagttggattcctaggtattttattctctttgaagcaattgtgaatgggagttcactcatgatttggctctctgtttgtctgttatyggtgtataagaatgcttgtgatttttgtacattgattttgtatcctgggactttgctgaagttgcttatcagcttaaggaagttttgggctgagacagtg

SEQ ID NO: 71448 - DNA, 201 bp, Homo sapiens
ttttgttgtgtttctgccaggtttgggtatcacaatgatgctggcctcatagaacgagttggagagggatccctcctccctaattttttggaatagtttcrgtaggaatggtaccagctcttctttatacatctggtagaattctgtctggtcctgggcttttcttggttggtaggcttttttattactgcttcagtttta

SEQ ID NO: 71449 - DNA, 201 bp, Homo sapiens
tatggctagccagtttttccagcaccatttattaaatagggaatcctttccccattgcttgtttttctcaggtttgtcaaagatcagatagttgtagatakgtggcattatttctgagggctctgttctgttccattgatctatatctctgttttggtaccagcaccatgctgtttggttactgtagccttgtagtattgt

SEQ ID NO: 71450 - DNA, 201 bp, Homo sapiens
ggtaggaatggtaccagctcttctttatacatctggtagaattctgtctggtcctgggcttttcttggttggtaggcttttttattactgcttcagttttrgaacttgttattggtctgttcagggattcaatttcttaggttcagtcttgggaggttgtatttgtccaggaatttatcagtttattctagatcttctagt

SEQ ID NO: 71451 - DNA, 201 bp, Homo sapiens
gtttaattagatcccatttgtcaattttggcttttgttgccattgcttttggtgttttagacatgaagtccttgcccatgcctatgtcctgcatggtaatrcctaggttttcttctagggtttttatggttttaggtatagcgtttaagtctttaatccatcttgaattaatttttgtataaggtgtaaggaagggatcca

SEQ ID NO: 71452 - DNA, 201 bp, Homo sapiens
atttgtccaggaatttatcagtttattctagatcttctagtttgtatgcatagaggtcttcatagtactctctgagagctttttttatgtctgtgggatcrgtggtaatgtcccctttgtcatttctaattgtgtttatttggatcttctttctttttattagtctagctagcagtctatctgtcttaattttttcaaaga

SEQ ID NO: 71453 - DNA, 201 bp, Homo sapiens
gtgctgcacccattaactcgtcatttagcattaggtatatctcctaatgctatccctcccccctctccccaccccacaacagtccccagagtgtgatgttycccttcctgtgtccatgtgttctcattattcaattcccacctatgagtgagaacatgcggtgtttggttttttctccttgtgatagtttactgagaatga

SEQ ID NO: 71454 - DNA, 201 bp, Homo sapiens
tctattatgttatagttgcaattgttgggggattagaagtttgaggaaaatgtaatgtaacccttccagtaattttacagaggatttttggattctctgtsagctgctactgcatttgtcttcacaattaagttcatacgaatgccaggatgtgaatgccaaaatagtttgagattttaacagcagtgaactcaggaaatt

SEQ ID NO: 71455 - DNA, 201 bp, Homo sapiens
ggttagttaaatatgtatacatgtgccatgctggtgtgctgcacccattaactcgtcatttagcattaggtatatctcctaatgctatccctcccccctcyccccaccccacaacagtccccagagtgtgatgtttcccttcctgtgtccatgtgttctcattattcaattcccacctatgagtgagaacatgcggtgttt

SEQ ID NO: 71456 - DNA, 201 bp, Homo sapiens
gtgaatgccaaaatagtttgagattttaacagcagtgaactcaggaaattaaaaattaactctggaaatactatttcatgttttacaaccacttttggatrgtgtgttcctttttaaaccttccttagatcattgttactcttgggttacaacctgtctcctttttaccaccaaagttcttaaaagtctagcacacctact

SEQ ID NO: 71457 - DNA, 201 bp, Homo sapiens
tgcaggttagttaaatatgtatacatgtgccatgctggtgtgctgcacccattaactcgtcatttagcattaggtatatctcctaatgctatccctccccmctctccccaccccacaacagtccccagagtgtgatgtttcccttcctgtgtccatgtgttctcattattcaattcccacctatgagtgagaacatgcggt

SEQ ID NO: 71458 - DNA, 201 bp, Homo sapiens
gagatttgcaacaatttgaaaaagcttgctttttctttagcttactttattgtaagaatacagcatataatacatataaaaaatatggttaatcagctgtktatattattggcaaggcttcaggtcaacaataggctattagtagttagtttttgggggagtcagaagttatgcatagttttttgactgcacagggattgg

SEQ ID NO: 71459 - DNA, 201 bp, Homo sapiens
cggctagggtaccttgtgaccatgtcttccaagaagaatagaaagcggttgaaccaaagcgcggaaaatggttcgtccttgccctctgctgcttcctcttstgcggaggcacgggctccttctgctggatcagacttcgcggcaacctccgggactctgacggtgaccaacttattagaaaagggtaaagaattccgggtg

SEQ ID NO: 71460 - DNA, 201 bp, Homo sapiens
tataatagttatattttttattttttgaggaccctctgtgctgttttctgtaattgcttatagaaattgactagttgacattcccatgtagaaaaagggaycccttttttctacatccttgccaaccctaatttttttatcttccaacttaatttttttttcctgttggctaatacaactttggcctgtcaaatcatggta

SEQ ID NO: 71461 - DNA, 201 bp, Homo sapiens
agttctcactctgggccgaggtctccacatggaactggcagcccagcccccaggcttcaggctgtccatgtcttgaaggtggggtttcaccagggacccayccctttgcacccaggagcctgtctgccttctgtcaccaggaatgtgccatccatggcccccaggctgtttgtgccaaggagtgcctgaagccctatggca

SEQ ID NO: 71462 - DNA, 201 bp, Homo sapiens
ggaaccaatcctctgcagataccaagacaactgtatatactttgtaaagcttgtataagatgatactcataaagcatttaacagataatgtctcaataagtgttttaattgttatatcattacaactatcaccattataatctcaacagggaaagcctttcataatcacagctgattaaaatacctttttagtattcaggc

SEQ ID NO: 71463 - DNA, 201 bp, Homo sapiens
gtgagccccgccctcccaactcagtaggggccagggctcctgcccgttcgcagccttgacggcttggcagagcttgcaactctagccgcacctacccagtrcagcgggcgtcctcacagccgcgctccagacgggccgctgctgccatcattactcccaagtttcgggtcagaaataagtagaattttagtgctggagaga

SEQ ID NO: 71464 - DNA, 201 bp, Homo sapiens
tcttagagaatttgatttcttaataaaaatttggctaactagatattttacatgtaaatcttttagagaatttattcagcaacaaaaatcagttatgtgtrtattgacagtttctaatctaattttcataaatataactaaaattatgaaaatgtacttaaaaaaaaaagctagattatactcctgtctcctagaagggac

SEQ ID NO: 71465 - DNA, 201 bp, Homo sapiens
cagaaaaacccagaaatattactctaagataataacaattattaccacttttatttgagcacatgcactataccaggcacagcacaccgtgctttatgtayataatctgtaactctcctgacaaccctgcaaagtagtacctctgtttacattttgaagatgagaaaattactgctcaaagagattaaatagcttgccatg

SEQ ID NO: 71466 - DNA, 201 bp, Homo sapiens
atactttttatccatactttatttaaaaattttatgtgttagaaaacttatactctagacatttaaaatttaaattttcataacatagtatgcttctgaawaacctgagaagaatgttacacaaaaggagatggcttgctgattccgtggagtaataaatgcctacctgttttcattttgaagttgaagccattgcttcta

SEQ ID NO: 71467 - DNA, 201 bp, Homo sapiens
aacttaactgcttccttctttcacatatcagtttctcttccatcagagagaatagtgatatggaatcattttgtctgaatggttggctaaaagtacatacygtagaaggtagaaacttaaatacaggataatgaattttttttatatctgattcccattagcattgacattttttttttctgtttccagaccataaaagct

SEQ ID NO: 71468 - DNA, 201 bp, Homo sapiens
tgacacagttaactccagctttttttttcttttccttcttttttttttttttttttttttgagatggagttttacccttgttgcccaggctggaatgcagkggcgaggtctcagctcactgcaacctacgcttcctgggttcaagcgattctcctgcctcagcctcccgagtagctgggactacaggcgcccactaccaca

SEQ ID NO: 71469 - DNA, 201 bp, Homo sapiens
tagggaaggagtggttgtgctattccgatctgaacttctgtaataggagagtagcaaagcagtgaggagttgaaaggcctttaaaaaaaaaaaaagtataygttcacatggagtccctctgaataagtaccagcaccccaaagtcactaaaattactccccaaatcaagcattcatcactcagaaagcctttatggatcac

SEQ ID NO: 71470 - DNA, 201 bp, Homo sapiens
tctcagcagagaggaggccctgaagagggtagactcctctctgatgttgatcatcctgacctcagcagctctcagcagagagggtagctcctctctgcagycggtccctccactggctctgctctgctctggctgagtccagggcttttatgagcctcagaggggaggaagtgcatgccgattggtccatgggcctgcggt

SEQ ID NO: 71471 - DNA, 201 bp, Homo sapiens
tgtgagaggcaacagaccatcaacaaaataaaatatagtatgtggcaataagagagaaggagcaaaataaagcagggaaggagaatgggattacagggagrgctgcaggttttaatagggtggccatggaaaaccttgccgagaaggtggcatttgtgtaaagacttgaggcgagtgaactgcaattatccaaaggaagca

SEQ ID NO: 71472 - DNA, 201 bp, Homo sapiens
gaatgaaagctgaaacaaggcagagtgtcacctcatcctacatggtaacatgggtgttgggtcacccaaattttttgctgctcttccatgtcactaatgascacaaatgctctgtgagtattgattttggggtacacataagtttttgggagttggtaaatttgcaaatacagcatccacaggtattgaggattgactata

SEQ ID NO: 71473 - DNA, 201 bp, Homo sapiens
ggtggggcgcgaggttgaggctgcaatggcggctccgaacttagtagcaggtcctgctacctgtgcgagggtggaggtggcacagtccaccttgaggacaygggacacaggagactgttgccactgctgctctcacagttgcttctgctatcctgtctgcctccttgcagcctggagcagggctccaggccatcgctgggc

SEQ ID NO: 71474 - DNA, 201 bp, Homo sapiens
aacaagaagtccacatgctccgaacacgagtgttctttgcacattcaagaacagccaggaagccaatgtcactggagtgaagagtgtgagggggttctagrgcccagttgaaaaaaagtgggagtaagtgattggtgtcgcatgctgctgatagattaaatagattgagaactgaggattgaccataggattagtgacctt

SEQ ID NO: 71475 - DNA, 201 bp, Homo sapiens
tcaacttgaatctttagttgttccctaagttcattctggaatggctgaaaccacttataaagaagaaagtattaagggcattgagttacccaacgtattarttgttatcgctgaattctacttttaaccaggaatatactttggtcttcgttcaaaagcacatcatttttttgtaattaaaatatatatggagacaatata

SEQ ID NO: 71476 - DNA, 201 bp, Homo sapiens
cactcataattaagtgtttaagggagttaggaagctggaggcaggatctataatgttttccaagtgattttgaagcagccagtcttgcccttgtctgtgaytggacatttgattcgctgatttaggcaagtggttctccaacctatgtaagaagcatttgtagagctcgtgaaaacacagttctggggtctatcctgctga

SEQ ID NO: 71477 - DNA, 201 bp, Homo sapiens
tctccctgccctccaataggcctactttttaatggggttattttgttgctgctgttgagttgtttgaattctttgtaaattctgggtatcagtcccctatyagaggcatagtttgacaatattttctctcattcttcaggatgtctgttcactctcttgataatttcttttgctgtgcagaagtgttttagtttaattaaa

SEQ ID NO: 71478 - DNA, 201 bp, Homo sapiens
ccatctactgctgttggtggagcgtttaagtctcccactattattgtattgctctctgtcttttcttaggtctaagagcatttgttttatgaatctgggarccctggagttaggtgcatatttatttaggattgttatatcttcttgtggaactgatccctttatcattatataatgaccctcttcgggttttttgtttgt

SEQ ID NO: 71479 - DNA, 201 bp, Homo sapiens
tttctgcccaggagcctctctgcctcctgctgccatcaatcatgtcgtccatggtgctggggctgttcatgctgaggggcgcttgcaggactgcgccaagmcaccctcagcctccctcacatactcattggcacccaaagtctggaggggaccaaggtggaagggagctggactgtcagtgccaccttgagcacatgaaca

SEQ ID NO: 71480 - DNA, 201 bp, Homo sapiens
tttatgaatctgggaaccctggagttaggtgcatatttatttaggattgttatatcttcttgtggaactgatccctttatcattatataatgaccctcttygggttttttgtttgtttttgtttcgtttgtactattattgatttaaactgtttaatctgatataagaaaggctattactgcttgcttttggtttcatttg

SEQ ID NO: 71481 - DNA, 201 bp, Homo sapiens
cacttggagatgtggaaaggtagagctgtgactagagctggcagaggcataagccttggaaggctggttggggcaaggtgaaaaatgggaaggacagaagsaggtaaagaagccagaaaaggcaaaattttaccaggttctttcctctttactggaatttgaattttgtcctacttgcctgtcttgagactttgactgaca

SEQ ID NO: 71482 - DNA, 201 bp, Homo sapiens
tcttacgctttttgcccaggccggagtgcagtggcgcagtcttggctcactgcaacctctgcctcctgggttcaaatgattctccttcctcagactcctgmgtagctgggattacaggcatgcactacaacgcctggctaatttttgtatttttaatagagacggggttccaccatgttgaccagtttggtcctgaattcc

SEQ ID NO: 71483 - DNA, 201 bp, Homo sapiens
ccctttatcaatatatcccagctaatgaatgaagaaggaataacagaaataggatagcatcattttgcagcccttcatgaatcaaaagacctggacaatcrtaagtggctactaacacatgaaaagaagagcagccatacattatgtgcatctcagcaatacctatgaagtacttgttcaaaaaaaaaaaaaatcaaacct

SEQ ID NO: 71484 - DNA, 201 bp, Homo sapiens
tatatcccagctaatgaatgaagaaggaataacagaaataggatagcatcattttgcagcccttcatgaatcaaaagacctggacaatcataagtggctaytaacacatgaaaagaagagcagccatacattatgtgcatctcagcaatacctatgaagtacttgttcaaaaaaaaaaaaaatcaaacctgaaactcccca

SEQ ID NO: 71485 - DNA, 201 bp, Homo sapiens
tagcattttctaactttgaccataatccatactggaatcatcattcaaaaataatggcctaattgttcctacaaatttcataatcattttcaaagaagttsattggtggcccttgaggcttttcaactttatcctattttggatgatatctgtggcctagaaatcagttgtatagcccaaaatgttacctagactactaat

SEQ ID NO: 71486 - DNA, 201 bp, Homo sapiens
ataattatatatttattataatatatattgatataaaggatccagttcatcagtcttttccttcgtggctggtgatttttgtagctagcttaagaaatctyggtcaaatctactgttaggtatattttctcttaccttcttgatgcttttattgtttttcctttcatgttgctatctttaattgcttcactttttttcata

SEQ ID NO: 71487 - DNA, 201 bp, Homo sapiens
agactacccacattccttgccacacagccccctcctccatcagaaacagcaatggaaaactccattatgttttatccctgtcacacttcaaatttcctttkccaggaaatttgtccctttggagggctcatctaatgaggttagccttattgaggaaaaatctctggaccttgaagtcagttgattaaggatcctgcaaaa

SEQ ID NO: 71488 - DNA, 201 bp, Homo sapiens
ctaggacaagaatccaccatgcaaggtccctcatacaaaatcactttctttatatccctccccacaaaaaaaaaaaaaaaaaaaaaaaatatatatatatrtatatgtgtgtgtgtgtgtatatatatatatatcttttatccacactttcctcacatccctctttttattcattgattccctcttattttgaaccatggc

SEQ ID NO: 71489 - DNA, 201 bp, Homo sapiens
gtggctcctctctgcaggcaggttgtcccgacgaatgttcagctcttagcagagagggtagctcctctctgctgctggtcatcctgttgtctgcagctctyagcagagaggaggccctgaagagggtagactcctctctgatgttgatcatcctgacctcagcagctctcagcagagagggtagctcctctctgcagccgg

SEQ ID NO: 71490 - DNA, 201 bp, Homo sapiens
tgacattgccgcaagttccccctgtggacccggctctcggtggcagcctggggctcctcctcgcacagcttgagaccctgccggggggcacctctggggcrgatcgcgggccccaaacccagttgtcgggagcgccaggctgaacagtcactccgacgtggggtggatcctggggttgcagcgtcggtggcccgggctgag

SEQ ID NO: 71491 - DNA, 201 bp, Homo sapiens
ctcccttcactctgtgcgcaactgcagcacccctgggtccaactctgccttgagacccctccatgccagaccgtgctcttcccccgcctgcaggtaggtcrgcccggccccacctgagtggatcccagggttgggcttccagggcagcaggccccaggtaccgttcgccttggagtccacctgaggatccacagcctgcac

SEQ ID NO: 71492 - DNA, 201 bp, Homo sapiens
ggcccggccccacctgagtggatcccagggttgggcttccagggcagcaggccccaggtaccgttcgccttggagtccacctgaggatccacagcctgcamccccacctgcacccacacccgtgccccaccacagccggtcccggctgccaaagtggcagtgactactttggatggcccgctgctgccatcaatttgaatg

SEQ ID NO: 71493 - DNA, 201 bp, Homo sapiens
gtttatattttgccgtccttgttgagaagaaaaacatggatgtatagatatacagtgatggatggactagcagcttaagaatcattttggggacatttttwaaaaaattttttgagacagagtcttgttccatctcccaggctggagttcagtggggcaatcgtggctcactgcagccttgacctcatgggctcaggtgat

SEQ ID NO: 71494 - DNA, 201 bp, Homo sapiens
tcattttttaaaagatattttgttaagatggtattttgaattggtaacatatgtatataattcagagatcaaaactgtatggaaagatatacatgctcatwccttgttccttctaccactgtaccccaacctttccaccttacttttattagtctcttgtttcttcttccaattttttaacacaaacaaaaaatatgcaaa

SEQ ID NO: 71495 - DNA, 201 bp, Homo sapiens
ggaaactatgtatacccttcagtactttgcttttttgatttagctctgtttcttgcagatctttttctctcagtaaatgggcattttcctcatccttttgwaggatgcatggatgaagaactaccatagttattcaaccagtgccttattttatggattcttaggctattgtcagtcttttgccactattaacagtactac

SEQ ID NO: 71496 - DNA, 201 bp, Homo sapiens
ccaaaatgttacctagactactaatgaacagcaaggtctaaggaaatggcaactagaggccgggcgtggtggctcatgcctgtgatcccagcactttgggrggccgaggctgtcagatcacaaggtcaggagatcgagaccatcctggctaacggtgaaagcctgtctctactaaaaatacaaaaaattagccagatgtgg

SEQ ID NO: 71497 - DNA, 201 bp, Homo sapiens
taattgttaaactagaattttggaatcagtattttttactcatgttttgtttaccggtaagtcaccttgcttattacagtgtctcaacgtattaagtgttyagtaaattttcattgaatggaatagaaggaaaagaggtagtatggaaatagactcaactgattctaattatgcacccaaaacaagaaagcaaaggttacg

SEQ ID NO: 71498 - DNA, 201 bp, Homo sapiens
ctagactactaatgaacagcaaggtctaaggaaatggcaactagaggccgggcgtggtggctcatgcctgtgatcccagcactttggggggccgaggctgkcagatcacaaggtcaggagatcgagaccatcctggctaacggtgaaagcctgtctctactaaaaatacaaaaaattagccagatgtggtggcgggcgcct

SEQ ID NO: 71499 - DNA, 201 bp, Homo sapiens
tagaaatttaagtctttgaagagaggaaactgtattattggatattttttgttttattttttgtttttgagacagagtctcgccctgtcacccaggctggmgtgcagtgacacgatctcggctcactacaacctccgcctcttgggttcaagtgattctcctgcctcagcctcctgagtagctgggattccaggcacctgc

SEQ ID NO: 71500 - DNA, 201 bp, Homo sapiens
tttatcttaattattgcaaggactggtcaagagaacgtgtttggaaattggaaattaatcatctatgttgaggaaataatttataacatttgagtttctcyggtgaatcattaacatagtttccatatttaaatttctgccattatattttttcacattgtctgtcttctttccaaataacttctcagagaaactcttaga

SEQ ID NO: 71501 - DNA, 201 bp, Homo sapiens
cgtggtggctcatgcctgtgatcccagcactttggggggccgaggctgtcagatcacaaggtcaggagatcgagaccatcctggctaacggtgaaagcctrtctctactaaaaatacaaaaaattagccagatgtggtggcgggcgcctgtagtcccagctactccagaggctgaggcaggagaatggtgtgaaccccaga

SEQ ID NO: 71502 - DNA, 201 bp, Homo sapiens
aaaaagtacagcctaaagaggaaattcttggcacttgtttcaattatctcctctttacaacattatagggtgctttcatgtgtatgtattatcattcatartagagagtacattgactaagattgcaaaatagtttccattgtatcataatccccttgtgtccagttgactcacatctctgaaaaatttctgctcagttac

SEQ ID NO: 71503 - DNA, 201 bp, Homo sapiens
ttatctcctctttacaacattatagggtgctttcatgtgtatgtattatcattcatagtagagagtacattgactaagattgcaaaatagtttccattgtrtcataatccccttgtgtccagttgactcacatctctgaaaaatttctgctcagttacaaatgtctgctggtctctttccaatgatactttgtttgtttgt

SEQ ID NO: 71504 - DNA, 201 bp, Homo sapiens
ccccttgtgtccagttgactcacatctctgaaaaatttctgctcagttacaaatgtctgctggtctctttccaatgatactttgtttgtttgtttgatggktggaaatctgaagaaagttcacttagttaaaatggtgatgtaaagtatatgagtacagtcctaaaatttactaaatgtacatactcaaatttactcaact

SEQ ID NO: 71505 - DNA, 201 bp, Homo sapiens
tagggttgtgagcataaggtccagatccacctagttatttttcaccagagttttaaaagacgaaatcgttgaagctgccggcatttagtctagggctttcygcattctcttgacctgcttctcttgtcttgttaatttaggcatgaaacggtgtcgcagtactctggcgtctttattccaggagaggcttcttacaagata

SEQ ID NO: 71506 - DNA, 201 bp, Homo sapiens
atggcccaaataccagcttctaggccgaaccaacggttgggatgttgctgtgttagcaaggtcatgcgaggttcttcctccctatccccacagcgttcctytcctgctgtctgcttgcttgccagccaccccctggttaattttcctaaggcatgcccagttcctcacttccctgagcagaatctccatggctcctcgttg

SEQ ID NO: 71507 - DNA, 201 bp, Homo sapiens
agtctaagagaagcagaatgcaacattacttagataacgtacttgtgtggactggtttaggggttcaatttctaatgagcagaaaattaagacaatgggaracagatggcccaaataccagcttctaggccgaaccaacggttgggatgttgctgtgttagcaaggtcatgcgaggttcttcctccctatccccacagcgt

SEQ ID NO: 71508 - DNA, 201 bp, Homo sapiens
aagtcaattaagtccaaactcagtttggtgttcagagcccccataatctaaattccagcctatgttcctcttcctgaagttcacttcagacaagctcaackcatttctccctgtactcccctctcttggccctctacatattcatacctccatggagagtgccttttccacacctgtccacagtccacgtctcacccagtt

SEQ ID NO: 71509 - DNA, 201 bp, Homo sapiens
acaatggttttccattggctaccgagtcgaacattcttaaagaactcataaagcctcctaccatccttcgaacggttgtcaacaccatcacaggtacggcrgagggggaaactgatagatagtggccatcctacagcctgagtggcttagtcgagtgtcgcacattgttttgagtgtttgtctttggggatctcaggtgtc

SEQ ID NO: 71510 - DNA, 201 bp, Homo sapiens
gttctaggcccagagctgagagtgggggtgagtggtggaggggtgtggcaagagattcaactggagagatcgagaggacagataagtgttaaaggtagtcrggtgtggtggcatgcctgtagtcccatttactcaggaggctgaagcgggagtattgcttgagtccaggagttcaaggctgcaatgagttatgatcacatc

SEQ ID NO: 71511 - DNA, 201 bp, Homo sapiens
accggaataagcacgttggaaaatgaatgaatacaaagtgttataaagtaaaaatctgtctagtctgtgctaaatacacgaatgcatgataaactgtgagstgtggaggcagtcagggagcctgccctatttgtgattgtttttgaacttcatggtagtaagaggtgttccttaccatttttgctttgcaaacatttattc

SEQ ID NO: 71512 - DNA, 201 bp, Homo sapiens
gcatgccagaccttacactttccttcatggtaaaatcctgggccagagattaagttcttgggatgagaaattaaatgctgctggaaagacagagtagtggsaatggaatagaacaagaagaaataattaggacagccacgaagcttgtctcaggcttgaattttctagaagtcactacatgatttctgtgtgtgtgtgtgt

SEQ ID NO: 71513 - DNA, 201 bp, Homo sapiens
gtagatttagacaaggtgcttaatggaagactccctgagaaggtaccataaaggaagacttaaaggaagaacaggagcttccaagcagaggaaagagcatrttctaggcccagagctgagagtgggggtgagtggtggaggggtgtggcaagagattcaactggagagatcgagaggacagataagtgttaaaggtagtcg

SEQ ID NO: 71514 - DNA, 201 bp, Homo sapiens
gctgagggaatagtcttgcacattttttcatttcttacttgtctaaaagtaaaaaaaaatatcagcctgtctcctaggtcagtcccctcctggacccaccygctcccttttttccttagccttcagtgccatggaactaatcaagggaggaaaaggtcaccagggagaactggacagaactgaaacacagcaacaccagtt

SEQ ID NO: 71515 - DNA, 201 bp, Homo sapiens
gaaatcgcggcttcctccttgcacgccgctcgctgtttcagcgcaagccggatctcccctcacacccaacagcaccaccttccgagactagcggctcattrccgcccagtccccgcggcccggcgcaagaactcctcgccgggccccattccaggctgggtcgggtctttagaataaggaccagttgtgtgtctccctgtc

SEQ ID NO: 71516 - DNA, 201 bp, Homo sapiens
tggctctggccacccccacccaagaccctgaaccggaataagcacgttggaaaatgaatgaatacaaagtgttataaagtaaaaatctgtctagtctgtgmtaaatacacgaatgcatgataaactgtgaggtgtggaggcagtcagggagcctgccctatttgtgattgtttttgaacttcatggtagtaagaggtgttc

SEQ ID NO: 71517 - DNA, 201 bp, Homo sapiens
ctcgtgcttatgggcacgcaccaccacacctggctaatttttgtgtttttagtagaggcagggtttcaccatggtggccaggctggtctcgaactcctgayctcaggtgatctgccttcctcagcctctcaaagtgctgggattacaggcatgagccccgcacctgaccaactcttgtttatatcaattagctggtggtaa

SEQ ID NO: 71518 - DNA, 201 bp, Homo sapiens
ccctcaccccagtcaagctcttgggagttaaagaatctctttcttttgtgagtttaaacgacttttgttccaagaacctctaaactgagcagttctgacarctccaccagagagacgaccacctttctcctctctgaggagctgtgtcagcatatccccaacagcagcattgcagcatccgatttattcttggaactagga

SEQ ID NO: 71519 - DNA, 201 bp, Homo sapiens
ccataatctaaattccagcctatgttcctcttcctgaagttcacttcagacaagctcaactcatttctccctgtactcccctctcttggccctctacataytcatacctccatggagagtgccttttccacacctgtccacagtccacgtctcacccagttattttttccttaagattctattttttccttaagattcccc

SEQ ID NO: 71520 - DNA, 201 bp, Homo sapiens
acccagagtcataccattctgccattttgtttctggcttttcttcatagttcaaagtcagccaactacctgcccttagcaagcgtggagagaaccccccgyaccacctcagcaaagggcttgtgtgtggaggagctgccacccacgctccatttcaccaaagtgacaactaatgctagggagggcgaacctctcatcggcg

SEQ ID NO: 71521 - DNA, 201 bp, Homo sapiens
cgccgctcgctgtttcagcgcaagccggatctcccctcacacccaacagcaccaccttccgagactagcggctcattaccgcccagtccccgcggcccggmgcaagaactcctcgccgggccccattccaggctgggtcgggtctttagaataaggaccagttgtgtgtctccctgtcgctggcagcggatcactttctgg

SEQ ID NO: 71522 - DNA, 201 bp, Homo sapiens
attaatgtgatataataatagatgggttatacagcaggctccttgaatgacagctggctccgtccgtctcggcaccacaggaaggcaggaaagaagtgtaycttttcatctctaacttgccactgtcactacctttacatatctgtgggctaatagcatttgtgcatatatattttaaaaattaatatttattaaagcact

SEQ ID NO: 71523 - DNA, 201 bp, Homo sapiens
gatccacccacgtcagcctcctaaagtgctgggattataggcatgagccaccgttcctggcctcaaacaatgtttttcttaaatggctgagacacacatcygtctaaaaactgtagaacatgcaagtgagcagtctgaagtcaagaaatctgtgacttaagtctctgtgacctgcatttatttactggcctaggtacttca

SEQ ID NO: 71524 - DNA, 201 bp, Homo sapiens
tcctgacctcaggtgatctgccttcctcagcctctcaaagtgctgggattacaggcatgagccccgcacctgaccaactcttgtttatatcaattagctgrtggtaaaattggttttgttatacgtcatttcacttacagttgcagtttctaagaacctattttttccaggcatgctgttaagtggagacttactgaagag

SEQ ID NO: 71525 - DNA, 201 bp, Homo sapiens
ctacatggttcttttttttttttttgagatggcgtcttgctctgttgcccaggatggagtgcagtggtgcgatctcaactcactgcaacctccgcctcccrggctcaagcgattctcctacctcagcctcccgagtagctgggattacaggcacacgccaccatgcccagctaatttttgtattttttaggagagatgggg

SEQ ID NO: 71526 - DNA, 201 bp, Homo sapiens
ggcacctatagtcccagctactcgggagactgaggcaggagaatggcgtgaacccaggaggcagagcttgcagatagcgccactgcacttcagcctgggcraaagagcgagactctgtctcaaaaaaaaaaaaaaaaagtagtctaagagaagcagaatgcaacattacttagataacgtacttgtgtggactggtttagg

SEQ ID NO: 71527 - DNA, 201 bp, Homo sapiens
tcaatattgaatgttagaagtgttttgggtctttatttagaagtttgctgatgtttttatgactagaaatattgccacaagaacttcactcttcttttttkgtttttttttgtttttttgttttgagacagagtctcactctgtcacccacccaggctggagtgcagtggcgcaatctcagctcactgcaccctccacctc

SEQ ID NO: 71528 - DNA, 201 bp, Homo sapiens
agtctgaagtcaagaaatctgtgacttaagtctctgtgacctgcatttatttactggcctaggtacttcaacacttcagggatgtcccccgctgcctcccycaccccagtcaagctcttgggagttaaagaatctctttcttttgtgagtttaaacgacttttgttccaagaacctctaaactgagcagttctgacaactc

SEQ ID NO: 71529 - DNA, 201 bp, Homo sapiens
tgtttttgaacttcatggtagtaagaggtgttccttaccatttttgctttgcaaacatttattccctgaattaacccaccactattatggccgccatcatycacttattctccaaaaattgggtaaataaataccatgtttgtttttattaacctttcttaaatgttgtatagctcacatttatttcaatattgaatgtta

SEQ ID NO: 71530 - DNA, 201 bp, Homo sapiens
catgataaactgtgaggtgtggaggcagtcagggagcctgccctatttgtgattgtttttgaacttcatggtagtaagaggtgttccttaccatttttgcyttgcaaacatttattccctgaattaacccaccactattatggccgccatcattcacttattctccaaaaattgggtaaataaataccatgtttgttttta

SEQ ID NO: 71531 - DNA, 201 bp, Homo sapiens
aatgcatgataaactgtgaggtgtggaggcagtcagggagcctgccctatttgtgattgtttttgaacttcatggtagtaagaggtgttccttaccatttytgctttgcaaacatttattccctgaattaacccaccactattatggccgccatcattcacttattctccaaaaattgggtaaataaataccatgtttgtt

SEQ ID NO: 71532 - DNA, 201 bp, Homo sapiens
gaatgcatgataaactgtgaggtgtggaggcagtcagggagcctgccctatttgtgattgtttttgaacttcatggtagtaagaggtgttccttaccattyttgctttgcaaacatttattccctgaattaacccaccactattatggccgccatcattcacttattctccaaaaattgggtaaataaataccatgtttgt

SEQ ID NO: 71533 - DNA, 201 bp, Homo sapiens
ctgtatctcactttaatctagaaaagggtatctaagaaccacttttgaaaagttgaaatgggcctgacatattggctcatgcctgtatccaatactttagsaggctgaggcgggaggatcactcatgcacaggagttcgaaatcagcctgggcaacttgatgaaaccctgtctttacaaaaaatacaaaaattagccaagc

SEQ ID NO: 71534 - DNA, 201 bp, Homo sapiens
agatactaagttcaggttactttcaaaaccaaaatatgatatctgtttctcaggtaactttttcttaaacctttattctgtttgaaaaggcagaccagatrgcaacaaggggttttaaaaatagactaggttaccccatatagaagttgggaaaaacctcatcttctgtttgaaaaattcttcaattgagtgcatgaatag

SEQ ID NO: 71535 - DNA, 201 bp, Homo sapiens
tgtacacacccgggacatccttctgtccacagcccaggccccagctgatgatgcccaccaaagtcatgcggccatcgttcagacacaccagggggcctccygaatcgccctgcaaaggagatagcaggtttggcgtttgcaaaaaaagcagactatctggagaaagtcagtatgtgtagcatgaacatcgtaatcttcaaa

SEQ ID NO: 71536 - DNA, 201 bp, Homo sapiens
cacgcctgtaatcccagcactttggaaagctgaggcgggaggattgcttgagcccaggagtttaagaccagcctgagcaacatagtgagaccccatctccmcaaaaagtgaaaaaaattacctgagcatagttgtgcatgcctgtattcctaactttgtgaggggctgaggtaggaggattgcttgagcttgggaagttga

SEQ ID NO: 71537 - DNA, 201 bp, Homo sapiens
tgttcaaatgatacaattctctcatgctactctaaagtttataaagaaaaaggatttacactttacacactgtacacaaaaggaataccttctgagagccrgggagtggggaaaggggaaggagacttgacgtcaagggtgcttttgaggaacatgacgggccagccagcctgccccaactttgaggccctgctgggctct

SEQ ID NO: 71538 - DNA, 201 bp, Homo sapiens
agctgaatttctgccggagattcagtggctgggggttccttcgcactggtcctcagtgtttttttttttttctttctttctttctttttttttcttgacaragtcttgctctgttgcccagggtggagtacagtgacacaatttcagctcactgcaacctctgcctcccaggctcaagcgattctcctgcctcagtgttcc

SEQ ID NO: 71539 - DNA, 201 bp, Homo sapiens
gatatagagtgtttctagggtaagggacctgcaggtgtaagcatagatgaaataactgtcctgtcacacgtgcagcaggccatggagtgtagcgggcatcrctgccgccattcctgcagcatcaccataagcagtgcagggtgtctccatcgagctgtttggttccatgtgtgtttaacatgtgcagaagtagcttctctg

SEQ ID NO: 71540 - DNA, 201 bp, Homo sapiens
tattgataaatcaggtaggtgcttttaatatgttctcagaaatatgaaaatagaaagggacctctttcatataatgcttgtagtttcagaattaacccccrttcaaggtcatccacttcaatttagtgcctactttgtgccaggcactgtgctgggtactgggaatggacgttaatattatgatgcagaccagggtttatt

SEQ ID NO: 71541 - DNA, 201 bp, Homo sapiens
gctgggggttccttcgcactggtcctcagtgtttttttttttttctttctttctttctttttttttcttgacagagtcttgctctgttgcccagggtggartacagtgacacaatttcagctcactgcaacctctgcctcccaggctcaagcgattctcctgcctcagtgttccaagtagctggagccacaggcgtgcacc

SEQ ID NO: 71542 - DNA, 201 bp, Homo sapiens
gactggtcacatgttacaagttaaaaacatggagacataatgacaatacatttttgtacattatgcctttgtcatagtagtgtactttttgattttgtttrtattattcagagtcattagaaaagttaatttagttactagacagtagcttttcaaaaagaaaaaattagattactggggtttttttctgtttattttttc

SEQ ID NO: 71543 - DNA, 201 bp, Homo sapiens
ggcgcaatctcagctcactgcaccctccacctccggggttcaagcaattctcgtgcttatgggcacgcaccaccacacctggctaatttttgtgtttttartagaggcagggtttcaccatggtggccaggctggtctcgaactcctgacctcaggtgatctgccttcctcagcctctcaaagtgctgggattacaggcat

SEQ ID NO: 71544 - DNA, 201 bp, Homo sapiens
attataaaaggtccatgagctatgaatattatactccccagtgcaaatgatgactggtcacatgttacaagttaaaaacatggagacataatgacaatacrtttttgtacattatgcctttgtcatagtagtgtactttttgattttgtttatattattcagagtcattagaaaagttaatttagttactagacagtagct

SEQ ID NO: 71545 - DNA, 201 bp, Homo sapiens
gtggctatcgtattaagctgcgcatttcttgtgtatgtgtgagctgttgccaaaacatgacatcaaattcagtgttcttggaagccctcttcaaagaacastgattgtgttgcagtcaggcaacgcaaaacatgaggcacggcccttttcttcaaggagtttgcggttcggttgagaaaatagacacccacagataagtag

SEQ ID NO: 71546 - DNA, 201 bp, Homo sapiens
gtgtgcctgtggtcccagctactcaggaggcagtggtgggaggatcacttgagcctggtatgtcgaggctgcagtgagctatgatcgtgccactgcactcyaaccaggctgaccgagccagaccctatctcaaaaaaaaaagaaagaaattataaaaggtccatgagctatgaatattatactccccagtgcaaatgatga

SEQ ID NO: 71547 - DNA, 201 bp, Homo sapiens
tccgtgacttctctgaatccttttcttctgtcaaatcatgacagcctaccctaccttatggggtttttgtaaggaccagatgatgtcagatgaaagcattytaaaaaaattatagagacaagaggatcacttgagcccaggagttcgagaccagcatgggcaacatggccaaaccttgtctctacaaaaaaaaaaaaaaaa

SEQ ID NO: 71548 - DNA, 201 bp, Homo sapiens
gacgagggaaacaataggacctgtatgttttacacacagttctcattcgaaatgtatcatgatcatatttttaaagatgcgtgttacctttcataaatacytaaataaaacttactttctgttgtctgcggaggaacttgataaacattaaaaaagcaagaatatctttggtggccatgtgtctgggatgtggggttcacc

SEQ ID NO: 71549 - DNA, 201 bp, Homo sapiens
ggatgatgtcagcttccatccttgtgttcgtttcaaacgctgggaatctgagcgcatcctctccttcatccctcctgatggaaacttccgcctgctgtctyaccatgtcagtgcacagaagtaagcagctcttataattaagaatggaatccgtgtatgtacatgtatgtggaaaccgtatctgtggtgattaagaactca

SEQ ID NO: 71550 - DNA, 201 bp, Homo sapiens
ttgcttggctttaattatctaaagccaatgaaagacttctttgttgattttttaagatagaaagattaaaaagaaagaaagatgggaagaaaatgaatgtyagtcaaggaaaggccacttaaggatctgctctatgaaggagaagaaagaggaaaaagaagtaaaggagttaggaggagacacttaaatgaaagattggca

SEQ ID NO: 71551 - DNA, 201 bp, Homo sapiens
gaaaaagaagtaaaggagttaggaggagacacttaaatgaaagattggcaagaaaagcagtcggactctaccttaaggagggatgggaaggaaagagttgwgttggtttctttctgattcctctactcatgtagaaaacacttgtacttctggaaatggactggagactttttaaatttgagtccactattgacatggaaa

SEQ ID NO: 71552 - DNA, 201 bp, Homo sapiens
tcaccggccattttcctgttacctgatccttctacaggatttttaaaaagtaagagagtttcagagaagccgatcccataatccccagtgcagccagggtytgtgtgtcatcgtactggagtagagggccgactcttcccatgaaggtgagcacagctgtgagtgagtgagctcatatctccatttgtcagtgctggactg

SEQ ID NO: 71553 - DNA, 201 bp, Homo sapiens
gagcacagctgtgagtgagtgagctcatatctccatttgtcagtgctggactggtaccagatcgtaaccttcccgttggtcggaaacttttccatctgtcrccctagaaaaagagaaagcttaccatcgagggtgtggttgatccttgaagctgcttggtaaagttatcatttcctcagtcttttcttttgtactcctatc

SEQ ID NO: 71554 - DNA, 201 bp, Homo sapiens
agtggagacttactgaagagtgggtagattgtatctcagttatcttggtcccatggaggattaggctgtatctattctggtaaagtagagttaattactcmaacgtttcaggcctcaaaaaccctggcttggctccatcacttactagctgatggccttagactaaccatgctttggttttcttatctgtaccatagagat

SEQ ID NO: 71555 - DNA, 201 bp, Homo sapiens
ttaccatcgagggtgtggttgatccttgaagctgcttggtaaagttatcatttcctcagtcttttcttttgtactcctatcatgtattcattaatatctaycagtcccttttcattctaagacaaaacatttctcctaaatctctgaataaaatcagtgctgtaggaagatggactgtgttgatcatgggtgtaagcaacc

SEQ ID NO: 71556 - DNA, 201 bp, Homo sapiens
taatttagcacctaacgttagccttttaaataaaaggacaaagagttcttggaatgctagcgtcttaaagatagtccaaaggaattttcaggtgtgctagyttgtccccttcatttcatttttttcccctcaactcttattcactgcatgaatgttaagaaatagcacagcagtaggggtaaagattttcatgtactgttc

SEQ ID NO: 71557 - DNA, 201 bp, Homo sapiens
tggtattactcacttcctctcccatctgataagattctggtttctatttattgaattggctgcatgcaaaatgacaaatggaatacttttgaacctcttgygtgggaaagtcatcctatttgcgatgactatatatagcctttctagctctgattctactttttgctcacaaattagagtttagattgtttttgcctggtg

SEQ ID NO: 71558 - DNA, 201 bp, Homo sapiens
acagtcgcactggtgaaactgacagccgctatatggccatactaatgtaacttattacaagacaggaagtgagaagagttgtttgatctagttgaaaccaygggggaatttgggaaagcagagtaaatttgctaatttggaagtctgagacttcagagcttgttattcttgaagcagttgttaaaagtcagtggacatcct

SEQ ID NO: 71559 - DNA, 201 bp, Homo sapiens
gaactcgtgagctccagcggtctgcccgcggaggcctccctaagtactgggatcacaggcgggagccccaagggatctttttaaatgtcttactgcattarcaagtgcctaaggagtgctcagagaatagctctgattggatgaataaagacccccaagggcagctttccattcctcccaccaattctggtgggcagaaat

SEQ ID NO: 71560 - DNA, 201 bp, Homo sapiens
ctgaatttctgccggagattcagtggctgggggttccttcgcactggtcctcagtgtttttttttttttctttctttctttctttttttttcttgacagartcttgctctgttgcccagggtggagtacagtgacacaatttcagctcactgcaacctctgcctcccaggctcaagcgattctcctgcctcagtgttccaa

SEQ ID NO: 71561 - DNA, 201 bp, Homo sapiens
ttgacagagtcttgctctgttgcccagggtggagtacagtgacacaatttcagctcactgcaacctctgcctcccaggctcaagcgattctcctgcctcaktgttccaagtagctggagccacaggcgtgcaccaccacacccagctaacttttgtattttagtagagatggggttttgccacgttggccaggctggtctc

SEQ ID NO: 71562 - DNA, 201 bp, Homo sapiens
gcgagactctgtctcaaaaaaaaaaaaaaaaagtagtctaagagaagcagaatgcaacattacttagataacgtacttgtgtggactggtttaggggttcratttctaatgagcagaaaattaagacaatgggagacagatggcccaaataccagcttctaggccgaaccaacggttgggatgttgctgtgttagcaaggt

SEQ ID NO: 71563 - DNA, 201 bp, Homo sapiens
tttccaggcatgctgttaagtggagacttactgaagagtgggtagattgtatctcagttatcttggtcccatggaggattaggctgtatctattctggtamagtagagttaattactcaaacgtttcaggcctcaaaaaccctggcttggctccatcacttactagctgatggccttagactaaccatgctttggttttct

SEQ ID NO: 71564 - DNA, 201 bp, Homo sapiens
ttctattttggaaccactgggcctttccaggtcagttcactatagtctgtgccgaccttagcacggtagtcatcagttaccactttgggggcatttaccaygttccaggcactgttttaagctcttttcatgtgttttcttttttaatccttagaaactctgtgatgtggaaaggagatgactttagctttatatgaagtt

SEQ ID NO: 71565 - DNA, 201 bp, Homo sapiens
ataggatggtggcgtctgtccagggctggtcccgcctggcgccctgagctgccaggtggctctggccacccccacccaagaccctgaaccggaataagcasgttggaaaatgaatgaatacaaagtgttataaagtaaaaatctgtctagtctgtgctaaatacacgaatgcatgataaactgtgaggtgtggaggcagtc

SEQ ID NO: 71566 - DNA, 201 bp, Homo sapiens
tttttttttttttttttttttttttttgagacagagtctcactctgtcgcccaggttggagtgcagtggtgcgatcttagctcactgcaacctctgcctcytgggttcaagcgattctcccgtctcagcctcctgagtagctgggaccacaggtacgtgccatcacgcctggctaattttttaattttagtagagacaggg

SEQ ID NO: 71567 - DNA, 201 bp, Homo sapiens
cactagaatataagcctcactaggacaggggtttttttttttttttttttttttttttttgagacagagtctcactctgtcgcccaggttggagtgcagtsgtgcgatcttagctcactgcaacctctgcctcttgggttcaagcgattctcccgtctcagcctcctgagtagctgggaccacaggtacgtgccatcacgc

SEQ ID NO: 71568 - DNA, 201 bp, Homo sapiens
ccaccagtcccttcccgtgtgatgtggaatgaatcatttgggaaaatatctgagtgcttgaggtcaaagcctctggaatcagactccctggacttaaaccycatcttcagtacttagaaccttgggcaagttacttaatctcagttaagtataaggacatcagtattcatctataaaatcagtacctactacatagttaca

SEQ ID NO: 71569 - DNA, 201 bp, Homo sapiens
atgactagaaatattgccacaagaacttcactcttctttttttgtttttttttgtttttttgttttgagacagagtctcactctgtcacccacccaggctrgagtgcagtggcgcaatctcagctcactgcaccctccacctccggggttcaagcaattctcgtgcttatgggcacgcaccaccacacctggctaattttt

SEQ ID NO: 71570 - DNA, 201 bp, Homo sapiens
ttcccctcatcttagcagacatccctggctaattctgtcagcaggacaagctgcaccccatgcagttctcaacctaatgagcttcaccttcctattagccygcgaaataattcaaacaaaccaatcacatgctccaatgggaaccaagggccatcctgccctcttgtctctaccaaggctgcctctctgggggtttgctct

SEQ ID NO: 71571 - DNA, 201 bp, Homo sapiens
tcctggattcaagcgattctcctgcctcagactcccgagtaactaggattacagggcgcccaccaccatgcccagctaattttttttttttttttttttgkatttttagtggagacagggtttcactatgttggccaggctcgtcttgagatctgcctgcctcggcctcccaaagtgctgggattacaggcatgagccatt

SEQ ID NO: 71572 - DNA, 201 bp, Homo sapiens
agaagcactgcgcctttgcagtgtcttctgaagaagaagaggcgggatctcatttgcttttgaggagtcgggtgttcctggtcacggtcgcatgttgtcaygaatccagtctaggtagttggtaaccttggtgtacacacccgggacatccttctgtccacagcccaggccccagctgatgatgcccaccaaagtcatgcg

SEQ ID NO: 71573 - DNA, 201 bp, Homo sapiens
agtcctcgaaaagaaaggagctgatcattggctggatgtgggcgggagaagtggacgttgtcagggatgcatctgtgtttctggcttaggcagcaggataratggtgccatcacacagatttggaaatgggagcaccgggttcagggcatgagagaatggactcatttctgacatgtgcctcagtgtcatccaagtggaga

SEQ ID NO: 71574 - DNA, 201 bp, Homo sapiens
tgtccctggtctaaaagaagcattaagttatgctatgaaaaagcataaaacgcagtgatttttggtcttgaacattctctttaatttggaatctaaaggcytttggaagcagttttgtatagtataaggtatgcagacagaagagagtcaggaggcctcagagccaccagtcccttcccgtgtgatgtggaatgaatcatt

SEQ ID NO: 71575 - DNA, 201 bp, Homo sapiens
tctcctgaggaacctacaggattctaaggtttcctaggtcactgaacaactaatcttggtccctgaatatttctaggtttgtaagtgcagcagttttattkcctctagaactcatcctgtttcaagggaagtacctaagaagatatagagtgtttctagggtaagggacctgcaggtgtaagcatagatgaaataactgtc

SEQ ID NO: 71576 - DNA, 201 bp, Homo sapiens
agcaaagtatgcgcaaacatcacaatattgagcaaaaaatcagatgcataagattatagacagtgggattacatgtatatgaagtttgaaaacagatgcartttagtctaaggtaatagaagtcagaattttggggatgtgaattacctgggatgggtaagagggagtgcttggatgctgaaaatgttccgtatcttgctg

SEQ ID NO: 71577 - DNA, 201 bp, Homo sapiens
gaaaaactgtgaaaaatatatctgaatttattaagtacagtataaaacagggttgtggcaacagaaagtaaaaactaacatggattgctataaatatgctkaagcctagttgttcaaatgatacaattctctcatgctactctaaagtttataaagaaaaaggatttacactttacacactgtacacaaaaggaatacctt

SEQ ID NO: 71578 - DNA, 201 bp, Homo sapiens
tctttggtggccatgtgtctgggatgtggggttcacctatcatctgccccagggatcctaagaggggaacagatggtgttttcaaaacctatctggaaatwaaaaaggttacggtgctgagaggaagagcagagtccaagaggagggggctgtgagagagaaacgcagagagaggataaagctaggacttccagttattct

SEQ ID NO: 71579 - DNA, 201 bp, Homo sapiens
tcacagctttgctgttcgaccttgggcagttatttaagctgtctttgcagcttcctcatctacgaaaaggggatcacaacggtaattcattttagagtagytggggggattaaatgatttcagatcctcctctcttatgtgaactcttaaatttggagtgtccctggaatctggttctcttatctctccacactccttccc

SEQ ID NO: 71580 - DNA, 201 bp, Homo sapiens
aaatgggaagtatctgggaaaatgcactcttccctctcctgtagggtctcgtcccgcttctgcggtgtggtgggtctggagaagtctgtagagaagcactscgcctttgcagtgtcttctgaagaagaagaggcgggatctcatttgcttttgaggagtcgggtgttcctggtcacggtcgcatgttgtcacgaatccagt

SEQ ID NO: 71581 - DNA, 201 bp, Homo sapiens
gcgtctgggcccaggcgggcgcgcgtcgcgctcggatttcgggcggatagtgcgtgggaggcggcgctgccctccgtatgcagcgcgcgtgcagccaaggyggcgctgcgatctgcggcctggggccctggtgtgaaactcccgcggagacgctcccagccccgggccgcagctcgcccctgcacggagggaggtgtctaa

SEQ ID NO: 71582 - DNA, 201 bp, Homo sapiens
tggtggctcacatctgtaatcccagcactttgggaggccgagttgggtggatcattaggtcaggagttcaagaccagcctggccaacatagtgaaaccccrtctctactaaaaatacaaaaattagccggatgtggtggcacgcgcctgtagtcccagctactcgggaggctgaggcaggagaattgtttgaacccggaag

SEQ ID NO: 71583 - DNA, 201 bp, Homo sapiens
ttgatgaggaaaacaaaaatcaattcctgtctggggacactgtctgcctgggttttgtccaggtaccccggtttccttccacatcccaaagcttgcacatyaagccaactgaggatgtatctacgtgggcccagtctgagtgagtgtgggtgttagtggctctgcaataggatggtggcgtctgtccagggctggtcccgc

SEQ ID NO: 71584 - DNA, 201 bp, Homo sapiens
gaagtctgtagagaagcactgcgcctttgcagtgtcttctgaagaagaagaggcgggatctcatttgcttttgaggagtcgggtgttcctggtcacggtcrcatgttgtcacgaatccagtctaggtagttggtaaccttggtgtacacacccgggacatccttctgtccacagcccaggccccagctgatgatgcccacc

SEQ ID NO: 71585 - DNA, 201 bp, Homo sapiens
cagggagcctgccctatttgtgattgtttttgaacttcatggtagtaagaggtgttccttaccatttttgctttgcaaacatttattccctgaattaaccyaccactattatggccgccatcattcacttattctccaaaaattgggtaaataaataccatgtttgtttttattaacctttcttaaatgttgtatagctca

SEQ ID NO: 71586 - DNA, 201 bp, Homo sapiens
ggttgcagtaagccctgatcatgacactgcactccagcctgggcaacagcaagaccctgtctcaaaaaaaaaaaaaaaaaaaaaaaaaaaagtaacaaatwaatttcttattgattaaattaccttctcgaaagtatttggctcccagttctgatggcagaactaaagttgtaatcacaaaattcagggagctgccttttc

SEQ ID NO: 71587 - DNA, 201 bp, Homo sapiens
tctcctctctgaggagctgtgtcagcatatccccaacagcagcattgcagcatccgatttattcttggaactaggatgtcagtgagaacaaaagctgccaracagcagccaggaataggggttgcatctcgcgagtagaaagtagtctaagagggctgggtgcagtggctcacgcctgtaatcccagcaccttgggaggcc

SEQ ID NO: 71588 - DNA, 201 bp, Homo sapiens
tcatgtagaaaacacttgtacttctggaaatggactggagactttttaaatttgagtccactattgacatggaaaccccagtggaatcagattttccctcraagaccatgatggtatcggactagttttcagacactgcctgttgctgtccatcagcacttggtctcttatcttcagtgagaaggtgacccgccttcttcc

SEQ ID NO: 71589 - DNA, 201 bp, Homo sapiens
gaggaactttctcccaaaagaaccaatcaacttctaactgttgtggttatttgcataactcaaatgagaagcgagggccttttggtttaacttctgtgtcrtatgaggtctggaatgagtcatatgaacactggaattgtggaattggagaagagaatgaggacccacacactatgataaaagttaaaaagcaagtcaaag

SEQ ID NO: 71590 - DNA, 201 bp, Homo sapiens
gcggctcattaccgcccagtccccgcggcccggcgcaagaactcctcgccgggccccattccaggctgggtcgggtctttagaataaggaccagttgtgtrtctccctgtcgctggcagcggatcactttctggctgaagaaaagacaaaacgacgagggaaacaataggacctgtatgttttacacacagttctcattcg

SEQ ID NO: 71591 - DNA, 201 bp, Homo sapiens
attgcttgaacctgggaggtgggggttgcaatgagctgagatcatggcattgtactccagcctgggtgacagagcgagactgtctcaaagaaacccataartaagtaagtaaataaataaataaataaataaataaatgggatatccatcccctgaagcatttatcctttatgttacaagcaacccaattatacttttatt

SEQ ID NO: 71592 - DNA, 201 bp, Homo sapiens
gtgtgaaactcccgcggagacgctcccagccccgggccgcagctcgcccctgcacggagggaggtgtctaaaggtgtctcttaggaacaggcacaacccgrgcagccgggccccagaacaatgggtgctttcagccgcccctttagatgcctggcccgtcaccatggcaaccaccccattattgaaagtcagtgccggtcc

SEQ ID NO: 71593 - DNA, 201 bp, Homo sapiens
gttttgtcctccagaaaattggagaaaagacagctttcagaccggaatctaattttttcccagcatttgattagaaaaaacttcaaacatacaggaaattygtaagacatgtacagtaaatggctgggtgcggtggctcacacctgcaatcccagcactttgggaggccgaggtgggaggatcacttgatcccaagagtta

SEQ ID NO: 71594 - DNA, 201 bp, Homo sapiens
tgcaattggtggccatggtcccgacagagagccctgtcctcttctacaaattcacacaatcttctgtatgttttctagagccattaaagcttttttaaaakgagcactgttctttgaaatctaaggaaaactggcaatcatctctctaagccagttccaagtaccgtatatatatctcaagccataataattacttcattt

SEQ ID NO: 71595 - DNA, 201 bp, Homo sapiens
attgcacatgccatcttataacctactatatactttacttatgtatattgattattatctgtcttttccccactagaatataagcctcactaggacagggktttttttttttttttttttttttttttttgagacagagtctcactctgtcgcccaggttggagtgcagtggtgcgatcttagctcactgcaacctctgcc

SEQ ID NO: 71596 - DNA, 201 bp, Homo sapiens
tacaggaaattcgtaagacatgtacagtaaatggctgggtgcggtggctcacacctgcaatcccagcactttgggaggccgaggtgggaggatcacttgakcccaagagttagagactagcctggacaacatggtgaaaccatgtctctactaaaaatacaaaaattagccaggtgtggtggtgcgtgcctgtagtcccag

SEQ ID NO: 71597 - DNA, 201 bp, Homo sapiens
atccccaggggcctcactgcctcagttcatttcattaatcctgaagaagagcttgtcctgcaaagggggaggggatgaaaccagctgaatttctgccggarattcagtggctgggggttccttcgcactggtcctcagtgtttttttttttttctttctttctttctttttttttcttgacagagtcttgctctgttgccc

SEQ ID NO: 71598 - DNA, 201 bp, Homo sapiens
caggagcattctggccttacaggctttgcagtgcctgttccctttgctggaatgctctcccccaagatctccctatagttaactcttctgccttcttcaartctttgcactaatgtctcttctcaatgaggcttgttctcactactctcttaaaaactgtaatttgccctccaatcccataacactcctggtagttttttt

SEQ ID NO: 71599 - DNA, 201 bp, Homo sapiens
acagcagccaggaataggggttgcatctcgcgagtagaaagtagtctaagagggctgggtgcagtggctcacgcctgtaatcccagcaccttgggaggccraggcaggcggatcacgaggtcaggagatcgagaccatcctggctaacacggtgaaaccccgtctctactacaaatatgaaaaattagccgggcatggtgg

SEQ ID NO: 71600 - DNA, 201 bp, Homo sapiens
ttgactgtatgttccttgaagtaacatagagtaccgcatctttgtacccgcagtgtccaggaggttgtaagcactccatcactgttagtttaataggtgaytgttcactagacattgtgagacacactgtggtttcccaaagagcttagaatccagatttggtcagcagatgcacatgttgatgcatggcagagtgtgccc

SEQ ID NO: 71601 - DNA, 201 bp, Homo sapiens
atcctgttaaaaacaggtgttatttccccaaatgctaaagctctttaggtcagcactgaatatgcaattttgtttttgtttttgtttttgagacggagtgycactctcttgcccaggctggagtgcagtggcgcgatctcagctcactgcaatttctgcctcctgcgttcaagtgattctcccacctcagcctcccaagta

SEQ ID NO: 71602 - DNA, 201 bp, Homo sapiens
ctacatttttagttgcatgttactctttctgctcacttcctttctgttatcttcaagtctttttttttttttttttgagactgagtctcgttctatcaccsaggctggagtgcaatggcacgatcttggctcactgcaaactctgccttccaggttcaagccattctcatgcctcggcctcccgagtagctgggattacag

SEQ ID NO: 71603 - DNA, 201 bp, Homo sapiens
tttagttcaatcctctcattttacgacccatgagacccaaggacctccctaggtaacctcctgaggtcacaccgccagtttgtggtgaccctgtcaccacrcagatgaccctgtgattgcttatcatccccacaatgctttcagacatgactcttaccctgacatcacgtactgtaccttgttttcacaacggacatgttt

SEQ ID NO: 71604 - DNA, 201 bp, Homo sapiens
gacttgacgtcaagggtgcttttgaggaacatgacgggccagccagcctgccccaactttgaggccctgctgggctcttgtgactataaatatactgtctrtttctaatgcaatccgtctttcctgaaagatcttgttatcttttactattgagacatgctttcatttttgtggtcctgtttccaaagctgctcacggtga

SEQ ID NO: 71605 - DNA, 201 bp, Homo sapiens
tggttgattggttggttggttggttggctggttttgtcttcagagatagagtcttgctatgttgcccagaatggtcttgaactcctggggtcaatcgatcygcccgcagcttcctgagtagttgagaatacaggtgtgtgctgtctcacccagctcttcatctgttttctatgaaaccttccatttgtctaaaatatttca

SEQ ID NO: 71606 - DNA, 201 bp, Homo sapiens
attaagccaactgaggatgtatctacgtgggcccagtctgagtgagtgtgggtgttagtggctctgcaataggatggtggcgtctgtccagggctggtccygcctggcgccctgagctgccaggtggctctggccacccccacccaagaccctgaaccggaataagcacgttggaaaatgaatgaatacaaagtgttataa

SEQ ID NO: 71607 - DNA, 201 bp, Homo sapiens
cttttgtgaccggctccactgtaccttggtacttctctaaatgccatattagcccatcagaccaagcattcctgtccctccttttcccggtctggagcacytagcccattgccttgtatgttacaggtgttgtgtatatgttaagcgagtgaagcagaattccaaatgattttaaaatgtgaacatgaataaagagtggga

SEQ ID NO: 71608 - DNA, 201 bp, Homo sapiens
ctacaaatatgaaaaattagccgggcatggtggcgggcacctatagtcccagctactcgggagactgaggcaggagaatggcgtgaacccaggaggcagascttgcagatagcgccactgcacttcagcctgggcaaaagagcgagactctgtctcaaaaaaaaaaaaaaaaagtagtctaagagaagcagaatgcaacat

SEQ ID NO: 71609 - DNA, 201 bp, Homo sapiens
aatgggattgctggattgcatggtagtgctatattaagttctttgagagatccccaaactgcttttcacagggcaacaaacatttactgaaacctcctgartgccagatattgtgctaggcaatggctacaaaggtgagcaggacagacacagtgcctgacctcagggggcacatactctagtggggaagactgacaaaga

SEQ ID NO: 71610 - DNA, 201 bp, Homo sapiens
gagatacatcgagagctgtcatcattaaaagggtattacactcatgaagccatctagggagagtgcagagaaagaaccgcggagcgtctactaacaagccrcagaataatgccatgcccctgaggtgagggtgtggcctcatgattggatattcttgtggctaatcatctggggaagggaccatttggtgcaataattatg

SEQ ID NO: 71611 - DNA, 201 bp, Homo sapiens
ggacagacacagtgcctgacctcagggggcacatactctagtggggaagactgacaaagaagaaaagaccacagataaataaacacagtaattacaagctkcgatgggtattataaagaatagagacagaatacttagggtggtagaggaagacaaagatggggggtagatttagacaaggtgcttaatggaagactccct

SEQ ID NO: 71612 - DNA, 201 bp, Homo sapiens
tacacactgtacacaaaaggaataccttctgagagccagggagtggggaaaggggaaggagacttgacgtcaagggtgcttttgaggaacatgacgggccrgccagcctgccccaactttgaggccctgctgggctcttgtgactataaatatactgtctatttctaatgcaatccgtctttcctgaaagatcttgttatc

SEQ ID NO: 71613 - DNA, 201 bp, Homo sapiens
gattgtggcctggactaaagtgatgacattgcattggagagattctgaattcctgatgtacattgaagatagaatccacagggtatgcttctgattacatraggggatgagggtaatggaggacttgaggatgactcatgggtttgagtagctggatggatggtggtattgtttactaagctggggaaaacagttgaggtt

SEQ ID NO: 71614 - DNA, 201 bp, Homo sapiens
ttgcttgaacctgggaggtgggggttgcaatgagctgagatcatggcattgtactccagcctgggtgacagagcgagactgtctcaaagaaacccataaadaagtaagtaaataaataaataaataaataaataaatgggatatccatcccctgaagcatttatcctttatgttacaagcaacccaattatacttttatta

SEQ ID NO: 71615 - DNA, 201 bp, Homo sapiens
atactttacttatgtatattgattattatctgtcttttccccactagaatataagcctcactaggacaggggtttttttttttttttttttttttttttttgagacagagtctcactctgtcgcccaggttggagtgcagtggtgcgatcttagctcactgcaacctctgcctcttgggttcaagcgattctcccgtctca

SEQ ID NO: 71616 - DNA, 201 bp, Homo sapiens
aagacaaagatggggggtagatttagacaaggtgcttaatggaagactccctgagaaggtaccataaaggaagacttaaaggaagaacaggagcttccaarcagaggaaagagcatgttctaggcccagagctgagagtgggggtgagtggtggaggggtgtggcaagagattcaactggagagatcgagaggacagataa

SEQ ID NO: 71617 - DNA, 201 bp, Homo sapiens
tatactttacttatgtatattgattattatctgtcttttccccactagaatataagcctcactaggacaggggtttttttttttttttttttttttttttttgagacagagtctcactctgtcgcccaggttggagtgcagtggtgcgatcttagctcactgcaacctctgcctcttgggttcaagcgattctcccgtctc

SEQ ID NO: 71618 - DNA, 201 bp, Homo sapiens
tgaaaacacccaaatttatatctcaagctcagcccactctcctgaaccctggacttatatgtccagctgccttctcaacatctccacttggatagttaatrgagctcacagatatattgatatactttggatgtttgtcccctccaaatctcatgttgaaatgtgatccccagttttggaggtgggtctagcaggtgtcat

SEQ ID NO: 71619 - DNA, 201 bp, Homo sapiens
tgggttcctgggcttagaggtaggaagtgtggaatctgagccattctgctcagatcttccaacgtccttgaatcacagctttgctgttcgaccttgggcagttatttaagctgtctttgcagcttcctcatctacgaaaaggggatcacaacggtaattcattttagagtagttggggggattaaatgatttcagatcctc

SEQ ID NO: 71620 - DNA, 201 bp, Homo sapiens
gcccggattggatcacatttgtgagctacatttttagttgcatgttactctttctgctcacttcctttctgttatcttcaagtctttttttttttttttttgagactgagtctcgttctatcacccaggctggagtgcaatggcacgatcttggctcactgcaaactctgccttccaggttcaagccattctcatgcctcg

SEQ ID NO: 71621 - DNA, 201 bp, Homo sapiens
aggagaattgcttgaacctgggaggtgggggttgcaatgagctgagatcatggcattgtactccagcctgggtgacagagcgagactgtctcaaagaaacmcataaataagtaagtaaataaataaataaataaataaataaatgggatatccatcccctgaagcatttatcctttatgttacaagcaacccaattatact

SEQ ID NO: 71622 - DNA, 201 bp, Homo sapiens
tgtagcatgaacatcgtaatcttcaaaatacagcaggcccttcaataatattccattcagtgtcatttcattataactttgatgaggaaaacaaaaatcarttcctgtctggggacactgtctgcctgggttttgtccaggtaccccggtttccttccacatcccaaagcttgcacattaagccaactgaggatgtatcta

SEQ ID NO: 71623 - DNA, 201 bp, Homo sapiens
ctctagaactcatcctgtttcaagggaagtacctaagaagatatagagtgtttctagggtaagggacctgcaggtgtaagcatagatgaaataactgtccwgtcacacgtgcagcaggccatggagtgtagcgggcatcgctgccgccattcctgcagcatcaccataagcagtgcagggtgtctccatcgagctgtttgg

SEQ ID NO: 71624 - DNA, 201 bp, Homo sapiens
actcatcctgtttcaagggaagtacctaagaagatatagagtgtttctagggtaagggacctgcaggtgtaagcatagatgaaataactgtcctgtcacaygtgcagcaggccatggagtgtagcgggcatcgctgccgccattcctgcagcatcaccataagcagtgcagggtgtctccatcgagctgtttggttccatg

SEQ ID NO: 71625 - DNA, 201 bp, Homo sapiens
gtgtctgttactatttaaatatttatacaaaagggtttttgtttatagcttaaggaatgatactgtgctctgcttggtgcatggagaaaaaggaagacccrtactctccacaccctagagcttttctctaaatattgtgcaaagtttttgctagttttatcttctgactttgggactagtttttgctgcagagttgtgttg

SEQ ID NO: 71626 - DNA, 201 bp, Homo sapiens
ttgcagcatccgatttattcttggaactaggatgtcagtgagaacaaaagctgccagacagcagccaggaataggggttgcatctcgcgagtagaaagtartctaagagggctgggtgcagtggctcacgcctgtaatcccagcaccttgggaggccgaggcaggcggatcacgaggtcaggagatcgagaccatcctggc

SEQ ID NO: 71627 - DNA, 201 bp, Homo sapiens
gttggagcctttttttgctgtcagtatctgtcccaagactggagaatccatctgctctgcataagtggttccctgtcacagcaatgtcggtcccactgacytcagtgtattgaacagaaacagttaggcgacctgctccttttgaataatactcatgtctattttccctctctccctcctttctaggactcaaggtgaatc

SEQ ID NO: 71628 - DNA, 201 bp, Homo sapiens
cgtcccaaggtgctgggattataggcttgagacaccatgcccgccaatttttttttttttagatgagtctcgctgtgttgcccaagctagactgcagtggygcgatctcggctcactgcaacctctgtctctgggttcaagcgattttcctgcctcagcctccccagtagctgtcagtacaggcacgcaccaccaccacac

SEQ ID NO: 71629 - DNA, 201 bp, Homo sapiens
ttttgtattcttggtgtgagagtaaaactggcacaatcttctcccgaagtacaatttagcaatatccaaacaaaattctacattgatgagctcatgtaccyaaaaattcctcttctaaagggctgcccgatacttcagggaacattgacatatggacatatgacacatacaagggttctcactacaatgctgctggaatta

SEQ ID NO: 71630 - DNA, 201 bp, Homo sapiens
cagtacctgatctaggggacttgcacactagtagggagacagtaaaacaactgtaataaaatgtgatttggcagagcctattaaaaatgattctatcagcygggcgcggtggctcacgcctgtgatcccagcactttgggaggccgaggcaggcagatcacaacgtcaggagatcgggaccatcctggctaacacggtgaa

SEQ ID NO: 71631 - DNA, 201 bp, Homo sapiens
taatcccagctactcaggaggctgaggcgggagaactgcttgaacccaggaagtggaagttgcagtgagcagagatcgagccactgcactccagcctgagygacagagggatactccgtctcaaaaaaagaaaggaaaagaaaaagaaattttagtctatgacaacaatagctacagcacacagtaaacactccgtaactc

SEQ ID NO: 71632 - DNA, 201 bp, Homo sapiens
ggcactgggtccgtgctgtcccatggaggtagggagcgctcctcggcccccgcctcgtggttcaatcctccccgcggaagagccccacactttgctgggtrtggccgcggctgcctctgtcccactcgctgcgctcccgggattcggagtcactgccaggaacgcacctagatgtactctagctggtggtggcgccatcct

SEQ ID NO: 71633 - DNA, 201 bp, Homo sapiens
gggtctggcctctaagaggcttttacggcctcctccgtcactacctggcgagtgattcagcctgcctttttttttttttttttttttttttttttttttgwgatggagtcaagctctgtcgcccaggctggagtgcagtggcacgatctcggctcactgcaacctccgcctcccaggttcaagcgattttcctgcctcagc

SEQ ID NO: 71634 - DNA, 201 bp, Homo sapiens
gcaggcgctcggtggacggatgggtggcggaatgaaggacacagaggccactgcggggtctggcctctaagaggcttttacggcctcctccgtcactacckggcgagtgattcagcctgcctttttttttttttttttttttttttttttttttgtgatggagtcaagctctgtcgcccaggctggagtgcagtggcacga

SEQ ID NO: 71635 - DNA, 201 bp, Homo sapiens
aaccttcagaattactgggattacagacgtgagccattgtgcccggccaggagtgagttatctaatgaagagtaacaataacagaaaatgtttatgagctsctgcatacaataatttcacaagtatttatcgaaaattgattacataccaggcaaaatgtatgcaaagattaaaatctgcagtacctgatctaggggactt

SEQ ID NO: 71636 - DNA, 201 bp, Homo sapiens
ctataagttgatgttttttcactacattttagactatatcaactttttttttctttcatcttttccagccatttcttcttggttctggttccgtgtgtacygcatgatattgtaccacgtgtcacggagactcgcttccttgttttctttcagtttcattttcccttgcacttcagatggaatgatatctattgatctctt

SEQ ID NO: 71637 - DNA, 201 bp, Homo sapiens
ggtttggcttttgttttttgggatagcgtctcactctgtcacccaggctggagtgcagtggtgcaatcatgactcattgaagcctcgacctgctgtgctcsagagatcctcccacctcagcctcctgagtagctgggactacagtcatgggcccccaagcccagctaatttttgtactttttctagggacaaagttttgct

SEQ ID NO: 71638 - DNA, 201 bp, Homo sapiens
gtgatgtcctctcttttattttgataacttagttttgtctctctctctttgatgagtttcgctaatgatttattattcttttcaaatagccataatgtctrtgttaactttattactttcagggtttttctgttttctattctatagattttctctcattattgcctttcttatacttattctgggtttatattgctcttt

SEQ ID NO: 71639 - DNA, 201 bp, Homo sapiens
tattatcttttttacatattgctaggtttgatttgctaatactttcttaagcatatttttgtgtctgtattcatgagagatattgatttatcattgtcttwttctgtaatgtctttctaagtttgggtatactcattattctggctttataaaataaactcagtttcctgagagtcttataagattagcattatttcttct

SEQ ID NO: 71640 - DNA, 201 bp, Homo sapiens
ccaaaagttgattctttgaaaagattaacaaaatggagaaatctttggcttgatttattaaaaaataagaatcctcaaattactaaaatcagaaatgaaartgggacattattgctgattctacaggaataaaaagggttagaagagagtactatgaaaaaatgtatgccaaaaaaacacatttatctagctaaaatgaac

SEQ ID NO: 71641 - DNA, 201 bp, Homo sapiens
ccaggttcaagcgattttcctgcctcagcctcctgagtaactgggattacaggtgcccgccaccacgtccggctaattttttttctatttttagtagagamgggggtttcactgttttggccaggctggtctcgagctcctgatctcgtgatccgcccgcttcggccttccaaagtgctgggattacaagcgtgagccacc

SEQ ID NO: 71642 - DNA, 201 bp, Homo sapiens
gatagaaaacatccaatgcgatttgttcttcagtcagaattttaaaagttaaggtgcctataaatgcacaggaagaaggctgagggatggtgggatgagarggtcctgtgggatggcagaaggccttggtgtctgctacgggtcctttgtccctgccagggctcacgttgaaatctgaaccgtaatgtagctggtggggcc

SEQ ID NO: 71643 - DNA, 201 bp, Homo sapiens
tctccattcacaggcatggcgggtggcaggaactggccccagccgaccacagtttcctaagtgcagaggtgcgactgcagtcttccctgctccctccccarcggtctaatctggagtctctaggtcatctactcccagtctcaaaaaattcctggatccttgaaaatctctaataacactgaaacaaaaaatacaacattg

SEQ ID NO: 71644 - DNA, 201 bp, Homo sapiens
ttgccaccatcgaagtgctgaaaccacactgttaaggagaaaatcttaaaagcagccagagaacaaagatctcctccccacagacaagccaggtgagaggsgcagcctaagccctgaaaaaccacacaggaagaggcagcggcagaggccccaccccagccggtgctgctcccctctcctcttcatcaggactgtccccgc

SEQ ID NO: 71645 - DNA, 201 bp, Homo sapiens
tcccgggattcggagtcactgccaggaacgcacctagatgtactctagctggtggtggcgccatcctgccaggtcaatccaagaagcagcgtgcttggctrtgacaagacagaacttcgcattcggagttcagggcacccctgaccccgcccccttttcggggcacctgcggctcctgttggctaaccctgaacttccttc

SEQ ID NO: 71646 - DNA, 201 bp, Homo sapiens
tcatttctactttgctgtttttaccattaatagaatgtgaaatataacaataaacaataacgtttgacacattgaaacgtatcaaatgttattttttggcrtctattgagatgattatattgtttttctcttttatgctattcaaatgtttaatcaaattgactttcaaatgttgcatctaacttgaattcctgggtcaaa

SEQ ID NO: 71647 - DNA, 201 bp, Homo sapiens
acaatgccctttaccagatcaaattccctttcatttctactttgctgtttttaccattaatagaatgtgaaatataacaataaacaataacgtttgacacwttgaaacgtatcaaatgttattttttggcatctattgagatgattatattgtttttctcttttatgctattcaaatgtttaatcaaattgactttcaaat

SEQ ID NO: 71648 - DNA, 201 bp, Homo sapiens
cggctaattttttttctatttttagtagagacgggggtttcactgttttggccaggctggtctcgagctcctgatctcgtgatccgcccgcttcggccttmcaaagtgctgggattacaagcgtgagccaccgtgcccggctcatcctgcttttggtttcaggtctccatgccagtgaaatgtcacctcaactccaccgtc

SEQ ID NO: 71649 - DNA, 201 bp, Homo sapiens
ggctggagtgcagtggcacgatctcggctcactgcaacctccgcctcccaggttcaagcgattttcctgcctcagcctcctgagtaactgggattacaggkgcccgccaccacgtccggctaattttttttctatttttagtagagacgggggtttcactgttttggccaggctggtctcgagctcctgatctcgtgatcc

SEQ ID NO: 71650 - DNA, 201 bp, Homo sapiens
gggagactatctggcacatgacacgggatgagacttggtgggggtcccacgggggacaggtccttccagcggttcctctgcacccagcgctgcacgggcayggggcgtgggtaatcagcctcccgaaagccacgcgagtcacggtcctgcctgcgaagaactcccagggcgaccttggggctgaggagtgggtaagagaaa

SEQ ID NO: 71651 - DNA, 201 bp, Homo sapiens
atgactatgatgtgtccaggtagggttttctttacatttatttttatgaggggtttatgaactttttgaatctataagttgatgttttttcactacatttkagactatatcaactttttttttctttcatcttttccagccatttcttcttggttctggttccgtgtgtaccgcatgatattgtaccacgtgtcacggaga

SEQ ID NO: 71652 - DNA, 201 bp, Homo sapiens
gcttggtgccataaccgccccctcccacattcccccaggagttgtcaatcttagttccccatgacacctggttgttagaatgaacctggcccctccccgtstcccttccggatctcatccccctcctcctgccatcctccccaccccttcccctgatgggcagaatccagctgtccttccccttcaccaccagtggaagtt

SEQ ID NO: 71653 - DNA, 201 bp, Homo sapiens
caactcgggaggatgaggcaggagaatcgcttgaacccaggaggcggaggttgcagtgagccgagattgcgccactgcactccagcctggcgacaagagartgactccgtctcaaaaaaaaaagaaaaagagaaaaatcaaccccaagttttctcaaagatgtgaaaaggagggaacccttcctaactgattctatgaggc

SEQ ID NO: 71654 - DNA, 201 bp, Homo sapiens
aagaaggatggagggccgggcgcggtggctcacgcctgtaatcccagcactttgggaggccgaggcgggcggatttggctaacacagtgaaaccccgtgtstactaaaaatacaaaaaattagccgggcgtggtggcaggagcctgtactcccagctactcgggaggctgaggcaggagaatcgcttgaaccaggaaggcg

SEQ ID NO: 71655 - DNA, 201 bp, Homo sapiens
gctgcaaaaatcttcaacaaaataataacaaactgaaactaacatttacagatttttattatttatttatttatttattaaagacagtcttgctctgtcascacgctggagtgcagtggtgtgatcatagctcactgcagccttgaactcctgggctcaagttatccccttccctcagcctcccaagtcactgggacttta

SEQ ID NO: 71656 - DNA, 201 bp, Homo sapiens
aaagaaggatggagggccgggcgcggtggctcacgcctgtaatcccagcactttgggaggccgaggcgggcggatttggctaacacagtgaaaccccgtgwctactaaaaatacaaaaaattagccgggcgtggtggcaggagcctgtactcccagctactcgggaggctgaggcaggagaatcgcttgaaccaggaaggc

SEQ ID NO: 71657 - DNA, 201 bp, Homo sapiens
ttgtctaagaaaagaaggatggagggccgggcgcggtggctcacgcctgtaatcccagcactttgggaggccgaggcgggcggatttggctaacacagtgwaaccccgtgtctactaaaaatacaaaaaattagccgggcgtggtggcaggagcctgtactcccagctactcgggaggctgaggcaggagaatcgcttgaa

SEQ ID NO: 71658 - DNA, 201 bp, Homo sapiens
caacgagcagaggagagaaagttactttttcctgccgggctgcgtgtttaaccaatttgtctaagaaaagaaggatggagggccgggcgcggtggctcacrcctgtaatcccagcactttgggaggccgaggcgggcggatttggctaacacagtgaaaccccgtgtctactaaaaatacaaaaaattagccgggcgtggt

SEQ ID NO: 71659 - DNA, 201 bp, Homo sapiens
ggctcacgcctgtaatcccagcactttgggaggccgaggcgggcggatcacctgaggtcaggagttcgagaccagcctgaccgacatggagaaacgcagcmtctactaaaaatacaaaattagcggggcgtggtggcggatgcctgtaatcccagccactcgggagactgaggcaggagaatcgcttgaacccgggaggca

SEQ ID NO: 71660 - DNA, 201 bp, Homo sapiens
gacaacgagcagaggagagaaagttactttttcctgccgggctgcgtgtttaaccaatttgtctaagaaaagaaggatggagggccgggcgcggtggctcmcgcctgtaatcccagcactttgggaggccgaggcgggcggatttggctaacacagtgaaaccccgtgtctactaaaaatacaaaaaattagccgggcgtg

SEQ ID NO: 71661 - DNA, 201 bp, Homo sapiens
taaatctggatgataactactgaatctgtctcttttcctgatcctctccagaatccttcatctcaaggacaatatctaaggaattcactggtaaaacattktatgcttggtcacaagcagctagagaaagcaaactacttccggcctggtgcggtggctcatgtctgtaatctcagcactttgggaggccgaggtggtgga

SEQ ID NO: 71662 - DNA, 201 bp, Homo sapiens
aaggaagcaaggaaggaaggaaggaaggaagcaaggaaggaagcaatgaaggaaggaagggagagagagagaaagaaagaagagagagagaagaaagaaaraaagaaagaaagaaagaaagaaagaaagaaagaaagaaagaaagaaagagaaagaaaagaaagaaagaaagaaaactacatctgaagtcaacactagtat

SEQ ID NO: 71663 - DNA, 201 bp, Homo sapiens
gatgtgtccacagggccatgtcgtgaaggccatgtggacgctgttggtggtgtttcttcgttcccttgtggactatggggaaacacaaaaggattttaagytggggagaaacataatcatatttgtatttacgaaggtccctctggctgcaacatggagtatattgtaggagggtaccattgcctgcagtgaggcgttaag

SEQ ID NO: 71664 - DNA, 201 bp, Homo sapiens
ctgcactccagcctgggtgacagagcgatactctgtcttggaaggaaggaagcaaggaaagaaggaaggaaggaagcaaggaaggaaggaaggaagcaagsaaggaaggaaggaaggaagcaaggaaggaagcaatgaaggaaggaagggagagagagagaaagaaagaagagagagagaagaaagaaagaaagaaagaaa

SEQ ID NO: 71665 - DNA, 201 bp, Homo sapiens
ggtgactatagaagctgtcactcctgtaaattattaaatttgttgagtgaggattaacacagcaagtgctatatttgcctctacattttagaacaacagamtataaatatgagtctgttgttccataaattacatgggaaacatatacaatcctagaccagcagtgtccatcggaactttctgggatgatgaaaatgttgt

SEQ ID NO: 71666 - DNA, 201 bp, Homo sapiens
tcctgacctccggtgatctgcccaccttggcttcccaaagtgctgggattataggcatgagccaccacacccagcctatggtattttattatacccacctragcaaactaacatgactgaatgtcccaaggctgatattcagagctctttgaaggtgtggctgccacaggaacatgcagtctgcagtggctatgaaacttg

SEQ ID NO: 71667 - DNA, 201 bp, Homo sapiens
tttttcagtggtttggaaattatttaaatctctcagtgtaagaaaataatctgaaggcaaactgatgaatcacatattgatgacttcttgcacgcctaggygatctttccatctgttaaacgtgtttttaaataactgtctgctattttaagttactatttgacaaagtgtggcaaatcaaacaaaaagaacatgtaatta

SEQ ID NO: 71668 - DNA, 201 bp, Homo sapiens
gtgcctacactgaataatcctaagaagatcagaatccagaaagtgcatttctacttctatcttcttacagtgtctctccagctccctctattggcaaagcygaacactgggccagtcagtcaagttcttgttacaggatccaggtttactatcacaaagtccacaaaggtagatttagagctgatagacaataaattgata

SEQ ID NO: 71669 - DNA, 201 bp, Homo sapiens
gagtatattgtaggagggtaccattgcctgcagtgaggcgttaaggacgcagcatggatgagagatgaggaaagctgaaatgaaacagaggcaggagaaawggagaggaggacatggccttgaggaatttccaggacataaatttggcatcacttcttggaccatgagaggaagagggagcaggaagaatcaaagatgaat

SEQ ID NO: 71670 - DNA, 201 bp, Homo sapiens
ccgccttgattgagggcaaggcttccggcagatgactcagaaccgttcgattgctctggcttgtgcaatccctgattctttgggcctgtgtggatgtctgygggcaccggagagagggccagtgcctggtccttggagggtggtttttataaaaagtgtacacattggctattgtccttttttcaccgttgattcacgttt

SEQ ID NO: 71671 - DNA, 201 bp, Homo sapiens
tatgggctgattattccccacctttcagacttctttccaagtccaagtgttgggcagaggaggaagaggaatgagagtagcaaacccggcaacctctgatrctccctctttcctctctcagcccacatataatgtggatgtctccttgtaatcttcagtctcattctctccctgaagctaagtagctggctttggtacaaa

SEQ ID NO: 71672 - DNA, 201 bp, Homo sapiens
aactaaatgaaagtgaaaacacactgacaacactaaatgctggtgaaaacgtggagcaacaggaactctcattcattgctggtgggaatacaatattgtayagtcactttggaagacagtgtggaagttttttataaaactaaaaatatgatccagcaatcatgacccttaccatttacccaaaggagctgataaaacctg

SEQ ID NO: 71673 - DNA, 201 bp, Homo sapiens
aaatgcgtagtttcaagccagtcaggtgctctataacaggataattttgaaagtgctatggaaatcctcagaaaaaaacaagtaaataaataaataataakaagaaaacctctacagaatcctggaaagactttccagagaagctggctttaaaagctgggcaggccaaggtaatttatagattcaatgccatccccatca

SEQ ID NO: 71674 - DNA, 201 bp, Homo sapiens
agttcaaaaccaggctaaactaaatcattctggatgcatgtgtagacagtaaaactatgtcgttattatcatgaaactcaggaaggtggtgatacagaggrgagggaagcggatgtgatgagggaggagggtgtgatcagtagggaaacacggcctccagcgatgacaatattccagttattaaactgggtgatgggttgt

SEQ ID NO: 71675 - DNA, 201 bp, Homo sapiens
caggactggaaacctccctcaagtcctctgccccctccatctccttcaacacagaagcttcagctcaggaaaggaaaggccacctttcacatgcagaagcrcatcagcttctggaggggtacttcatgaaggtactgcctccatcttctcagtctccaaaccatcccttgctttggacctctccttttcaactgtggccct

SEQ ID NO: 71676 - DNA, 201 bp, Homo sapiens
atgaaactcaggaaggtggtgatacagaggggagggaagcggatgtgatgagggaggagggtgtgatcagtagggaaacacggcctccagcgatgacaatmttccagttattaaactgggtgatgggttgtactgctgttctttataattcaatacacattttaaatgttcttttgtatttattcaataggtaatgaaact

SEQ ID NO: 71677 - DNA, 201 bp, Homo sapiens
tagaacaaggaagcagtaatagctacacctcacaagataactgtgaagtcctgatgaaatatcaccttttcatgtaacgtttttgaattctcagtaccacrtaactgatcgatgtacactatttcacttaatcctcccataattcatgcttttccaaaattgctgcctctgcctatttttcagtggtttggaaattattta

SEQ ID NO: 71678 - DNA, 201 bp, Homo sapiens
aaagcagaacatttggtggaaattaaatgagctgaaacaactaatttatgaaccatgcattatagaattgtttcccaatctttctctcaaactgctcacarctaaatatttaatttccctttccataattttgcttttactttggaattttatacttctgtatcagtatggcatggagaggaaatgtgactgtagttagga

SEQ ID NO: 71679 - DNA, 201 bp, Homo sapiens
gaagcctggggatgccagtgccatacctcttgtatattctgcagaatatgagccaaataagccttctttctttataaactacccagcctcaggtattcctrtatagcaacacaaaacagactaagacaatgcttatatgaaaatgtctagattgttaccaagacaaatgtaagcaatgaaacatacatgttgtagagcctc

SEQ ID NO: 71680 - DNA, 201 bp, Homo sapiens
cttggtcctgttctcctggtagtcagtgaggtacaattagctctcatggaatggattaattcctccaagagtgggttgttataaagtaaggtttctccccrtgtttggtccctcttcgcatgtgcctgcatcccctttgacctttccctcattgaacctgcaggttcaatgaaggttcactgcaacctccgcctcctgagg

SEQ ID NO: 71681 - DNA, 201 bp, Homo sapiens
ataatggctgtggtttgggtgtggatttttgtctccacgaaaacccacactgcgattcagtccctgctgtgccagtgttccacttagggagaggtgtctgygtcatgtgggtggatcccttgtgaaagccttggtcctgttctcctggtagtcagtgaggtacaattagctctcatggaatggattaattcctccaagagt

SEQ ID NO: 71682 - DNA, 201 bp, Homo sapiens
gatatagaccaatggagcagaacagaggcctcagaaataataccacacatctacaaccatctgatctttgacaaaccggacaaaaacaagaaatggagaayggattccctatttaataaatggtgctgggaaaactggcatatgtagaaagctgaaactggatcccttccttacaccttatacaaaaattaattcaagatg

SEQ ID NO: 71683 - DNA, 201 bp, Homo sapiens
atcctaaattcaaaagattactgagttataaagtggatgtctggacaatccaaaacataatggctgtggtttgggtgtggatttttgtctccacgaaaacmcacactgcgattcagtccctgctgtgccagtgttccacttagggagaggtgtctgcgtcatgtgggtggatcccttgtgaaagccttggtcctgttctcc

SEQ ID NO: 71684 - DNA, 201 bp, Homo sapiens
ttggtacaaagggaaaagttggccagttatggaaagaaaatatgggttgtgtcagtgaagttctgagggctcagggtctttctggctgcaagggggttgakggaatgtctttttagctgtgccctagaaaacaatataactctccctgttcaatctaaatcatcagtgtgttcccttatcactgatcacagcagttgcatt

SEQ ID NO: 71685 - DNA, 201 bp, Homo sapiens
agcacaatcctaaattcaaaagattactgagttataaagtggatgtctggacaatccaaaacataatggctgtggtttgggtgtggatttttgtctccacsaaaacccacactgcgattcagtccctgctgtgccagtgttccacttagggagaggtgtctgcgtcatgtgggtggatcccttgtgaaagccttggtcctg

SEQ ID NO: 71686 - DNA, 201 bp, Homo sapiens
gtcatttttcattaacattccccagacaaatttgtactgcttactaacagcacaatcctaaattcaaaagattactgagttataaagtggatgtctggacmatccaaaacataatggctgtggtttgggtgtggatttttgtctccacgaaaacccacactgcgattcagtccctgctgtgccagtgttccacttagggag

SEQ ID NO: 71687 - DNA, 201 bp, Homo sapiens
ttggtgggagaggaattttatgctgcattccccaacagccactagatacgccaatcaggtgtgcatggtccatgctatgatctgtgagtatcagatcaacrtcagcttgttcagcaagccctcaggactggaaacctccctcaagtcctctgccccctccatctccttcaacacagaagcttcagctcaggaaaggaaagg

SEQ ID NO: 71688 - DNA, 201 bp, Homo sapiens
ctatccacaaggcagtgcaaagaggtgtgtgtttccctgaagaagagggtgccaccctgttgctcctggctgtaacactcagaggctctctctgcagtggwagaatcatatgggctgattattccccacctttcagacttctttccaagtccaagtgttgggcagaggaggaagaggaatgagagtagcaaacccggcaac

SEQ ID NO: 71689 - DNA, 201 bp, Homo sapiens
tccactccttttcctctttgaccagcaaaacagattaaaagatgaaaaatgcttgttttcctccgtgaaacttccagcaaatgcctggtggtttgaagtcstttacaaaggatataatttggcccctgggagtttggttgtaaacacagatatcccatgtaggaaacacagtgcgtgcaggtgcaaagaggcacaagatag

SEQ ID NO: 71690 - DNA, 201 bp, Homo sapiens
ttgcaaacaaactacatcagagatttgaagagaagagaattaatacaaagaattattaagtaatagattttttaaaaatactgtaatggcagcagatgtasaaggtacaaaagagaaattgtcacttcatgtcttggggtaagtggaaaaaaaaagaactaaggacttaggaaaagacataggtcatagactgtattatgt

SEQ ID NO: 71691 - DNA, 201 bp, Homo sapiens
acccttatgccacatttaggagtttgaacttgagattatggtctggaaagccatgcatggtttttaaacaaacgtctcatatgagtgcattggggctttasaaagataacccggctcagtatttggtatgaaaagaggctggggagctggcgcgtaggccaccaccatgggccagggactgctgaaagcagagggattgtc

SEQ ID NO: 71692 - DNA, 201 bp, Homo sapiens
ggagtttgaacttgagattatggtctggaaagccatgcatggtttttaaacaaacgtctcatatgagtgcattggggctttagaaagataacccggctcartatttggtatgaaaagaggctggggagctggcgcgtaggccaccaccatgggccagggactgctgaaagcagagggattgtctgcaatagagaagtgggg

SEQ ID NO: 71693 - DNA, 201 bp, Homo sapiens
agagacagaggagggcgaggggagagcgcgcgcgcgaaacggagactgagacccagccatcagggtgtgctgggagaactggggagacgagtctgcccctscgagtggacccagggaagagggcgcggtctacgcagagcccgaggcagggaagcgggaggggcccggagagcagccctgggtgaggccctttggaatgga

SEQ ID NO: 71694 - DNA, 201 bp, Homo sapiens
tggtacagatagtgtggatgaggcactgcaagacaacgtctgatgtgtccacagggccatgtcgtgaaggccatgtggacgctgttggtggtgtttcttcrttcccttgtggactatggggaaacacaaaaggattttaagctggggagaaacataatcatatttgtatttacgaaggtccctctggctgcaacatggagt

SEQ ID NO: 71695 - DNA, 201 bp, Homo sapiens
tgtaaaaccctaggaaaaaccaaaaacataatttcacagctacagaaacaactaatatcactggcttacttcttcattgtgccacatcagaaaatcaatarttttatgatttaccatatataatttgcaaataaagatgaggaattaacctaaagtccaaattcttttcagctattcctaatcttagcttataaactaagc

SEQ ID NO: 71696 - DNA, 201 bp, Homo sapiens
cagagcgatactctgtcttggaaggaaggaagcaaggaaagaaggaaggaaggaagcaaggaaggaaggaaggaagcaaggaaggaaggaaggaaggaagsaaggaaggaagcaatgaaggaaggaagggagagagagagaaagaaagaagagagagagaagaaagaaagaaagaaagaaagaaagaaagaaagaaagaaa

SEQ ID NO: 71697 - DNA, 201 bp, Homo sapiens
gggagagagagagaaagaaagaagagagagagaagaaagaaagaaagaaagaaagaaagaaagaaagaaagaaagaaagaaagaaagaaagagaaagaaaagaaagaaagaaagaaaactacatctgaagtcaacactagtattggtgggagaggaattttatgctgcattccccaacagccactagatacgccaatcagg

SEQ ID NO: 71698 - DNA, 201 bp, Homo sapiens
aggaagaatcaaagatgaatccaagaatgaacaaatctaatttttgaaataatgcaatgaaaagtagaactggtctgttttcctaggtaaggaatttgtcygcaagtcgatattcacgaggattaattgtatttattttctgagtatggacaatttaaatgctgggccctgaagggaaacccatctctcagaataactaaa

SEQ ID NO: 71699 - DNA, 201 bp, Homo sapiens
ttaccagacattggatccacattctacctcgttgctagctacaagaacttgttcaagctacttaacttctgagtctcagattcctcatgggtttattatcmctaaggattaaataatctatgcaaaatgtccaatgcaaagaaggtattcagtaaacatatctgaggaggtcagatcaactttttttcctagaattcaatt

SEQ ID NO: 71700 - DNA, 103 bp, Homo sapiens
tgytcagaaaaaaacaagtaaataaataaataataataagaaaacctctacagaatcctggaaagactttccagagaagctggctttaaaagctgggcaggcc

SEQ ID NO: 71701 - DNA, 201 bp, Homo sapiens
ggaaggaagggagagagagagaaagaaagaagagagagagaagaaagaaagaaagaaagaaagaaagaaagaaagaaagaaagaaagaaagaaagaaagagaaagaaaagaaagaaagaaagaaaactacatctgaagtcaacactagtattggtgggagaggaattttatgctgcattccccaacagccactagatacgc

SEQ ID NO: 71702 - DNA, 201 bp, Homo sapiens
caatgaaggaaggaagggagagagagagaaagaaagaagagagagagaagaaagaaagaaagaaagaaagaaagaaagaaagaaagaaagaaagaaagaaagaaagagaaagaaaagaaagaaagaaagaaaactacatctgaagtcaacactagtattggtgggagaggaattttatgctgcattccccaacagccacta

SEQ ID NO: 71703 - DNA, 201 bp, Homo sapiens
ggaatggagtgttcactctctaggagaagttgggctaaatgatgaaatggagtgtccgtgtatgtgatctgtggtgctgttttgctgtagttaattcctakttttaacttgaaatgtgttctgactgcgttagtgccaatttttttgagaccggtgtacctatcctatcaggtacattcgatttacacaagtacattctct

SEQ ID NO: 71704 - DNA, 201 bp, Homo sapiens
agccccgcgactctctttcccggccgcctcccgccgtcattctcctagttcctgcccgcctttgcctcgctctgattcctgctctggccttcctcccttcscctctctcacgcactccagggaagaggtggcctccgcgggaacctgggcacctccgtgcctgccccgcccggtacctggcagaggcccccacctcctgct

SEQ ID NO: 71705 - DNA, 201 bp, Homo sapiens
gcaatgaaggaaggaagggagagagagagaaagaaagaagagagagagaagaaagaaagaaagaaagaaagaaagaaagaaagaaagaaagaaagaaagaaagaaagagaaagaaaagaaagaaagaaagaaaactacatctgaagtcaacactagtattggtgggagaggaattttatgctgcattccccaacagccact

SEQ ID NO: 71706 - DNA, 201 bp, Homo sapiens
cttcccaggatttccagagcacccttcccttctttcctgactcctttgcttggtatcctgattcctttcctaccattctaagccctcttcttttcattatratatgatcttcttgtatgacctccactatatccataggttcatgtttcaacttttaacttatttcttcaaaatctctaacctgtctcgagccgtagatgt

SEQ ID NO: 71707 - DNA, 201 bp, Homo sapiens
gaggctggggcaggagacatgcttgaacccaggaggtggaggttgcaatgagctgagattgcaccactgcactccagcctgggtgacagagcgatactctstcttggaaggaaggaagcaaggaaagaaggaaggaaggaagcaaggaaggaaggaaggaagcaaggaaggaaggaaggaaggaagcaaggaaggaagcaa

SEQ ID NO: 71708 - DNA, 201 bp, Homo sapiens
gtgtggatgtctgtgggcaccggagagagggccagtgcctggtccttggagggtggtttttataaaaagtgtacacattggctattgtccttttttcaccrttgattcacgtttgactccactgtagttagacgtccacccaaacattctctgaaattgctcctgataaggatactaatcattttctaattgccttggcca

SEQ ID NO: 71709 - DNA, 201 bp, Homo sapiens
ggcagcaaatcacagcgcagcaaatcgcaagcctagaaacagacgctccctctccaggggcagcttcctattcagggcgggtctgggcgcacctgttctcsggacccggccctcggccttcgccgggtctcgcggtggggcttgggaccccggctggtgccagggcgacccccacagccccgcgactctctttcccggccg

SEQ ID NO: 71710 - DNA, 201 bp, Homo sapiens
gctgaaatgaaacagaggcaggagaaatggagaggaggacatggccttgaggaatttccaggacataaatttggcatcacttcttggaccatgagaggaasagggagcaggaagaatcaaagatgaatccaagaatgaacaaatctaatttttgaaataatgcaatgaaaagtagaactggtctgttttcctaggtaagga

SEQ ID NO: 71711 - DNA, 201 bp, Homo sapiens
gtctgcgtcatgtgggtggatcccttgtgaaagccttggtcctgttctcctggtagtcagtgaggtacaattagctctcatggaatggattaattcctccragagtgggttgttataaagtaaggtttctccccatgtttggtccctcttcgcatgtgcctgcatcccctttgacctttccctcattgaacctgcaggttc

SEQ ID NO: 71712 - DNA, 201 bp, Homo sapiens
aactgtgaagtcctgatgaaatatcaccttttcatgtaacgtttttgaattctcagtaccacgtaactgatcgatgtacactatttcacttaatcctcccrtaattcatgcttttccaaaattgctgcctctgcctatttttcagtggtttggaaattatttaaatctctcagtgtaagaaaataatctgaaggcaaactg

SEQ ID NO: 71713 - DNA, 201 bp, Homo sapiens
aaatacctaatgtaaatgactagttgatgggtgcggcaaaccaacatggctcatgtatacctatgtatcaaacttgcatattgtgcacttttaccctagarcttaaagtataataataaaaaagaaacaacccaaatgtccatcaaaaacagaatggataaatggattgtagtatattagtataatggaatacagaacaat

SEQ ID NO: 71714 - DNA, 201 bp, Homo sapiens
tccagcctgggtgacagagcgatactctgtcttggaaggaaggaagcaaggaaagaaggaaggaaggaagcaaggaaggaaggaaggaagcaaggaaggarggaaggaaggaagcaaggaaggaagcaatgaaggaaggaagggagagagagagaaagaaagaagagagagagaagaaagaaagaaagaaagaaagaaaga

SEQ ID NO: 71715 - DNA, 201 bp, Homo sapiens
actgaatgtcccaaggctgatattcagagctctttgaaggtgtggctgccacaggaacatgcagtctgcagtggctatgaaacttgtcagatggccaaagstggcttacgagaagccatatgtccttgctggagggtgtgggcaggctggggctggaccatagaagcaaatgcctggtagggatatagttgccagaggttg

SEQ ID NO: 71716 - DNA, 201 bp, Homo sapiens
accactgcactccagcctgggtgacagagcgatactctgtcttggaaggaaggaagcaaggaaagaaggaaggaaggaagcaaggaaggaaggaaggaagsaaggaaggaaggaaggaaggaagcaaggaaggaagcaatgaaggaaggaagggagagagagagaaagaaagaagagagagagaagaaagaaagaaagaaa

SEQ ID NO: 71717 - DNA, 201 bp, Homo sapiens
acaaaggtagatttagagctgatagacaataaattgatatctggcacagcaatgaatggagttctcaggcaagcctgtcattaaatctggatgataactastgaatctgtctcttttcctgatcctctccagaatccttcatctcaaggacaatatctaaggaattcactggtaaaacattttatgcttggtcacaagcag

SEQ ID NO: 71718 - DNA, 201 bp, Homo sapiens
ctgggtgacagagcgatactctgtcttggaaggaaggaagcaaggaaagaaggaaggaaggaagcaaggaaggaaggaaggaagcaaggaaggaaggaagsaaggaagcaaggaaggaagcaatgaaggaaggaagggagagagagagaaagaaagaagagagagagaagaaagaaagaaagaaagaaagaaagaaagaaa

SEQ ID NO: 71719 - DNA, 201 bp, Homo sapiens; identical to SEQ ID NO: 62132

SEQ ID NO: 71720 - DNA, 201 bp, Homo sapiens
gacgttaaaggtgaggagaagatgcaagacaagaacctggattccccagcttctctgcccgggaggacctgggggaaacaaccctcacctcccagagcagragcctccggttccagagctccagggcagacccgcagcgcccaggcccacctgctccctgccttcaatcaccagacgggcttcactcctggttcttcagga

SEQ ID NO: 71721 - DNA, 201 bp, Homo sapiens; identical to SEQ ID NO: 62134

SEQ ID NO: 71722 - DNA, 201 bp, Homo sapiens
aaaacattaacctacacacgcaagaagctcagtgaacacgcaaaataaatgcagatacctacaccaagacacatcggtcaaaatatttaaggcaaaagccaaaaaaaaaaaaaaatcctgaaagcaataattccactcacatgcagtgtctagaataaagacaaaaggtagattcgtgcttgcttagggctgagggggatg

SEQ ID NO: 71723 - DNA, 201 bp, Homo sapiens
ccaggctggagcgcaatggcgcgaaatcggctcattgcagcctcgacgtccaggactcgagcgatcctcccgcctcagcctctcgagaaggtgggaccacsggtgggcaccgccacgcccggctaatttttattaatgttttgctagagccgggatcttgctgtgttgtctggctggtcttaaactcctgggctccagcga

SEQ ID NO: 71724 - DNA, 201 bp, Homo sapiens
gcctggtgcactcgggcgcgcaaccccctcactttccccatcttcccggcggagcacggcaaacgtgcggagcgcctcccggaagctggtcctgcgttctygccgcccggcggaaacaggagccgcggctgccgggagccccgcggccgccggaagtacccggaagcggctcgggcgggcgcagggtcgcgggtgtagggt

SEQ ID NO: 71725 - DNA, 201 bp, Homo sapiens
gaggcaggagaatcgcttgaaccggggaggcagaggttgcaatgacccaagatcacaccgttgcactctggcctaggcaacaagagcaaaactccgtctcaaaaaaaaaaaatttatattctttaaagatcagcctcctcttccactgccagcccagtgtttgagactgctatggtttgaatgttggtcccctctgaaacc

SEQ ID NO: 71726 - DNA, 201 bp, Homo sapiens; identical to SEQ ID NO: 61911

SEQ ID NO: 71727 - DNA, 201 bp, Homo sapiens
cgcagggtcgcgggtgtagggtggcggcgctccgcctttcaccgacgcacctgggagaaacagaccggaggacgcgggtggcgcggagcacgagaaacaaygagtttctgtctagatcgtgggggacccaagcccggggttgcgtccaaggtcggggatggagaggacgcgacccccgcggcagtcgagatggccttttta

SEQ ID NO: 71728 - DNA, 201 bp, Homo sapiens
ggaacaatcccagacctgctgggtatcagcatggtaacccgtcgagcctgcctcacctctcctgatggaagggacgctccgtgcactcgagcctgcctcayctctcctgacggaagtgacactcctcacgtccagctccagcttctgcaccaaggcgctggggtctatcttggtcctggcaaagatgttggtgttgatgaa

SEQ ID NO: 71729 - DNA, 201 bp, Homo sapiens; identical to SEQ ID NO: 61994

SEQ ID NO: 71730 - DNA, 201 bp, Homo sapiens
tgccaggacgcagagcagttcttgcagagctgcggagacatgatgcagcccaggggcaaaaccacagctgtaatctactctggggaatcgccccaagaaayagccaggggcatcccttgctcaaggacattgtcaggtacaggttagctggaaagctgctgagacctcgggtgcctgagggaacaatcccagacctgctgg

SEQ ID NO: 71731 - DNA, 201 bp, Homo sapiens; identical to SEQ ID NO: 61996

SEQ ID NO: 71732 - DNA, 201 bp, Homo sapiens
atttttcataaaaggactagtttgccccccttttggcacactcttgccctctctttgctgttccaccatgggatgacacagcaagaaggcccttgccagtkgctagctcttctgtcttggacttcccagtctccagaaccatgagccagtaaatttcagttcattatataaattacctagtctgtggtattctgttatagc

SEQ ID NO: 71733 - DNA, 201 bp, Homo sapiens; identical to SEQ ID NO: 61998

SEQ ID NO: 71734 - DNA, 201 bp, Homo sapiens
ggctgaacaaagaggcagttgtggaaaagtaaaccgtgtggggaggcttaagaacgacaggaattactttaattactttaatgtctgtacagaattctgtyggctatgacgtgcttccctgtagaggaatctttcttcgcccggtacagggaaggcatctttcacctgagcgtttttatctcctgtcttcaggaagaaaag

SEQ ID NO: 71735 - DNA, 201 bp, Homo sapiens
ccaagacacatcggtcaaaatatttaaggcaaaagccaaaaaaaaaaaaaaatcctgaaagcaataattccactcacatgcagtgtctagaataaagacaraaggtagattcgtgcttgcttagggctgagggggatggagaaacaggccagccgactgctaaagggaacggggtctctcttcagtttgctctccgttctt

SEQ ID NO: 71736 - DNA, 201 bp, Homo sapiens; identical to SEQ ID NO: 62000

SEQ ID NO: 71737 - DNA, 201 bp, Homo sapiens
ccggaggcggcgccccgcagctcacccgccctcggacccacgcggcagcccccggccagcgcctccccagctcaccttccccgcggccgaggccggcggargggtcgcctccggggcagggggcgcggggccgggggcggcctcccctttcggcctcacggcagcctggtgcactcgggcgcgcaaccccctcactttccc

SEQ ID NO: 71738 - DNA, 201 bp, Homo sapiens
aatcaggtaactaattaattaaaaaaaaattaagagacagggtctcactctgttgcccaagttggaacagtggtgcaatcatagctcattgtaatggtgamctcctgggctcaagtgatcctcccatcttagcctcctgaatagctgggaacacaggcatgtgccaccacacctggctaattttttgggtttttttttttg

SEQ ID NO: 71739 - DNA, 201 bp, Homo sapiens; identical to SEQ ID NO: 62148

SEQ ID NO: 71740 - DNA, 201 bp, Homo sapiens; identical to SEQ ID NO: 62100

SEQ ID NO: 71741 - DNA, 201 bp, Homo sapiens
aggtgggtttcctgcctgtctcccagcccccaagagctccacggactctgccagtagctgctttaaaggagggagggagttttctgatcctctggacatcyctggggctggagctatgggctgagccataggagagccagcccagctccctgggggttgggggctgtgtctctccatcccttagtaaaaatacagcaactc

SEQ ID NO: 71742 - DNA, 201 bp, Homo sapiens; identical to SEQ ID NO: 62006

SEQ ID NO: 71743 - DNA, 201 bp, Homo sapiens; identical to SEQ ID NO: 62008

SEQ ID NO: 71744 - DNA, 201 bp, Homo sapiens; identical to SEQ ID NO: 62009

SEQ ID NO: 71745 - DNA, 201 bp, Homo sapiens
tatggcctccttcacattacagaggagacaggatgcagatgaggtagaaggcagccagggcaccaagaggtgccaggctggactgcaactccccaggtgcyctcacccacagcacctgagggagaagtccttggtctccctcacccacagcacctgagggagaagtccttggtcttggagggttacgtggcagagacagaa

SEQ ID NO: 71746 - DNA, 201 bp, Homo sapiens
cctgaaagcaataattccactcacatgcagtgtctagaataaagacaaaaggtagattcgtgcttgcttagggctgagggggatggagaaacaggccagcygactgctaaagggaacggggtctctcttcagtttgctctccgttcttctctaactctgggaacgtcctttcctttccggggagctcagtgcgattcagga

SEQ ID NO: 71747 - DNA, 201 bp, Homo sapiens; identical to SEQ ID NO: 62103

SEQ ID NO: 71748 - DNA, 201 bp, Homo sapiens; identical to SEQ ID NO: 62106

SEQ ID NO: 71749 - DNA, 201 bp, Homo sapiens; identical to SEQ ID NO: 62020

SEQ ID NO: 71750 - DNA, 201 bp, Homo sapiens
gctcctgctctctcctctctgcccctggagtggtgtgtgctggctctaggtcagtaggaggcttcattcagaaatgcctttcagcatgctgcccagaccaygtctctgtttcaggagcactgccacgagaggggatgctgccgtggctgcgccagcttcagccctttccctgcaccgagatgtcccagtgagcggctgggt

SEQ ID NO: 71751 - DNA, 201 bp, Homo sapiens
acccccgcggcagtcgagatggcctttttaaaattctatatttgagaaggagtctcgcgctgtcgcccaggctggagcgcaatggcgcgaaatcggctcaytgcagcctcgacgtccaggactcgagcgatcctcccgcctcagcctctcgagaaggtgggaccaccggtgggcaccgccacgcccggctaatttttatta

SEQ ID NO: 71752 - DNA, 201 bp, Homo sapiens; identical to SEQ ID NO: 62153

SEQ ID NO: 71753 - DNA, 201 bp, Homo sapiens
tacccaggagtggccagaaggctcctctccaggcctcacagagggaaacactggtctagtgagagacctgcgtcctgcccatcaggaccgaagcggcacgygtgaggatcctgcaggccaagagacaacagcgattacaaaccccagtcccagccttgcagctgaccttgcaggtgacgccctgcctgggtgtctcggtgc

SEQ ID NO: 71754 - DNA, 201 bp, Homo sapiens
ataaaacttcaatgaatgggtacgcttttctcctgttaatctgttttatgtaattctaaatctcaggcccaacctaaaaaccttgaaggtagaggtaaaayatggcctccttcacattacagaggagacaggatgcagatgaggtagaaggcagccagggcaccaagaggtgccaggctggactgcaactccccaggtgct

SEQ ID NO: 71755 - DNA, 201 bp, Homo sapiens; identical to SEQ ID NO: 62030

SEQ ID NO: 71756 - DNA, 201 bp, Homo sapiens; identical to SEQ ID NO: 62032

SEQ ID NO: 71757 - DNA, 201 bp, Homo sapiens
gaaatcggctcattgcagcctcgacgtccaggactcgagcgatcctcccgcctcagcctctcgagaaggtgggaccaccggtgggcaccgccacgcccggytaatttttattaatgttttgctagagccgggatcttgctgtgttgtctggctggtcttaaactcctgggctccagcgatcctccctcctcggcctcccaa

SEQ ID NO: 71758 - DNA, 201 bp, Homo sapiens; identical to SEQ ID NO: 62033

SEQ ID NO: 71759 - DNA, 201 bp, Homo sapiens; identical to SEQ ID NO: 62158

SEQ ID NO: 71760 - DNA, 201 bp, Homo sapiens
ggaatgctgttggctgtgaaaactccagaggctggtatctttagagttccttcagggtgcattcagcatctgagcctagcgactcttgaggtgaaagtgcycacgttttttttttggtgagagagtctcactctgtcgcccaggctggagtgcagtggcgcagtctcaaagtgctcatctttatgtactttggatgccggt

SEQ ID NO: 71761 - DNA, 201 bp, Homo sapiens; identical to SEQ ID NO: 62034

SEQ ID NO: 71762 - DNA, 201 bp, Homo sapiens; identical to SEQ ID NO: 61928

SEQ ID NO: 71763 - DNA, 201 bp, Homo sapiens; identical to SEQ ID NO: 62160

SEQ ID NO: 71764 - DNA, 201 bp, Homo sapiens; identical to SEQ ID NO: 62035

SEQ ID NO: 71765 - DNA, 201 bp, Homo sapiens
agtgggtttgttatcaaagtatttttcataaaaggactagtttgccccccttttggcacactcttgccctctctttgctgttccaccatgggatgacacakcaagaaggcccttgccagttgctagctcttctgtcttggacttcccagtctccagaaccatgagccagtaaatttcagttcattatataaattacctagt

SEQ ID NO: 71766 - DNA, 201 bp, Homo sapiens
ctgcctgggtgtctcggtgcagctgcacatcaggggcctctgctggacagaagctctgagtccacacttggcccccaggcgctggagctggtaggtgacaygttgcactcttatttgggattctgctacctctttctgttcaacaagtgaagcctcagaatgcagagagggggctaggagaggcccctgcagacatgctgg

SEQ ID NO: 71767 - DNA, 201 bp, Homo sapiens
tgtgttaatcaggtaactaattaattaaaaaaaaattaagagacagggtctcactctgttgcccaagttggaacagtggtgcaatcatagctcattgtaayggtgacctcctgggctcaagtgatcctcccatcttagcctcctgaatagctgggaacacaggcatgtgccaccacacctggctaattttttgggtttttt

SEQ ID NO: 71768 - DNA, 201 bp, Homo sapiens
cccaggagtggccagaaggctcctctccaggcctcacagagggaaacactggtctagtgagagacctgcgtcctgcccatcaggaccgaagcggcacgcgygaggatcctgcaggccaagagacaacagcgattacaaaccccagtcccagccttgcagctgaccttgcaggtgacgccctgcctgggtgtctcggtgcag

SEQ ID NO: 71769 - DNA, 201 bp, Homo sapiens; identical to SEQ ID NO: 62162

SEQ ID NO: 71770 - DNA, 201 bp, Homo sapiens
cttgcagtgagccgagatcgcaccactgcactccagcctgggcgatggagcgagactctgtctcaaaaaaaaaaaaataagtaaaaataaaaaactcaggyctgcttctcccttcgtgttgtacccaggagtggccagaaggctcctctccaggcctcacagagggaaacactggtctagtgagagacctgcgtcctgccc

SEQ ID NO: 71771 - DNA, 201 bp, Homo sapiens; identical to SEQ ID NO: 62163

SEQ ID NO: 71772 - DNA, 201 bp, Homo sapiens
ctttaattactttaatgtctgtacagaattctgttggctatgacgtgcttccctgtagaggaatctttcttcgcccggtacagggaaggcatctttcaccygagcgtttttatctcctgtcttcaggaagaaaaggagagatccgatgatgctcttgcctgtgccatttttcaagtgccttaggtagaagtgattcttatg

SEQ ID NO: 71773 - DNA, 201 bp, Homo sapiens; identical to SEQ ID NO: 62164

SEQ ID NO: 71774 - DNA, 201 bp, Homo sapiens
cacacctctatctaccctgctccccaacactgggcaccagcactcacctgcccaggacccacagtgaaaacccacccacaaaaaatgcactttggagaagrgtagcaggtcccaggcagagccagggccacctctcagaaaggacatcaagtttctcgcccagctgagagatggacagatgaccgcacaagccactcacag

SEQ ID NO: 71775 - DNA, 201 bp, Homo sapiens; identical to SEQ ID NO: 62165

SEQ ID NO: 71776 - DNA, 201 bp, Homo sapiens
aagtgacattcttatcatcagggatggatcagaggagccaagagcactctgtacagacacacctggtgaacacaacccctcccctcctgcagcctccccaygtggtttagttttccacaaccacctccgttcaacctctcaccctctcaaagaagcacaaagttctcccacttccttgtcttcatttccttataaggctcc

SEQ ID NO: 71777 - DNA, 201 bp, Homo sapiens; identical to SEQ ID NO: 62166

SEQ ID NO: 71778 - DNA, 201 bp, Homo sapiens; identical to SEQ ID NO: 62167

SEQ ID NO: 71779 - DNA, 201 bp, Homo sapiens
caaaggagaggccacagggctgctgggcacgacctcagcccaagaacgctgcgaggccagatgttgctaaagaggagtttccctggtaggcaagacgggtsgtgagcgtgacgtctccctaaattaggaggggaagaggggacgtgacagtcagtgcagcaggtgaccttggggaccagatgagccacaggggcttgaagg

SEQ ID NO: 71780 - DNA, 201 bp, Homo sapiens; identical to SEQ ID NO: 61930

SEQ ID NO: 71781 - DNA, 201 bp, Homo sapiens; identical to SEQ ID NO: 62169

SEQ ID NO: 71782 - DNA, 201 bp, Homo sapiens
aatctgacagccacctccaagccagaggtatccagtggtaaaaggcaaaaaccccctggccaaggaggctttaagaacaattgctgaccagtgaggagctyaagcagatccaactagccaggctaaaagagaaaaacaggaagaaaaaaaaaaaaccaagggggcacatcagaggctgcacacagccagaaggggacaagg

SEQ ID NO: 71783 - DNA, 201 bp, Homo sapiens; identical to SEQ ID NO: 62171

SEQ ID NO: 71784 - DNA, 201 bp, Homo sapiens
cgcctcagcctctcgagaaggtgggaccaccggtgggcaccgccacgcccggctaatttttattaatgttttgctagagccgggatcttgctgtgttgtcyggctggtcttaaactcctgggctccagcgatcctccctcctcggcctcccaaagcgctgggattacaggcatgagccacactgcgcctggccaagctagt

SEQ ID NO: 71785 - DNA, 201 bp, Homo sapiens
acacacggagaaaacagttcaaaccctgttggtcaccaaagcccaagttcctgtggcttcagcgtggctgccaggacgcagagcagttcttgcagagctgyggagacatgatgcagcccaggggcaaaaccacagctgtaatctactctggggaatcgccccaagaaacagccaggggcatcccttgctcaaggacattgt

SEQ ID NO: 71786 - DNA, 201 bp, Homo sapiens
attaagcacgacgtacatatttataatggaagtatccgaaagagaggagtgacagaaaggggcagaaaaaaatattcaaggaaataatggctgaagacttrccaatgtaacgaaaaacattaacctacacacgcaagaagctcagtgaacacgcaaaataaatgcagatacctacaccaagacacatcggtcaaaatattt

SEQ ID NO: 71787 - DNA, 201 bp, Homo sapiens
gaaaaactgagtgaacagcgcctcagagcactgtgggacaccattaagcacgacgtacatatttataatggaagtatccgaaagagaggagtgacagaaargggcagaaaaaaatattcaaggaaataatggctgaagacttgccaatgtaacgaaaaacattaacctacacacgcaagaagctcagtgaacacgcaaaat

SEQ ID NO: 71788 - DNA, 201 bp, Homo sapiens; identical to SEQ ID NO: 62050

SEQ ID NO: 71789 - DNA, 201 bp, Homo sapiens; identical to SEQ ID NO: 61941

SEQ ID NO: 71790 - DNA, 201 bp, Homo sapiens; identical to SEQ ID NO: 62052

SEQ ID NO: 71791 - DNA, 201 bp, Homo sapiens; identical to SEQ ID NO: 62114

SEQ ID NO: 71792 - DNA, 201 bp, Homo sapiens
acattcaaagaaggcccacctgctcctacctgccagcatgagccaggcaacagaaactgctttgagcagcccacatgtaaagaattcagagtaggcattayaaatatttctaaggactaaaagagaccgtgtctaaagaactaaacgaaggtataatgacattctcacatcaaacagaaaacatcagtaaagagtattttt

SEQ ID NO: 71793 - DNA, 201 bp, Homo sapiens
gacgtgtgtgctgcagggctgcaaggagcacaaccaggagacgggaagggctgcgcatggatctgatgaaactgagaggaccctgcttcggcttcaggatmtaaaccctcaagagttatttgtacaaaatgataagcagctaacctctgcaacacataaagcacttgtttaagaaaaggatcaaaactgccccaaacatac

SEQ ID NO: 71794 - DNA, 201 bp, Homo sapiens; identical to SEQ ID NO: 62179

SEQ ID NO: 71795 - DNA, 201 bp, Homo sapiens; identical to SEQ ID NO: 62070

SEQ ID NO: 71796 - DNA, 201 bp, Homo sapiens; identical to SEQ ID NO: 62186

SEQ ID NO: 71797 - DNA, 201 bp, Homo sapiens; identical to SEQ ID NO: 61958

SEQ ID NO: 71798 - DNA, 201 bp, Homo sapiens; identical to SEQ ID NO: 61959

SEQ ID NO: 71799 - DNA, 201 bp, Homo sapiens; identical to SEQ ID NO: 62119

SEQ ID NO: 71800 - DNA, 201 bp, Homo sapiens
caggtgctctcacccacagcacctgagggagaagtccttggtctccctcacccacagcacctgagggagaagtccttggtcttggagggttacgtggcagrgacagaaaagtcggtacatgggaaaatatcagactcacgggggaacagtgctggagaccagggcagccttcagatgggcaggcaggtggctgaggcagca

SEQ ID NO: 71801 - DNA, 201 bp, Homo sapiens
tcagtaggaggcttcattcagaaatgcctttcagcatgctgcccagaccacgtctctgtttcaggagcactgccacgagaggggatgctgccgtggctgcrccagcttcagccctttccctgcaccgagatgtcccagtgagcggctgggtgctcacagttcccgttgggccatcagaggaagatcaaagatcaaccctcc

SEQ ID NO: 71802 - DNA, 201 bp, Homo sapiens; identical to SEQ ID NO: 62121

SEQ ID NO: 71803 - DNA, 201 bp, Homo sapiens; identical to SEQ ID NO: 62074

SEQ ID NO: 71804 - DNA, 201 bp, Homo sapiens
ccccatctctggtgtcctgacacggagctcttgcccaggagcggtaggctgcaaaaaggaagaactccatagctctgccagaagggactcgccttgtctgsagctcgtgtgagggctctcacgcctaagggtgttgctgaccaggaaggagctctgggtggtgacagatgcagagggcagggtgcccaaggctcctgggta

SEQ ID NO: 71805 - DNA, 201 bp, Homo sapiens
atgctgttggctgtgaaaactccagaggctggtatctttagagttccttcagggtgcattcagcatctgagcctagcgactcttgaggtgaaagtgctcaygttttttttttggtgagagagtctcactctgtcgcccaggctggagtgcagtggcgcagtctcaaagtgctcatctttatgtactttggatgccggtgaa

SEQ ID NO: 71806 - DNA, 201 bp, Homo sapiens
cacggagaaaacagttcaaaccctgttggtcaccaaagcccaagttcctgtggcttcagcgtggctgccaggacgcagagcagttcttgcagagctgcggrgacatgatgcagcccaggggcaaaaccacagctgtaatctactctggggaatcgccccaagaaacagccaggggcatcccttgctcaaggacattgtcag

SEQ ID NO: 71807 - DNA, 201 bp, Homo sapiens; identical to SEQ ID NO: 62124

SEQ ID NO: 71808 - DNA, 201 bp, Homo sapiens
tgcgattcaggaacctctggggtccgcgtggcaaccctggaccgcagcgggaggttcctggctctctcccctccccgggagcggcgcgagtccgtgtgccmaggacggcagcgcagagcggagcctcggagtttacgacgcttcgcgaagcaagaaggtcgcgtctgtagcgcagcaaatgcccgcagagcccgagggaag

SEQ ID NO: 71809 - DNA, 201 bp, Homo sapiens
atgtgcctgttgtcccgtccccgctactcaggaggctgaggcaggggaatcacttgaacccaggaggcggaggttgcagtgagccaagatcaagccactgyactccaccctggcgacagagcaagactctgtctccaaacaaacaaacaaacaaaaaacaaacaaacaaaaacaaagatccagcatggctcaaaggagagg

SEQ ID NO: 71810 - DNA, 201 bp, Homo sapiens
acactggagtgagtgggagttcccagaccctctcactggccaggctgacgtgtgtgctgcagggctgcaaggagcacaaccaggagacgggaagggctgcrcatggatctgatgaaactgagaggaccctgcttcggcttcaggatctaaaccctcaagagttatttgtacaaaatgataagcagctaacctctgcaacac

SEQ ID NO: 71811 - DNA, 201 bp, Homo sapiens
gactctgccagtagctgctttaaaggagggagggagttttctgatcctctggacatccctggggctggagctatgggctgagccataggagagccagcccwgctccctgggggttgggggctgtgtctctccatcccttagtaaaaatacagcaactcccaactcaaagtcaagggtcaatagtcacaaaaccttggtgca

SEQ ID NO: 71812 - DNA, 201 bp, Homo sapiens
tgagacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggaga

SEQ ID NO: 71813 - DNA, 201 bp, Homo sapiens
gagacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggagag

SEQ ID NO: 71814 - DNA, 201 bp, Homo sapiens
agacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggagagc

SEQ ID NO: 71815 - DNA, 201 bp, Homo sapiens; identical to SEQ ID NO: 58641

SEQ ID NO: 71816 - DNA, 201 bp, Homo sapiens
ctgaagcaggagaatcacttgagccgaggaggcagaagttgcactgagctgagattgtgccactgcactccaacctgagcaacagagcagactctgtctcaaaaaaaaaaaaaaaaaaaaaagccagtggtggtggtgcacacctgtagtcccagctactcaggagggtggggtaggaggatcgctggaggccaggttgca

SEQ ID NO: 71817 - DNA, 201 bp, Homo sapiens; identical to SEQ ID NO: 58642

SEQ ID NO: 71818 - DNA, 201 bp, Homo sapiens; identical to SEQ ID NO: 58644

SEQ ID NO: 71819 - DNA, 201 bp, Homo sapiens; identical to SEQ ID NO: 58645

SEQ ID NO: 71820 - DNA, 201 bp, Homo sapiens; identical to SEQ ID NO: 58646

SEQ ID NO: 71821 - DNA, 201 bp, Homo sapiens
tgggtgctgtcaccttggtctacggattgcccctctgaccccgttttggtctctctcttacccgccacgccctgcggcttagatatctctgcgactttacstactacacctctttgtaccagagtcacggtcgatcagccttcgtccacgtgcccccactggggaagccgtacaacgcggaccagctgggcagggcactga

SEQ ID NO: 71822 - DNA, 201 bp, Homo sapiens; identical to SEQ ID NO: 58648

SEQ ID NO: 71823 - DNA, 201 bp, Homo sapiens; identical to SEQ ID NO: 58649

SEQ ID NO: 71824 - DNA, 201 bp, Homo sapiens
tgggctttctctggaggggaaggtggatgctggcgggtgacttgcagtgggcgcctggcagtgggtgtggactgtaactgacaggtggaaatgagtagggrcactattgttccctccatgccagcttttttttttgctggaaatgccccctccacacccctggtagctctgtgtcctgagaaatccagagtgtgggagaca

SEQ ID NO: 71825 - DNA, 201 bp, Homo sapiens; identical to SEQ ID NO: 58699

SEQ ID NO: 71826 - DNA, 201 bp, Homo sapiens; identical to SEQ ID NO: 58700

SEQ ID NO: 71827 - DNA, 201 bp, Homo sapiens
taaatagtgctagtttgggcacagagtaatttatattccctttggttaaaatgcaggctttttagccaacaacaaaagtgttttccccccacccccactcrcccaccagggtgatgccacttttgcctcctgccctgaaaattggacttaagatgccatgtcttggccgggcgcagtggctcatgcctgtaatcccagcac

SEQ ID NO: 71828 - DNA, 201 bp, Homo sapiens
acaacaaaagtgttttccccccacccccactcgcccaccagggtgatgccacttttgcctcctgccctgaaaattggacttaagatgccatgtcttggccrggcgcagtggctcatgcctgtaatcccagcactttggaaggccagggtgggcggatcacctgagatcaggagttcaagatcagcctggccaacatggtga

SEQ ID NO: 71829 - DNA, 201 bp, Homo sapiens
ttaagaaaaaaaaaaggggggccaggcgcagtggcttatgcctgttatcccagcactttgggaggccaaggcagactgatcgcttgaggccaggagtttgsgaccagcctggccaacatagcaaaaccccatctctactaaaaatacaaaaattagtcaagagtggatggtgcgtgcctgtaatcccagctacctgggagg

SEQ ID NO: 71830 - DNA, 201 bp, Homo sapiens
taagatgccatgtcttggccgggcgcagtggctcatgcctgtaatcccagcactttggaaggccagggtgggcggatcacctgagatcaggagttcaagaycagcctggccaacatggtgaaaccctgcctctactaaaaatacaaaaattagccgggcatggtgatgagtgcctgtagtcccagctactcgggaggctga

SEQ ID NO: 71831 - DNA, 201 bp, Homo sapiens
tgcctcttgtggcgtctgaacctagacgtcccttttggagacagctggacaaagccctattctccgcagccccagcctctatcctgaggcctctgggagcygcgtgacggccagcatggggtgctgatcatggtcaaggaggcaggtctttgccaggttgccccatgcagccacccatcctcagcatcctaacttgagggg

SEQ ID NO: 71832 - DNA, 201 bp, Homo sapiens
ttggccgggcgcagtggctcatgcctgtaatcccagcactttggaaggccagggtgggcggatcacctgagatcaggagttcaagatcagcctggccaacrtggtgaaaccctgcctctactaaaaatacaaaaattagccgggcatggtgatgagtgcctgtagtcccagctactcgggaggctgaggctggagaatcgc

SEQ ID NO: 71833 - DNA, 201 bp, Homo sapiens; identical to SEQ ID NO: 58702

SEQ ID NO: 71834 - DNA, 201 bp, Homo sapiens
tgggcggatcacctgagatcaggagttcaagatcagcctggccaacatggtgaaaccctgcctctactaaaaatacaaaaattagccgggcatggtgatgrgtgcctgtagtcccagctactcgggaggctgaggctggagaatcgcttgaacttgggaggcagaggttgcagtgagctgagattgcacagctgcactcca

SEQ ID NO: 71835 - DNA, 201 bp, Homo sapiens
gagggcaaaatcaactattgccacaaacactgagggacgctcaggtctcctaagacctcatcctgctggggaccccacgaggggacatccaccctctgggrtgtggccaggaaaagacaagctcttcagcttggggatccgatctggaagagagattctgatctgcccacctcctcttcctccttctctacaaaagctccg

SEQ ID NO: 71836 - DNA, 201 bp, Homo sapiens; identical to SEQ ID NO: 58703

SEQ ID NO: 71837 - DNA, 201 bp, Homo sapiens
ggcggatcacctgagatcaggagttcaagatcagcctggccaacatggtgaaaccctgcctctactaaaaatacaaaaattagccgggcatggtgatgagygcctgtagtcccagctactcgggaggctgaggctggagaatcgcttgaacttgggaggcagaggttgcagtgagctgagattgcacagctgcactccagc

SEQ ID NO: 71838 - DNA, 201 bp, Homo sapiens
tgagctgtcgccatggagaccagggccacctgtggaaaggcggattttgtctgcttttgacttttcttttttaatatgtaaaactccacatcagcggaaamccccccctacttctggcctggagcttcagggttttggtgctgggacgagtttgttgttctccttagcggggtggcgcggggggctcaaaacgggggcgcg

SEQ ID NO: 71839 - DNA, 201 bp, Homo sapiens
caggagttcaagaccagcctgggcaacataaggagaccccatctgaacaagtaaaaaaaatagcaggctgagacaggaggattccttgagcttggagttcraggctgcagtgagctgtgatagcgccactgcacttcagtctgggcaacagagcaagaccctgttggctctaaataaataaatgcatgtgttcctttccta

SEQ ID NO: 71840 - DNA, 201 bp, Homo sapiens; identical to SEQ ID NO: 58707

SEQ ID NO: 71841 - DNA, 201 bp, Homo sapiens
aattttctttctttttttttaaagacaagagtttcgctcttgttgcccaggctggagtgcaatggcagaatctcagctcaccgcaacctctgcctcccagrttcaagtgattctcctgcctcagcctcccaagtagctgggactacaggtgcctgccaccatgcccagaaaatttttgtatttttagttgagatgaggttt

SEQ ID NO: 71842 - DNA, 201 bp, Homo sapiens; identical to SEQ ID NO: 58709

SEQ ID NO: 71843 - DNA, 201 bp, Homo sapiens; identical to SEQ ID NO: 58653

SEQ ID NO: 71844 - DNA, 201 bp, Homo sapiens; identical to SEQ ID NO: 58712

SEQ ID NO: 71845 - DNA, 201 bp, Homo sapiens; identical to SEQ ID NO: 58714

SEQ ID NO: 71846 - DNA, 201 bp, Homo sapiens; identical to SEQ ID NO: 58715

SEQ ID NO: 71847 - DNA, 201 bp, Homo sapiens; identical to SEQ ID NO: 58716

SEQ ID NO: 71848 - DNA, 201 bp, Homo sapiens
tttttagtagaggcggggttttgccatattggccacaccagggtggtctcgaactcccgacctcaagtgatccacccacctcagcctcccaaagtgctggrattataggcctgagccaccgcgcctggccctctttccagtcttaattccaacacgagtcacctccttgtgacttgtaggcctctccaactccccagacca

SEQ ID NO: 71849 - DNA, 201 bp, Homo sapiens
gtccaactcaaaggcagctattggtcaatgcagttgagtagctgaaggaaggaatgcctggatttaccatcaggatttttgtttttggagacaggatctcrctctgttgcataggctggagtcaagtagtataatcacagctcactgcagcctccatctcctgggattaagtgatcccccgcctcagcctcccgagtagct

SEQ ID NO: 71850 - DNA, 201 bp, Homo sapiens
tttttagtagagatagggttttatcatgttggccaggctggtctcgaactcctgacctcaggtgattcgcctgcctcggcctcccaaagtgctgggattamaggcatgagccaccgcgcctggcctaattttattttattttagtttttttgagactgcgtctagctttgtcacccaggctggagtgcagtggctcgatct

SEQ ID NO: 71851 - DNA, 201 bp, Homo sapiens
tgaagcaggagaatcacttgagccgaggaggcagaagttgcactgagctgagattgtgccactgcactccaacctgagcaacagagcagactctgtctcaaaaaaaaaaaaaaaaaaaaaagccagtggtggtggtgcacacctgtagtcccagctactcaggagggtggggtaggaggatcgctggaggccaggttgcac

SEQ ID NO: 71852 - DNA, 201 bp, Homo sapiens; identical to SEQ ID NO: 58662

SEQ ID NO: 71853 - DNA, 201 bp, Homo sapiens; identical to SEQ ID NO: 58664

SEQ ID NO: 71854 - DNA, 201 bp, Homo sapiens
tcctccctgcatctggggacacagctgccgtgaccagggaggccagcctgggaggtccagatgcccagggagaatcttggtctggtgaatccatgagctgmgataccacggctggggccatatgttcacctgctttcctgtccgttggtgaaggaatttcagaattcattttatatccaagactggcttttaccaaattta

SEQ ID NO: 71855 - DNA, 201 bp, Homo sapiens; identical to SEQ ID NO: 58665

SEQ ID NO: 71856 - DNA, 201 bp, Homo sapiens
aggccagggtgggcggatcacctgagatcaggagttcaagatcagcctggccaacatggtgaaaccctgcctctactaaaaatacaaaaattagccgggcrtggtgatgagtgcctgtagtcccagctactcgggaggctgaggctggagaatcgcttgaacttgggaggcagaggttgcagtgagctgagattgcacagc

SEQ ID NO: 71857 - DNA, 201 bp, Homo sapiens; identical to SEQ ID NO: 58723

SEQ ID NO: 71858 - DNA, 201 bp, Homo sapiens
aggtctagccaagacagggacaaaatggggaagggggtgtgccaggcctgaactgagctaagcacctgccccgggctccacacttccatctttcttttgtyttcatttcacctctgtgtttaaagcactgtgtgacatagctccttagagatataacctattgtctgctcattgtcacgtgtgtgtgtgtcatctttgtat

SEQ ID NO: 71859 - DNA, 201 bp, Homo sapiens
aatggaaataccaggttgtaaagtctgggtgattataattttactagcctgacaaattgccttccacacggggacaaccagcgtgccttcccaccagcaayagctcactctgcccatttccccacatgtgccacagcactgggagttatcaagttttttttgtttgtgtgtgtgtgtgtgtgtgtgtgtgtgtgtgtgttt

SEQ ID NO: 71860 - DNA, 201 bp, Homo sapiens
agaaaacaggtctagccaagacagggacaaaatggggaagggggtgtgccaggcctgaactgagctaagcacctgccccgggctccacacttccatctttyttttgtcttcatttcacctctgtgtttaaagcactgtgtgacatagctccttagagatataacctattgtctgctcattgtcacgtgtgtgtgtgtcatc

SEQ ID NO: 71861 - DNA, 201 bp, Homo sapiens
tgctcctcaaacacaccaagttcactccagcctcagggcctttgaacaccctatggcctctgcccagaacaccttcctctgggaacacctctttccagtctttttttttttttttttgagatggagtctcgctctgtagcacaggctggagtgcattggcgcgatcttggctcactgcaacctccgcctctgacgttcaag

SEQ ID NO: 71862 - DNA, 201 bp, Homo sapiens; identical to SEQ ID NO: 58671

SEQ ID NO: 71863 - DNA, 201 bp, Homo sapiens; identical to SEQ ID NO: 58672

SEQ ID NO: 71864 - DNA, 201 bp, Homo sapiens; identical to SEQ ID NO: 58673

SEQ ID NO: 71865 - DNA, 201 bp, Homo sapiens
gagatcaggagttcaagatcagcctggccaacatggtgaaaccctgcctctactaaaaatacaaaaattagccgggcatggtgatgagtgcctgtagtccyagctactcgggaggctgaggctggagaatcgcttgaacttgggaggcagaggttgcagtgagctgagattgcacagctgcactccagcctgggtgacaga

SEQ ID NO: 71866 - DNA, 201 bp, Homo sapiens
ctgttggctctaaataaataaatgcatgtgttcctttcctagaccttccctatggctcccattgcacatagaataaaattccaaccctggcccttggcccrcctctccaccccgctctgcctctactcaccccatatccattgcactccagacacatgaaccagcttcctcctgctcctcaaacacaccaagttcactcca

SEQ ID NO: 71867 - DNA, 201 bp, Homo sapiens
aacttcaggtttcatcttgctctattcctcaaaggtctggtctgtgggcctctgaggagaaaacaggtctagccaagacagggacaaaatggggaaggggrtgtgccaggcctgaactgagctaagcacctgccccgggctccacacttccatctttcttttgtcttcatttcacctctgtgtttaaagcactgtgtgaca

SEQ ID NO: 71868 - DNA, 201 bp, Homo sapiens
ctactaaaaacataaaaattagccggatgtgctggcaggcacctgtaattccagctactcgggaggctgaggcaggagaatcgcttgaacccgggaggcgraggttggagtgagccaagatctcaacactccactccaacctgggtgacagagtatgactccgtctcaaaaaaataaataaataaaaataaaaactggaaa

SEQ ID NO: 71869 - DNA, 201 bp, Homo sapiens
agcactttgggaggttgaggcaggagaatcccttgagccaggagttcaagaccagcctgggcaacatagcaagagatcccatatctaccaaaacatacaaraattagccagatgtggtggtgcatgcctgtggtcccagatactcaggaggctgaggcaggaggatcacctatgcctgggaggttgaagccccagtgagcc

SEQ ID NO: 71870 - DNA, 201 bp, Homo sapiens
cagcttggggatccgatctggaagagagattctgatctgcccacctcctcttcctccttctctacaaaagctccggttgattcgagggaagtggtgaaaawttttttttctcccattttcctccctgcatctggggacacagctgccgtgaccagggaggccagcctgggaggtccagatgcccagggagaatcttggtct

SEQ ID NO: 71871 - DNA, 201 bp, Homo sapiens
cctgtggtcccagatactcaggaggctgaggcaggaggatcacctatgcctgggaggttgaagccccagtgagccatgatcacaccactgtagtccagccygggtgacacagcaagactctgtctcaaaaaaaaaaaaaaaaaaaatcctcatgcaagaagggaaggaccaagtcccattccctcttgcctcattttcaga

SEQ ID NO: 71872 - DNA, 201 bp, Homo sapiens
gggacatccaccctctggggtgtggccaggaaaagacaagctcttcagcttggggatccgatctggaagagagattctgatctgcccacctcctcttcctycttctctacaaaagctccggttgattcgagggaagtggtgaaaaattttttttctcccattttcctccctgcatctggggacacagctgccgtgaccagg

SEQ ID NO: 71873 - DNA, 201 bp, Homo sapiens
caacttgatgatggcatctcttttaagatgcccaagtctgcgcacttttattcctttattcggcccctagcaccccctccccaccccaaagaaggtcagtwgcatgcgtgtggggatgtagctcaaaaaagaaataagatggagtggaaaggaaagaaaggaagaagcaggaattcaaggtgggtgggctgagcttggggc

SEQ ID NO: 71874 - DNA, 201 bp, Homo sapiens
tggtaaggtcttcccttggatttggatgggtgctgtcaccttggtctacggattgcccctctgaccccgttttggtctctctcttacccgccacgccctgyggcttagatatctctgcgactttacctactacacctctttgtaccagagtcacggtcgatcagccttcgtccacgtgcccccactggggaagccgtacaa

SEQ ID NO: 71875 - DNA, 201 bp, Homo sapiens
gaccctcaggcatctcctttcccttcctgccttcctctcccttctcctctgctgcagcatgattttcttaatcttcagacactcactattttcatgaacarttaccctccggccccacaaccaaagacaactcatggcctcctttggcccttgtgtaacactgcaaacctgtggctttgcaaaatgtacccaggtcacaag

SEQ ID NO: 71876 - DNA, 201 bp, Homo sapiens
tttcctttgattaagctgctgcttcctctgtttcactggattgtgctagttatcagtggttcttgggttcaaagtaataagaattccaaaactggaaaaawaaataaataaataaaaattaatgataaacttccacttcagcaatgaatagaaccttttctcttataagtatgtggtattttatgacatttaaaatatata

SEQ ID NO: 71877 - DNA, 201 bp, Homo sapiens
caacattctagaaagatatagctaagaatgttgcttctacaattagaaaataaagtatcagactatattaaaaattaatagtacttcgttactactaaacragctagtacttcgttttcattggatacattttcagcatcatgagttgtcacagcctctgagcccctgatcttaagccacaagggctgagtgtattgtaaa

SEQ ID NO: 71878 - DNA, 201 bp, Homo sapiens
tggtaggacaacagtttgtggtacaatgttaaagacacaactgtaaaatttttttgcaaagaaaaaatctccctactaacttgtttctcagccttctggawacaatatttactttttaaaaatcagaaatcatttaaataaaacattaaatccatgaggtttccaaatgccatttactttgtcttattaaattaagcctac

SEQ ID NO: 71879 - DNA, 201 bp, Homo sapiens
tagttccagctacttgggagactgaggcaggaggactgcttgaacccaggagtttgaggctgcagtgagttgtgatcacaccactgcactccagcctggaygacagagagaccctgtctctataaataaataagtaaaattttaaaaaataaaaataaatagtatatgccctgtttaagcaacagaatggggtattaaaat

SEQ ID NO: 71880 - DNA, 201 bp, Homo sapiens
agacaccatgattggacaagaagcatttattttaatgtttaaaattataaactggccaggcgcagtggccaacacctgtaattccagcactttggaaggcyaacacaggtggatcacttgaggtcaggagttcgagatcagcctggccaccatggtgaaaccccgtctccactaaaaaatacaaaaattagcctggcatgg

SEQ ID NO: 71881 - DNA, 201 bp, Homo sapiens
attttaaaaaataaaaataaatagtatatgccctgtttaagcaacagaatggggtattaaaatattaggagaattggtttctgcttttaaaaatacactaktctcaatcactgaattgattatataacatcatgcttgacttgaaccaaaactaggtggaatttgaaatatgttaaatatgcattagaaggaaatcgtaaa

SEQ ID NO: 71882 - DNA, 201 bp, Homo sapiens
actggaaaacaacccaaaagttcttcaacaggtgatcagttaaactgtggtacaaccatactgtggaatactctgtaataataaaaaggaacagaccaccraaaaaaatagtcatgtggtacttaacggcatttctgtcaatgacagagcacatgtggaacagtggtcccataagattataatggagctgaaaaattccta

SEQ ID NO: 71883 - DNA, 201 bp, Homo sapiens
aactggaaaacaacccaaaagttcttcaacaggtgatcagttaaactgtggtacaaccatactgtggaatactctgtaataataaaaaggaacagaccacyaaaaaaaatagtcatgtggtacttaacggcatttctgtcaatgacagagcacatgtggaacagtggtcccataagattataatggagctgaaaaattcct

SEQ ID NO: 71884 - DNA, 201 bp, Homo sapiens
ggtggatcacttgaggtcaggagttcgagatcagcctggccaccatggtgaaaccccgtctccactaaaaaatacaaaaattagcctggcatggtggcgcrcacctgtaatttcagctacttgggagactgaggcaggagaatagcttgaacccaggaggtggaagttgtagtgagccgggattgcgccactgcactccag

SEQ ID NO: 71885 - DNA, 201 bp, Homo sapiens
tcgcctaacttctaaatacaggtttggtcgatcaaaaccagtacaggtgatctgaggatttctcagatttaagcaacgtacaatgtcttcccggattgaaraacttgcagtagcagtaagtgcaacgattggaacctgaatgatgtaaaactgatattttaaaaaggaaagagctcattcattcccaacatgtctatagct

SEQ ID NO: 71886 - DNA, 201 bp, Homo sapiens
tgaagaagaactcacagaaaattaacaaaatataacacagtaagttagacagtgatagtgctatttttaaaacagcaaagatttacgaggaatgctgaatratgggggagggggaactaatctgatatttcaaatatggtggcccaggaggcctaaatccaagagatctgagagaagtatgggagaacatcctatagacaa

SEQ ID NO: 71887 - DNA, 201 bp, Homo sapiens
cataaaatagctcttcagatgcactgcatctattatacaaaccaaccatagcaattatcttgtatataagtggaaatgtatgtgcaatttaccaatttgcraagaagcacttctagaatatgactcaaaattaaaacaagatcaatttattaaaaattataaactactttttcaatcactataactttactgaattaaaaa

SEQ ID NO: 71888 - DNA, 201 bp, Homo sapiens
gcatctattatacaaaccaaccatagcaattatcttgtatataagtggaaatgtatgtgcaatttaccaatttgcaaagaagcacttctagaatatgactsaaaattaaaacaagatcaatttattaaaaattataaactactttttcaatcactataactttactgaattaaaaattatctccaaacttatatttaaaaa

SEQ ID NO: 71889 - DNA, 201 bp, Homo sapiens
tagctttcttacaaagagactggtaggacaacagtttgtggtacaatgttaaagacacaactgtaaaatttttttgcaaagaaaaaatctccctactaacytgtttctcagccttctggatacaatatttactttttaaaaatcagaaatcatttaaataaaacattaaatccatgaggtttccaaatgccatttactttg

SEQ ID NO: 71890 - DNA, 201 bp, Homo sapiens
taagtggaaatgtatgtgcaatttaccaatttgcaaagaagcacttctagaatatgactcaaaattaaaacaagatcaatttattaaaaattataaactaytttttcaatcactataactttactgaattaaaaattatctccaaacttatatttaaaaaaatcaattaagtttaagagtaggttttttcaaattaaaaaa

SEQ ID NO: 71891 - DNA, 201 bp, Homo sapiens
tgtttcactggattgtgctagttatcagtggttcttgggttcaaagtaataagaattccaaaactggaaaaaaaaataaataaataaaaattaatgataarcttccacttcagcaatgaatagaaccttttctcttataagtatgtggtattttatgacatttaaaatatataaactagagtgaagcttaaaaacaacaca

SEQ ID NO: 71892 - DNA, 201 bp, Homo sapiens
tatgcaacagtgttgctcaaattgatattgactacatatcactcttttttaaaaaaggtggaaaatatgtaaaaatttgaacttatgtaacagataaatcraaagagtaaaaattcctattacaaaaggagccattattttgccaagtgatttgctacagacttttatttcctcttaattttctgaggggagaaaattcta

SEQ ID NO: 71893 - DNA, 201 bp, Homo sapiens
gattaatgtataattacaaatgataaactctcaattcactgaaaatctaactatataaagcaatggtcgtttttttttggcctcctattttaaatatatasgtttatggcttcacaaatctagaagcaaagctccaatgacccagataacctctcttcagtggtactgagataatcaataacatactatatataggaaata

SEQ ID NO: 71894 - DNA, 201 bp, Homo sapiens
atccattcttgttttattctgaatataggacaagaaagccaggagcaaatcctacatttcaattattccttaaggtcctcaagaataactccaggattttyttggcctagcatcaatattccctttagaggaaaacaccaatgatgttctttaaactctatttgtctatgcttgttttgtgtttgtattggtagaagcttt

SEQ ID NO: 71895 - DNA, 201 bp, Homo sapiens
tagtaaggagttccagaaaggtattccagacttaaggatgtgtttgcagacaataatttgtaaactgcatagaaagcaacaaggggcactggggagagggrtatctgttggggaaattataatagtctcggctaaaaagtaacaaagacctcaattagcagagtcaacatgaaaaacagaaagaaacatttgcataggatt

SEQ ID NO: 71896 - DNA, 201 bp, Homo sapiens
cactcactcagagcaacttccagtcctacaagctccattcacaggaagcaccctatacaggtataccatcttttatcttttatactgtatttttactgtgycttttctacattagataagtttagatacacaaatacttaccattgtattacaattgcctgcaatattcattacagtaacatctgtacaggtttacagcct

SEQ ID NO: 71897 - DNA, 201 bp, Homo sapiens
ttcttcaacaggtgatcagttaaactgtggtacaaccatactgtggaatactctgtaataataaaaaggaacagaccaccaaaaaaaatagtcatgtggtrcttaacggcatttctgtcaatgacagagcacatgtggaacagtggtcccataagattataatggagctgaaaaattcctatcaccaagtgatgtcatagc

SEQ ID NO: 71898 - DNA, 201 bp, Homo sapiens
gaacagtgagaaaaatgatactactataaccaccaggtggcatgtctcaccacttagctaataaagagggttcttgaaaacaccaggggaaaaacgttttytcagccactgctcggccaacaccctccccgcactggaggcccaacagaaggaatgtgctttattaatcctcccaagaaatgaaaatgatccaatgacgtc

SEQ ID NO: 71899 - DNA, 201 bp, Homo sapiens
aaagaaaaaatctccctactaacttgtttctcagccttctggatacaatatttactttttaaaaatcagaaatcatttaaataaaacattaaatccatgakgtttccaaatgccatttactttgtcttattaaattaagcctacttgttagctatctacttctccatttattattttttaacattacatttgaaatggtgc

SEQ ID NO: 71900 - DNA, 201 bp, Homo sapiens
gaacccaggaggcagaggctgcaacgagccaagatcccgccactgcattacagcctgggcgacagagcaagactccatgtcaaaaaaaaaaaaaaaaaaaycttattttaaaaacatgttttcaaagaagaaaaaactactcaacaaaacctagatattgtaatatcctatatattaaggctctaatttaagaaaatgcaa

SEQ ID NO: 71901 - DNA, 201 bp, Homo sapiens
aacagcttagtgatttctgctgtttttgaaattactgaaataatatagtgtgaaacattccaggtttatagcagttgtcctagtataactggaatcagaasgagaagaaaagcaccaagaacagtgagaaaaatgatactactataaccaccaggtggcatgtctcaccacttagctaataaagagggttcttgaaaacac

SEQ ID NO: 71902 - DNA, 201 bp, Homo sapiens
tattttcatgaacagttaccctccggccccacaaccaaagacaactcatggcctcctttggcccttgtgtaacactgcaaacctgtggctttgcaaaatgyacccaggtcacaaggggatttttttttttagcaatgatatccctttctgggtcactttttaagcttataaccagacttataatcttaaatgtatttttcc

SEQ ID NO: 71903 - DNA, 201 bp, Homo sapiens
actagtctcaatcactgaattgattatataacatcatgcttgacttgaaccaaaactaggtggaatttgaaatatgttaaatatgcattagaaggaaatcrtaaataacataaaatacataagttgttaaaaaaaaaaaaaggaaatcattaccaaaattcatcaaccattaaatccttaccttgttttgacaagaaatgg

SEQ ID NO: 71904 - DNA, 201 bp, Homo sapiens
gattttcttaatcttcagacactcactattttcatgaacagttaccctccggccccacaaccaaagacaactcatggcctcctttggcccttgtgtaacaytgcaaacctgtggctttgcaaaatgtacccaggtcacaaggggatttttttttttagcaatgatatccctttctgggtcactttttaagcttataaccag

SEQ ID NO: 71905 - DNA, 201 bp, Homo sapiens
gtaatatatttatgaaaatgaggaagtaagcatgaaacatgacatatatttaagaagttaacagaaaaaccaggcaaaagaatggcagcacagtgaaaaargtctgttttggaatcagattgcttgagctgaaatcctgtttttgccacttactagatgtgagattttgagctctttatttaactctctaagcttcagttt

SEQ ID NO: 71906 - DNA, 201 bp, Homo sapiens
cagagcaggagactcagcagttatcaggaaaagcatgaatatgtcatcttccagaaattctaaggtacagtaacaacatgcctcccctaaaactagaactsgtgtttttattctattataggaaattacacttaactatggtattatttcataatcagaaaaagtggactgtcttacagttgtttctaaattatcagctgt

SEQ ID NO: 71907 - DNA, 201 bp, Homo sapiens
agacagagcaggagactcagcagttatcaggaaaagcatgaatatgtcatcttccagaaattctaaggtacagtaacaacatgcctcccctaaaactagawctcgtgtttttattctattataggaaattacacttaactatggtattatttcataatcagaaaaagtggactgtcttacagttgtttctaaattatcagc

SEQ ID NO: 71908 - DNA, 201 bp, Homo sapiens
gctagcaaaggcttcttgactggattggcagacagagcaggagactcagcagttatcaggaaaagcatgaatatgtcatcttccagaaattctaaggtacrgtaacaacatgcctcccctaaaactagaactcgtgtttttattctattataggaaattacacttaactatggtattatttcataatcagaaaaagtggac

SEQ ID NO: 71909 - DNA, 201 bp, Homo sapiens
ccttatatttgattaatgtataattacaaatgataaactctcaattcactgaaaatctaactatataaagcaatggtcgtttttttttggcctcctatttkaaatatataggtttatggcttcacaaatctagaagcaaagctccaatgacccagataacctctcttcagtggtactgagataatcaataacatactatat

SEQ ID NO: 71910 - DNA, 201 bp, Homo sapiens
attttttgtagagacagggattcaccatgttgcccaggctggtctcgaactcctggcctcaagtgattctccaacgtctgcctcccaaagtgctgggattmtgggtgtgagacaccatgattggacaagaagcatttattttaatgtttaaaattataaactggccaggcgcagtggccaacacctgtaattccagcactt

SEQ ID NO: 71911 - DNA, 201 bp, Homo sapiens
taattacaaatgataaactctcaattcactgaaaatctaactatataaagcaatggtcgtttttttttggcctcctattttaaatatataggtttatggcwtcacaaatctagaagcaaagctccaatgacccagataacctctcttcagtggtactgagataatcaataacatactatatataggaaatatgtataaatg

SEQ ID NO: 71912 - DNA, 201 bp, Homo sapiens
ttgaaaacttcttaacatatatatttaaaatgcctttaaacaaaataaacagaaaaaagtactaatgccagtttcctcaacaataaaatgaaaataatacrtaacttactgagcagttatagggattaaattagatcattttatatagaaagcgcctacaatagtccttggaacacaatacaggctccactgtgtttgtaa

SEQ ID NO: 71913 - DNA, 201 bp, Homo sapiens
attcttgcatgttgctgtctgggaatagaccacactacagctggtagttctgggggcggtactgccgaaaggcctgaacacatgtattttggctgcaattraggaacttgggatgctgactattaattttgtatttcagcaactgccccttctcctatcccaaagaaccaattactgccctctgcctcagcagtaccagta

SEQ ID NO: 71914 - DNA, 201 bp, Homo sapiens
ctgagataatcaataacatactatatataggaaatatgtataaatgaaacgtattattaattgattgctagcaaaggcttcttgactggattggcagacasagcaggagactcagcagttatcaggaaaagcatgaatatgtcatcttccagaaattctaaggtacagtaacaacatgcctcccctaaaactagaactcgt

SEQ ID NO: 71915 - DNA, 201 bp, Homo sapiens
tcattttatatagaaagcgcctacaatagtccttggaacacaatacaggctccactgtgtttgtaaggtgaccttttctaagctccttaagactgaagtcrtgtaattagtaaactagacagaattcagatgaaagagtcattttatgtttgcttgtttacttatcaatcattaaaagtatatgtcctagccaggcatggt

SEQ ID NO: 71916 - DNA, 201 bp, Homo sapiens
aatacataagttgttaaaaaaaaaaaaaggaaatcattaccaaaattcatcaaccattaaatccttaccttgttttgacaagaaatggctgcagatcctgmaggatattccctgtttttcgcctaacttctaaatacaggtttggtcgatcaaaaccagtacaggtgatctgaggatttctcagatttaagcaacgtacaa

SEQ ID NO: 71917 - DNA, 201 bp, Homo sapiens
aacaggcagcaagttttgctaaatcaaacaaccaaatataaattaatcttagacatatacttcaatggtgtggtgcccacagactgagaaaagtataagtwtcccacctgcttctaaattcaggtcatgttgctaattctaactttgtactccataacatcacacatacttcattcattcatgcactcattctaaatagtt

SEQ ID NO: 71918 - DNA, 201 bp, Homo sapiens
tgattgctagcaaaggcttcttgactggattggcagacagagcaggagactcagcagttatcaggaaaagcatgaatatgtcatcttccagaaattctaargtacagtaacaacatgcctcccctaaaactagaactcgtgtttttattctattataggaaattacacttaactatggtattatttcataatcagaaaaag

SEQ ID NO: 71919 - DNA, 201 bp, Homo sapiens
ttcttggcctagcatcaatattccctttagaggaaaacaccaatgatgttctttaaactctatttgtctatgcttgttttgtgtttgtattggtagaagctttttttttttttttgaaacggggccttgctctgtcatccagcctggagtacagtggtgtgatctcagctcactgcagccccaacatcctgggctcaaatg

SEQ ID NO: 71920 - DNA, 201 bp, Homo sapiens
actaaagaattatttcaagaaaaagtatgaagattttaatagctaccttgttgaaccatgatactaaaatctgacccaaggccagccacatcattggagckcaattcacatggtttgattttccctcaatataaacttgctaactagtatatttaatttatttttggtttgttctgttttaatatctgctccaaccaaact

SEQ ID NO: 71921 - DNA, 201 bp, Homo sapiens
acaaaaaattagccgggcacagtggcgggcgcctgtagtctcagctactcgggaggctgaggcaggagaatggcgtgaacccaggaggcggagcttgcagygagccgagatcgcgccactgcattccagccagggtgacagaaccagactgtctcaaaaaaagaaaaataaataaaaaaaaataaagaacctttgagatat

SEQ ID NO: 71922 - DNA, 201 bp, Homo sapiens
atacaaaattagctaggcatggtggcacgtacctataatcctaactactggggaggctgagcagaagaatcgcttgaacccgggaggcagaggttgcagtraggtgagttcacgccattgcactccagcctgggcaacaagagtgaaactccatctcaaaaataaaaaaataaaataacataaaactgtatgttgggtgaa

SEQ ID NO: 71923 - DNA, 201 bp, Homo sapiens
aatatggtgaaaccccatctctactaaaaatacaaaattagctaggcatggtggcacgtacctataatcctaactactggggaggctgagcagaagaatcrcttgaacccgggaggcagaggttgcagtgaggtgagttcacgccattgcactccagcctgggcaacaagagtgaaactccatctcaaaaataaaaaaata

SEQ ID NO: 71924 - DNA, 201 bp, Homo sapiens
ttaacaggcagcaagttttgctaaatcaaacaaccaaatataaattaatcttagacatatacttcaatggtgtggtgcccacagactgagaaaagtataaktatcccacctgcttctaaattcaggtcatgttgctaattctaactttgtactccataacatcacacatacttcattcattcatgcactcattctaaatag

SEQ ID NO: 71925 - DNA, 201 bp, Homo sapiens; identical to SEQ ID NO: 68000

SEQ ID NO: 71926 - DNA, 201 bp, Homo sapiens; identical to SEQ ID NO: 68002

SEQ ID NO: 71927 - DNA, 201 bp, Homo sapiens; identical to SEQ ID NO: 67372

SEQ ID NO: 71928 - DNA, 201 bp, Homo sapiens; identical to SEQ ID NO: 68003

SEQ ID NO: 71929 - DNA, 201 bp, Homo sapiens; identical to SEQ ID NO: 67374

SEQ ID NO: 71930 - DNA, 201 bp, Homo sapiens; identical to SEQ ID NO: 68006

SEQ ID NO: 71931 - DNA, 201 bp, Homo sapiens; identical to SEQ ID NO: 67948

SEQ ID NO: 71932 - DNA, 201 bp, Homo sapiens; identical to SEQ ID NO: 67377

SEQ ID NO: 71933 - DNA, 201 bp, Homo sapiens; identical to SEQ ID NO: 68008

SEQ ID NO: 71934 - DNA, 201 bp, Homo sapiens; identical to SEQ ID NO: 67952

SEQ ID NO: 71935 - DNA, 201 bp, Homo sapiens
tgggtgggcacaatctaatcagctgccagcgaatataaagcaggcagaaaaacatgaagaggagagactggcctaccctcccagcctacatctttctcccrtgctgatgcttcctgccctcaaacatcagactccaaattcttcagttttgagactcagactggctctccttgctcctcaggcttgcagaccgcctactgt

SEQ ID NO: 71936 - DNA, 201 bp, Homo sapiens; identical to SEQ ID NO: 67379

SEQ ID NO: 71937 - DNA, 201 bp, Homo sapiens; identical to SEQ ID NO: 67380

SEQ ID NO: 71938 - DNA, 201 bp, Homo sapiens; identical to SEQ ID NO: 67661

SEQ ID NO: 71939 - DNA, 201 bp, Homo sapiens; identical to SEQ ID NO: 67381

SEQ ID NO: 71940 - DNA, 201 bp, Homo sapiens; identical to SEQ ID NO: 67808

SEQ ID NO: 71941 - DNA, 201 bp, Homo sapiens; identical to SEQ ID NO: 67385

SEQ ID NO: 71942 - DNA, 201 bp, Homo sapiens; identical to SEQ ID NO: 67386

SEQ ID NO: 71943 - DNA, 201 bp, Homo sapiens; identical to SEQ ID NO: 67387

SEQ ID NO: 71944 - DNA, 201 bp, Homo sapiens; identical to SEQ ID NO: 67852

SEQ ID NO: 71945 - DNA, 201 bp, Homo sapiens; identical to SEQ ID NO: 67855

SEQ ID NO: 71946 - DNA, 201 bp, Homo sapiens
tctccagaacaacaaaccaagtccatgctatagcaaatgacccaaggttactaaatgagctaacaagcaagaacaaattagaatctaacattctgctcagktctgagcactgaacactccacagcatacatttcttcaattctattaaacataccattcagcaaccctaatagctaaaaactagcaaaaggcacaaagggt

SEQ ID NO: 71947 - DNA, 201 bp, Homo sapiens; identical to SEQ ID NO: 67646

SEQ ID NO: 71948 - DNA, 201 bp, Homo sapiens
caggtaagccagggaactaactggatgtttacacttaattcctggtttttaaaatgcagacaagaaaaaaaatgtggccctcaaaaaaccatatctgtgtmccatactcatgtgttctgaacttaacctcctgtctctaaatgtataagattttgtaagttcagtttccttcacttaattgaggagaaatgtgattgtatc

SEQ ID NO: 71949 - DNA, 201 bp, Homo sapiens
tatgtcaagatgatatcatatatatgatgtaagtaataagtatccttagtagatactgaaaactcagtaaatgtgcaaatacctatattgaagtaggttgmaaattcttacttgtacccaaaatagttcactgaataaagaccgtggacaaaaaatgggacctttgagtactgtaactaaggtggaagatgagatcttcta

SEQ ID NO: 71950 - DNA, 201 bp, Homo sapiens; identical to SEQ ID NO: 67393

SEQ ID NO: 71951 - DNA, 201 bp, Homo sapiens
caatcattagaaatgaagtattttctccagaacaacaaaccaagtccatgctatagcaaatgacccaaggttactaaatgagctaacaagcaagaacaaaytagaatctaacattctgctcagttctgagcactgaacactccacagcatacatttcttcaattctattaaacataccattcagcaaccctaatagctaaa

SEQ ID NO: 71952 - DNA, 201 bp, Homo sapiens; identical to SEQ ID NO: 67394

SEQ ID NO: 71953 - DNA, 201 bp, Homo sapiens
tgtttcttttttttttaacccaagagatacgggctttaacacttttttttttcctgttgggcaggtgaaatggactcttaaaactgagctttaacaatacmcagcagtagacaaatatgtcaagatgatatcatatatatgatgtaagtaataagtatccttagtagatactgaaaactcagtaaatgtgcaaatacctat

SEQ ID NO: 71954 - DNA, 201 bp, Homo sapiens
aactaaatcactcatctaggggcagtgcattggataaggaattgttactactttttgctactcctttgcagatcaatcattagaaatgaagtattttctcmagaacaacaaaccaagtccatgctatagcaaatgacccaaggttactaaatgagctaacaagcaagaacaaattagaatctaacattctgctcagttctg

SEQ ID NO: 71955 - DNA, 201 bp, Homo sapiens; identical to SEQ ID NO: 67395

SEQ ID NO: 71956 - DNA, 201 bp, Homo sapiens
gctgaggcaggagaatggtgtgaacccgggaggcggagcttgcagtgagccaagattgcgccactgcactccagcctgggcgacagagcgatactctgtcmcaaaaaaaaaaaaaaaaaaaaaaaaaaaccaagaattgagaattatgttgtcaactgaaaaaacagtagctgggaataaagtcacttatctggttcattt

SEQ ID NO: 71957 - DNA, 201 bp, Homo sapiens
ctcatgtgttctgaacttaacctcctgtctctaaatgtataagattttgtaagttcagtttccttcacttaattgaggagaaatgtgattgtatcaataayaacagtgtagtatcatgttaagccaaccatatgaaatagccaatatctgatcattctgactgtaaaaaatagcaatagcgtgtgattcaacttagtatga

SEQ ID NO: 71958 - DNA, 201 bp, Homo sapiens
ggcactttgggaggccgaggcgggtggatcacaaggtcagcagatcaagaccatcctggccaacaggatgaaaccctgtctctactaaaaaaaaaaaaaaaatacaaaaaattagccaggcatggtggcatgcgcctgtggtcccaactacttgggaggctgaggcaggagaatggtgtgaacccgggaggcggagcttgc

SEQ ID NO: 71959 - DNA, 201 bp, Homo sapiens
aaaaaccatatctgtgtaccatactcatgtgttctgaacttaacctcctgtctctaaatgtataagattttgtaagttcagtttccttcacttaattgagragaaatgtgattgtatcaataataacagtgtagtatcatgttaagccaaccatatgaaatagccaatatctgatcattctgactgtaaaaaatagcaata

SEQ ID NO: 71960 - DNA, 201 bp, Homo sapiens
gcaggaaatgcaaatgagcagcgcatcctggatgtgggacattagggagcagtggggatttcagtaaatgtggagggaggaagctgttactcagtatgatrgttaatactgagagtcaacttgattggattgaaggatgcaaagtattgatcctgggtgtctgtgagcgtgttgccaaaggagattaacatttgagtcagt

SEQ ID NO: 71961 - DNA, 201 bp, Homo sapiens; identical to SEQ ID NO: 68056

SEQ ID NO: 71962 - DNA, 201 bp, Homo sapiens; identical to SEQ ID NO: 67868

SEQ ID NO: 71963 - DNA, 201 bp, Homo sapiens; identical to SEQ ID NO: 67757

SEQ ID NO: 71964 - DNA, 201 bp, Homo sapiens; identical to SEQ ID NO: 67593

SEQ ID NO: 71965 - DNA, 201 bp, Homo sapiens; identical to SEQ ID NO: 67594

SEQ ID NO: 71966 - DNA, 201 bp, Homo sapiens; identical to SEQ ID NO: 68061

SEQ ID NO: 71967 - DNA, 201 bp, Homo sapiens; identical to SEQ ID NO: 67453

SEQ ID NO: 71968 - DNA, 201 bp, Homo sapiens; identical to SEQ ID NO: 67673

SEQ ID NO: 71969 - DNA, 201 bp, Homo sapiens; identical to SEQ ID NO: 68066

SEQ ID NO: 71970 - DNA, 201 bp, Homo sapiens; identical to SEQ ID NO: 67613

SEQ ID NO: 71971 - DNA, 201 bp, Homo sapiens
tcaggtaagttaatacttaataaaccccctttacatatatatatatcctattagttctgtccctctagggaaccttgactaatacactcagcaatagccaractgttgccatgcagtaattaaggtccgttttcatgtattttcaggtaagccagggaactaactggatgtttacacttaattcctggtttttaaaatgca

SEQ ID NO: 71972 - DNA, 201 bp, Homo sapiens; identical to SEQ ID NO: 22207

SEQ ID NO: 71973 - DNA, 201 bp, Homo sapiens; identical to SEQ ID NO: 22208

SEQ ID NO: 71974 - DNA, 201 bp, Homo sapiens; identical to SEQ ID NO: 3167

SEQ ID NO: 71975 - DNA, 201 bp, Homo sapiens; identical to SEQ ID NO: 22211

SEQ ID NO: 71976 - DNA, 201 bp, Homo sapiens; identical to SEQ ID NO: 22214

SEQ ID NO: 71977 - DNA, 201 bp, Homo sapiens; identical to SEQ ID NO: 22215

SEQ ID NO: 71978 - DNA, 201 bp, Homo sapiens; identical to SEQ ID NO: 3168

SEQ ID NO: 71979 - DNA, 201 bp, Homo sapiens; identical to SEQ ID NO: 22218

SEQ ID NO: 71980 - DNA, 201 bp, Homo sapiens; identical to SEQ ID NO: 3169

SEQ ID NO: 71981 - DNA, 201 bp, Homo sapiens; identical to SEQ ID NO: 22220

SEQ ID NO: 71982 - DNA, 201 bp, Homo sapiens; identical to SEQ ID NO: 22221

SEQ ID NO: 71983 - DNA, 201 bp, Homo sapiens; identical to SEQ ID NO: 22222

SEQ ID NO: 71984 - DNA, 201 bp, Homo sapiens; identical to SEQ ID NO: 22223

SEQ ID NO: 71985 - DNA, 201 bp, Homo sapiens; identical to SEQ ID NO: 22224

SEQ ID NO: 71986 - DNA, 201 bp, Homo sapiens
ttgttaacttctgtggttacagtaatttcttatgtattgccttctccgagtcttttttttcttgctgaagtatatcctttagtaattctttcagtaaaggyatgtggttagtggggtcttcacatgcagaaatgcatacacatatgtatgcatagaaatatgtatcacgcatatgtatgataatattgccatgcatttttg

SEQ ID NO: 71987 - DNA, 201 bp, Homo sapiens; identical to SEQ ID NO: 22226

SEQ ID NO: 71988 - DNA, 201 bp, Homo sapiens
ggtcttcacatgcagaaatgcatacacatatgtatgcatagaaatatgtatcacgcatatgtatgataatattgccatgcatttttgtccttcaaatagcrgatataaaagtataggtcgagttattttctctcagttctttggaaatattattcttttgtgacttggcttttctgattggaagcattcatagcatttaag

SEQ ID NO: 71989 - DNA, 201 bp, Homo sapiens; identical to SEQ ID NO: 22227

SEQ ID NO: 71990 - DNA, 201 bp, Homo sapiens; identical to SEQ ID NO: 22228

SEQ ID NO: 71991 - DNA, 201 bp, Homo sapiens; identical to SEQ ID NO: 3165

SEQ ID NO: 71992 - DNA, 201 bp, Homo sapiens; identical to SEQ ID NO: 22230

SEQ ID NO: 71993 - DNA, 201 bp, Homo sapiens; identical to SEQ ID NO: 22231

SEQ ID NO: 71994 - DNA, 201 bp, Homo sapiens; identical to SEQ ID NO: 22233

SEQ ID NO: 71995 - DNA, 201 bp, Homo sapiens
tggttgttttttttattattattcttttgcttatttggaaccgatggcatatatttctattattttaggggttactcatatgtttagcatacattcttttyttttttctttttttttagagactgggtcttgctctgtatcccattctagaatgcactgccacaattatagctcactgcaccctagacttcctgggctcaa

SEQ ID NO: 71996 - DNA, 201 bp, Homo sapiens
ttttttttattattattcttttgcttatttggaaccgatggcatatatttctattattttaggggttactcatatgtttagcatacattcttttctttttyctttttttttagagactgggtcttgctctgtatcccattctagaatgcactgccacaattatagctcactgcaccctagacttcctgggctcaagcaatc

SEQ ID NO: 71997 - DNA, 201 bp, Homo sapiens; identical to SEQ ID NO: 22234

SEQ ID NO: 71998 - DNA, 201 bp, Homo sapiens; identical to SEQ ID NO: 22236

SEQ ID NO: 71999 - DNA, 201 bp, Homo sapiens; identical to SEQ ID NO: 22235

SEQ ID NO: 72000 - DNA, 201 bp, Homo sapiens; identical to SEQ ID NO: 22237

SEQ ID NO: 72001 - DNA, 201 bp, Homo sapiens; identical to SEQ ID NO: 22240

SEQ ID NO: 72002 - DNA, 201 bp, Homo sapiens; identical to SEQ ID NO: 22239

SEQ ID NO: 72003 - DNA, 201 bp, Homo sapiens; identical to SEQ ID NO: 3166

SEQ ID NO: 72004 - DNA, 201 bp, Homo sapiens; identical to SEQ ID NO: 22242

SEQ ID NO: 72005 - DNA, 201 bp, Homo sapiens; identical to SEQ ID NO: 22244

SEQ ID NO: 72006 - DNA, 201 bp, Homo sapiens; identical to SEQ ID NO: 22243

SEQ ID NO: 72007 - DNA, 201 bp, Homo sapiens; identical to SEQ ID NO: 22245

SEQ ID NO: 72008 - DNA, 201 bp, Homo sapiens
tacaggcgtgtgccaccaggcctggctttttttttttttttttttctttaaagagatggggtcttactatgttatgttactcaggctagtctcaaactccyggcctcaagcaatgccctggcctcccaaagcactgggattacaggcacaagccaccacacccggctagcacacgttctaaactatatattatcctaacaa

SEQ ID NO: 72009 - DNA, 201 bp, Homo sapiens; identical to SEQ ID NO: 22246

SEQ ID NO: 72010 - DNA, 201 bp, Homo sapiens; identical to SEQ ID NO: 3163

SEQ ID NO: 72011 - DNA, 201 bp, Homo sapiens; identical to SEQ ID NO: 22248

SEQ ID NO: 72012 - DNA, 201 bp, Homo sapiens; identical to SEQ ID NO: 3164

SEQ ID NO: 72013 - DNA, 201 bp, Homo sapiens; identical to SEQ ID NO: 22250

SEQ ID NO: 72014 - DNA, 201 bp, Homo sapiens; identical to SEQ ID NO: 22251

SEQ ID NO: 72015 - DNA, 201 bp, Homo sapiens; identical to SEQ ID NO: 22252

SEQ ID NO: 72016 - DNA, 201 bp, Homo sapiens; identical to SEQ ID NO: 22253

SEQ ID NO: 72017 - DNA, 201 bp, Homo sapiens; identical to SEQ ID NO: 22254

SEQ ID NO: 72018 - DNA, 201 bp, Homo sapiens; identical to SEQ ID NO: 22255

SEQ ID NO: 72019 - DNA, 201 bp, Homo sapiens; identical to SEQ ID NO: 22256

SEQ ID NO: 72020 - DNA, 201 bp, Homo sapiens
gtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatatggtc

SEQ ID NO: 72021 - DNA, 201 bp, Homo sapiens
gacatactgattgttaccatatggatgggtgggcaattatatctccctttgatttgcattcctttggttgttaatgaggttgaacatcttttgatacattyattggtcatttatactgtcttctgctgattgcctattcatatcttttgcccatttttctgttggattgttttctttcttactgatttgttctgtataaat

SEQ ID NO: 72022 - DNA, 201 bp, Homo sapiens
gaagaagccaggttctagttacattaaatgttcatcatagacacatccctatggacgaaaagactggtggttgcctgaggctgggaggagagggaattgartagctgctaatgggcacggcgtttcttcttggggtaatgaagagattttaaaatttgattttggtggtagttgcataattctgcatatactaaaaactat

SEQ ID NO: 72023 - DNA, 201 bp, Homo sapiens
aaatttgattttggtggtagttgcataattctgcatatactaaaaactattgaggctgggcacggtggctcacgcctgttatcccagcactttgggaggcygaggtgggcagatcatttgaggtcaggagtttgagactagcccagccaacatggtgaaatcctgtctctactaaaaatacaaaaaaaagtagctgggcct

SEQ ID NO: 72024 - DNA, 201 bp, Homo sapiens
aaagtgtatgccctgtttgggggcttattgatacatactaccgaatcaccttttagaaaaattttagcagctccccccctcattagcagtgttggtaagcwgtagttcttacacatttgattgcatgattgtacccaaataattagcagatgcaagctttccctttctctcttaatccttttggagaaaattagtctgtta

SEQ ID NO: 72025 - DNA, 201 bp, Homo sapiens
ccttaccctttgagaggggtagaattcgtttttaaaaataaactttttcatatgttagttattgtagctcttttttatatttataggaaacattttcttcmaattttttctttgtcatttaactttgttttttccttgctgataactttgaagtgttcatgttttacatagtaatttcagtgattttgtctttatggtgtg

SEQ ID NO: 72026 - DNA, 201 bp, Homo sapiens
tgctgtttttataaaaagttattgattgaaaaaatgtagttttgttatacgttcttaaagtggtagagatctccattgttttagggtttaaaaaaattttwaaataatttttatattttgcaataacttaagcataccctgagaagagaagagctcctttgctttggttgcttttgtcttgttataaaattttttttacaa

SEQ ID NO: 72027 - DNA, 201 bp, Homo sapiens
aatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgtta

SEQ ID NO: 72028 - DNA, 201 bp, Homo sapiens
tggccgagtgtggtggctcacgcctgtaatcccagcactttgggaggccgaggtggttggatcacctgagttcaggagttcgagaccagcttgaccaacayagtgaaaccctgtctctactaaaaaacaatacaaaaattagtcgggcttggtggcgcatgcctgtaatcccagcaactaaggaggctgaggcagaagaat

SEQ ID NO: 72029 - DNA, 201 bp, Homo sapiens
atttgactaattgtttctgactttacaatttcagtcttggaactttgccttcccggcttctttggtttacagggttgaaaaagaaagcaaaagtatctaaygacctttgtaaaacatcttttaagtgagaacctttttcataaggcagttgtttcctcagtgggtagatggtttttcctgtaatctggcattgtgtaagga

SEQ ID NO: 72030 - DNA, 201 bp, Homo sapiens
caggtttagtaccccttatccgaaatgcttgggaccagaagtattttaaattttggatttgtaaagattctggaatatttgcatagacataatgagatatytcagggatgggacccaggtctaaatataaaatttatttatgttcttccttgttggtatagtggttagttttttttttttaaggtattttatttatgtccc

SEQ ID NO: 72031 - DNA, 201 bp, Homo sapiens
gccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattatt

SEQ ID NO: 72032 - DNA, 201 bp, Homo sapiens
ttctgagcctcaatgagatgagtatagaaattgagaatgagtgtttagaagtttttatagcattttaatacagcagttttatgtctgttgaatcaaaaatwaaaaatcagagcttatatatttatgtttttgttttttaatttcttttttctagtactgtaatttgtttttgttatagtttacaatttattggttcctcat

SEQ ID NO: 72033 - DNA, 201 bp, Homo sapiens
tggtaacagttaatctattgatttaattcctgtattgagtataggtatattcagatacatgttttctttttaagccagttttggtaattatattttcataraaaattgttcatttcatctgatatttcaaattttggggcataaatttgttcgtagaattctctcatgatttttaaaacctctaccaaatctgtgtgcccc

SEQ ID NO: 72034 - DNA, 201 bp, Homo sapiens
caggattgttatatctccctggagaattgcttctgttttgtaataatctttatccctagatatgtttttaacttaagagctattttgcctgataatatagytataccagatttttcttggttagttattttcttggtgtaccttttcccattcttttactttcaacttttctatgtcattatgttttaggtgtgtctcttg

SEQ ID NO: 72035 - DNA, 201 bp, Homo sapiens; identical to SEQ ID NO: 4973

SEQ ID NO: 72036 - DNA, 201 bp, Homo sapiens; identical to SEQ ID NO: 4975

SEQ ID NO: 72037 - DNA, 201 bp, Homo sapiens
cctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgt

SEQ ID NO: 72038 - DNA, 201 bp, Homo sapiens; identical to SEQ ID NO: 27845

SEQ ID NO: 72039 - DNA, 201 bp, Homo sapiens
ctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtg

SEQ ID NO: 72040 - DNA, 201 bp, Homo sapiens
aacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtct

SEQ ID NO: 72041 - DNA, 201 bp, Homo sapiens
tttcattagttattgagtccttggtcttttctcatcaaatcgaattttctcctgtgtttttcatcttgtcagttaatggtaactctttcccctcaagccartctagaagtgtaggaggcatctttgacaatcgcctcaccctcagcatctaatcagtccctatgtcctgcagattccaccaccaaaatccatgtattaata

SEQ ID NO: 72042 - DNA, 201 bp, Homo sapiens
catgtggaccctttttttccttcagtttaacttttctggagcagtgtgctgcgtagttcggcctgagtttgtgcagcttgttaagacaactcttgtgtacrctatgttgaagctcaacaaaaaagtcatgggaccacttctagaaatctttcagctgtcaggcctgtcagtctcatgacagtttgttggttgtgccaaaca

SEQ ID NO: 72043 - DNA, 201 bp, Homo sapiens
ataatttgaactgaccatcctataggttattggtaggtattaaaatgaagtgatttctgcctcttctgtggcaaaagaatttgtgaattagaagccgtggyttctaatcgctttaggattaagtctcaaatgtgtacacacgaagttcgtgatctggcccctgctgtcctctccagccacccttctctaaggtccctgaat

SEQ ID NO: 72044 - DNA, 201 bp, Homo sapiens; identical to SEQ ID NO: 27850

SEQ ID NO: 72045 - DNA, 201 bp, Homo sapiens; identical to SEQ ID NO: 4980

SEQ ID NO: 72046 - DNA, 201 bp, Homo sapiens; identical to SEQ ID NO: 4979

SEQ ID NO: 72047 - DNA, 201 bp, Homo sapiens; identical to SEQ ID NO: 27857

SEQ ID NO: 72048 - DNA, 201 bp, Homo sapiens; identical to SEQ ID NO: 27859

SEQ ID NO: 72049 - DNA, 201 bp, Homo sapiens
gagctttgagtttgttcctcctttcattggattgttttattcagcaattatttgagatgctatggtgatttatagaatacctttctcaatttgactttagrtctctgccaaaataaaatactcttgtagcttactatgggtgacatttgtgaactcctagagggaactgataagctgaggctcttacaaggaagtaaaatt

SEQ ID NO: 72050 - DNA, 201 bp, Homo sapiens
tgtaatcccagctactggaggaggctgaggcaggagaatcacttgaacccaggagacggaggttgcagtgagccaagatcgcacgtgccactgcactccarcctgggtgagagagcaagactccatctcaaaaaataaaaatttaaaaaataaaaaataaaaactactgaactgtatactttaaattataaattacatggc

SEQ ID NO: 72051 - DNA, 201 bp, Homo sapiens; identical to SEQ ID NO: 27861

SEQ ID NO: 72052 - DNA, 201 bp, Homo sapiens; identical to SEQ ID NO: 27936

SEQ ID NO: 72053 - DNA, 201 bp, Homo sapiens
cctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattgaccaaaaagtacagacag

SEQ ID NO: 72054 - DNA, 201 bp, Homo sapiens
ttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggcggggtaggtgtttatattggacgtcagtgcaaaatgtgtttcttactgtgtc

SEQ ID NO: 72055 - DNA, 201 bp, Homo sapiens
atgtataactagttgttaatcattctatcctcttcttgaacagtaccttagaatgctttaactcttatcactgtcctccagtcttacattttattattgcrtagtattttagtttcatgttgtctttatcctcccatcaattatgatcattatgattaatccttacagtaaacacttattttgattgacatgtgttgagta

SEQ ID NO: 72056 - DNA, 201 bp, Homo sapiens
gagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtct

SEQ ID NO: 72057 - DNA, 201 bp, Homo sapiens
gtaatttagcctacaattctaaaccaagctaatttttccttatcaatatggcagtattatttcaattttgtttggctgcttgcacctatttacaagtatgytgttagtccagttgttccttttgagtaatcagcctttcttctctttttgcttttaacatgtttctgtctgtatttgggtgttcttcagtttcactgtgat

SEQ ID NO: 72058 - DNA, 201 bp, Homo sapiens; identical to SEQ ID NO: 27875

SEQ ID NO: 72059 - DNA, 201 bp, Homo sapiens
gctttttattgatttattcccacatgacagagctttgttgaatgagattaccacaacagtccccctatgttgaggtaacatcctttgggttctagctgcargcttcagatccctcaccttttattcatgttttatcttgagtttctgcttacagttcaatttctagccccattgaacatagtagtttagtttttggatggt

SEQ ID NO: 72060 - DNA, 201 bp, Homo sapiens
agaggtttattaagggtgttgagtttcctctgcatgtacttgcttgccacaccaacatgttcactcccaatgcttgttttcaccttctcaaatgaatcacyctgctttctgctttatttccctacagcagttggaatactcctcttctgataccattttcatcctgtcatttccctaatggtaacttaacagtagatcctg

SEQ ID NO: 72061 - DNA, 201 bp, Homo sapiens
ataaataaaccccatcacgaccagtttcttttccacctgtccaaaaaaaaaacaaaattaattggggggaaaaacagttttcatggagggcctcacactasttgatttcacatagtgagatgttgatgttcttagctcggtcttgaagtcacttgttatatattgctgcttcctgtctgtctctgttgactgattctggat

SEQ ID NO: 72062 - DNA, 201 bp, Homo sapiens
ccattgtcaagaaagtgtagtgaccaagacatcctccagaattagtcagttagcaagaaatatttcacattgattgggtagggacacaggccaaatgccgwaattccattcatttgtactgctatataaggctgaataattaattaagttgaaggtcttctgaaataagagtgacagaagagtaaagtctatttagaattg

SEQ ID NO: 72063 - DNA, 201 bp, Homo sapiens
ttccaactcccccatccttttattaaaaagtgaacagcttctcttgcattaagtcaggagcttaatgaaggaattttaagtcaggaacgcagctgttaatrtgatagccactctccaaagtgagagagggtcattggcagttattcagacttgactcatgatactcaggagagcaataggtgaaatgtatatagggagaga

SEQ ID NO: 72064 - DNA, 201 bp, Homo sapiens
tgaggcaggagaatggcgtgaactcaggaggcgaagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatg

SEQ ID NO: 72065 - DNA, 201 bp, Homo sapiens
ggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgtt

SEQ ID NO: 72066 - DNA, 201 bp, Homo sapiens
tcaggagtttgagaccagcctggctaacatggtgaaactctgtttctactaaaaatacacacaaaaaatagtctcctttctttcttcctataaatatttaytgagtatctactgtaggctagttgctgaggcaacaaaaagccatatagccttgtgtgtgtgtgtaggatggggcaatacagcaagtaagtaggcaagtgt

SEQ ID NO: 72067 - DNA, 201 bp, Homo sapiens
atccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaagga

SEQ ID NO: 72068 - DNA, 201 bp, Homo sapiens
tcattctcctggttgctgggagtgttcatggtgacagcttttagcagagtcgctctgcagaaattttcctcggctaaagacccctgccccgggccaagatyacatccccttcctggggacagcacattccataagtggttgatgcaggggtagaaaggcaatttgttcaaaacaaaattgcattggttttctccatatgca

SEQ ID NO: 72069 - DNA, 201 bp, Homo sapiens
ccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaat

SEQ ID NO: 72070 - DNA, 201 bp, Homo sapiens
cgggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactact

SEQ ID NO: 72071 - DNA, 201 bp, Homo sapiens
tatttcttctgaattagtacctgtctttccaatttttcttatttctttcaatcaatttttctactttttttttttttaattttaaaaaatgtcttcttccrgtggggctcggtggctcacacctgtaatcccagcattttggaaggctaaggcgggcagatcaactgaggtcaggagtttgagaccagcctggctaacatg

SEQ ID NO: 72072 - DNA, 201 bp, Homo sapiens
ttgggaggccgaggctggcggatcacgaggtcagaagatcgaggccatcctggctaacacggtgaaaccccgtctctactaaaaatacaaaaaattagccyggcgtggtggcgggcacctgtagtcccagctacttgggaggctgaggcaggagaatggcgtgaacccaggaggcggagcttgcagtgagccgagatcgcg

SEQ ID NO: 72073 - DNA, 201 bp, Homo sapiens
ggcggatcacgaggtcagaagatcgaggccatcctggctaacacggtgaaaccccgtctctactaaaaatacaaaaaattagcccggcgtggtggcgggcrcctgtagtcccagctacttgggaggctgaggcaggagaatggcgtgaacccaggaggcggagcttgcagtgagccgagatcgcgccaccgcactccagcc

SEQ ID NO: 72074 - DNA, 201 bp, Homo sapiens
tgaggcaggagaatggcgtgaacccaggaggcggagcttgcagtgagccgagatcgcgccaccgcactccagcctgggcgacagagcaagactccgtctcaaaaaaaaaaaaaaaaatgagaaagatggtcgacatctttagtcattagaggaatgcaacaagatagccacttcacacccactaggatggctataataaga

SEQ ID NO: 72075 - DNA, 201 bp, Homo sapiens; identical to SEQ ID NO: 27878

SEQ ID NO: 72076 - DNA, 201 bp, Homo sapiens
tgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtccca

SEQ ID NO: 72077 - DNA, 201 bp, Homo sapiens
tttagtcattagaggaatgcaacaagatagccacttcacacccactaggatggctataataagaaaggcagtaactagtgtgggcaaggaagtgaagcaattggaatctgcataatttgctggtaggaatgtaaaatgagggcactgccttagaaaacattttacagtttctcaaaatgttaaacagagttaacatacgat

SEQ ID NO: 72078 - DNA, 201 bp, Homo sapiens; identical to SEQ ID NO: 27879

SEQ ID NO: 72079 - DNA, 201 bp, Homo sapiens
ctagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctct

SEQ ID NO: 72080 - DNA, 201 bp, Homo sapiens
gatttgaacctgtcatattccagatccaagtttaccacagccctttatatttgcctttgaagccattaggtttagggtgatgaaagctctaaattgagggsagattttagaggatgtttatagagatttgtaagccctgcagtcgaggtcaggaaaagggataatgagatggttcatgtgtgaagtggtgacttatgggtg

SEQ ID NO: 72081 - DNA, 201 bp, Homo sapiens
caagtagacctaactgtgtattagcactgctgcatctgctttattgactattttttaaagactttattttttacagcagttttaggttcatagtgaaattsaccaaaaagtacagacagtttttatatacctctttccccaacacattcctttattgacactttaaagcttagtttcctcctttataaaggcagtaaaatc

SEQ ID NO: 72082 - DNA, 201 bp, Homo sapiens
cactggaagccttagaaaattctccttactgtaagccccagtttactacctaataactaccacctagttatatcttctgtgcaacaaatatggtcactgcrcatgggtgcccacctgaggagggcaggggctgaaacccagcttcattctgcatgtcaaaccatgcacctgcaggactgtagaaacggctggtgccgtttt

SEQ ID NO: 72083 - DNA, 201 bp, Homo sapiens
agtagacctaactgtgtattagcactgctgcatctgctttattgactattttttaaagactttattttttacagcagttttaggttcatagtgaaattgascaaaaagtacagacagtttttatatacctctttccccaacacattcctttattgacactttaaagcttagtttcctcctttataaaggcagtaaaatcta

SEQ ID NO: 72084 - DNA, 201 bp, Homo sapiens
ctttctgtgttttaagtgaatattagtatgtttcattatcagcttctccccaggtctatctataactgtgttttatggattgcctttagtagttcacactytttttctttgtttttagtggtggggtcatgatctatattgaccgaatagaagtggttaatatgttggctccttatgcaggtatgttacccatctacctgt

SEQ ID NO: 72085 - DNA, 201 bp, Homo sapiens
aagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaa

SEQ ID NO: 72086 - DNA, 201 bp, Homo sapiens
attttaagtcaggaacgcagctgttaatgtgatagccactctccaaagtgagagagggtcattggcagttattcagacttgactcatgatactcaggagarcaataggtgaaatgtatatagggagagagaagactgttgcaccagagtattctgatgcctttgctcttgtttgctcccacacagcacaagttgaccccgg

SEQ ID NO: 72087 - DNA, 201 bp, Homo sapiens
ttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttt

SEQ ID NO: 72088 - DNA, 201 bp, Homo sapiens
tcttcaaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttg

SEQ ID NO: 72089 - DNA, 201 bp, Homo sapiens
tggaggagagaaggaacaacttagagtagaaaacaagtaggctcagatgagctgagagttatttgacagtgaaaagagtattcctcgtagagaagttgctstttggggactgggacttgaaaactgctaataggtttttaaaactttcaatgtgaaataagcagtcacaatattaagcagtggggaaagggactcttaact

SEQ ID NO: 72090 - DNA, 201 bp, Homo sapiens
taatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttt

SEQ ID NO: 72091 - DNA, 201 bp, Homo sapiens
ctcaagccaatctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttc

SEQ ID NO: 72092 - DNA, 201 bp, Homo sapiens; identical to SEQ ID NO: 27959

SEQ ID NO: 72093 - DNA, 201 bp, Homo sapiens; identical to SEQ ID NO: 27886

SEQ ID NO: 72094 - DNA, 201 bp, Homo sapiens; identical to SEQ ID NO: 27887

SEQ ID NO: 72095 - DNA, 201 bp, Homo sapiens; identical to SEQ ID NO: 27888

SEQ ID NO: 72096 - DNA, 201 bp, Homo sapiens; identical to SEQ ID NO: 27889

SEQ ID NO: 72097 - DNA, 201 bp, Homo sapiens
gtaaggctctgggtgataggaggtgggagagtgggtggaggagagaaggaacaacttagagtagaaaacaagtaggctcagatgagctgagagttatttgrcagtgaaaagagtattcctcgtagagaagttgctgtttggggactgggacttgaaaactgctaataggtttttaaaactttcaatgtgaaataagcagtc

SEQ ID NO: 72098 - DNA, 201 bp, Homo sapiens; identical to SEQ ID NO: 27890

SEQ ID NO: 72099 - DNA, 201 bp, Homo sapiens
tctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctacctt

SEQ ID NO: 72100 - DNA, 201 bp, Homo sapiens
taggctgaggcaggagaatcacttgaagccaggaggcagaggttgcagtgagctgagatcacgccactgcactccagcctgggggacagagtgagactccrtctcaaaaaaaaaaagaacagtctggtgggaaagtagaccgtaaccaaagcacttgagagacttatcaaagtgggaggaatgcagtgctaggagggtctc

SEQ ID NO: 72101 - DNA, 201 bp, Homo sapiens
tatatttaataataaactatcataagagatgtaaatgaaattagtacagagacttcagtgtaaactaaaatacttcgcatctacaaaaaagttttacatgrgctagagccagccagtgtgactaaataggaatgttctttatgtgtaaaacggtaacattctaggaaataattatattaataaaaccatatttaaaaagtg

SEQ ID NO: 72102 - DNA, 201 bp, Homo sapiens
gaatcacttgaagccaggaggcagaggttgcagtgagctgagatcacgccactgcactccagcctgggggacagagtgagactccgtctcaaaaaaaaaargaacagtctggtgggaaagtagaccgtaaccaaagcacttgagagacttatcaaagtgggaggaatgcagtgctaggagggtctcaaaaaagagggagaa

SEQ ID NO: 72103 - DNA, 201 bp, Homo sapiens
acaaatggccaataaaaacatgaaaaagggccgggcgcagtggctcaagcctgtaatcccagcactttgggaggccgaggctggcggatcacgaggtcagragatcgaggccatcctggctaacacggtgaaaccccgtctctactaaaaatacaaaaaattagcccggcgtggtggcgggcacctgtagtcccagctact

SEQ ID NO: 72104 - DNA, 201 bp, Homo sapiens
caataaaaacatgaaaaagggccgggcgcagtggctcaagcctgtaatcccagcactttgggaggccgaggctggcggatcacgaggtcagaagatcgagrccatcctggctaacacggtgaaaccccgtctctactaaaaatacaaaaaattagcccggcgtggtggcgggcacctgtagtcccagctacttgggaggct

SEQ ID NO: 72105 - DNA, 201 bp, Homo sapiens
ggcgtggtggcgggcacctgtagtcccagctacttgggaggctgaggcaggagaatggcgtgaacccaggaggcggagcttgcagtgagccgagatcgcgycaccgcactccagcctgggcgacagagcaagactccgtctcaaaaaaaaaaaaaaaaatgagaaagatggtcgacatctttagtcattagaggaatgcaa

SEQ ID NO: 72106 - DNA, 201 bp, Homo sapiens
ggataaatcagatgtggtctatccatgcaatggaatattctataaaaaaggaatgaagtactgatgcatgctacaacacgaataagccttgaaaacattasgctaagaggaagaagccaggttctagttacattaaatgttcatcatagacacatccctatggacgaaaagactggtggttgcctgaggctgggaggagag

SEQ ID NO: 72107 - DNA, 201 bp, Homo sapiens
ctgggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatact

SEQ ID NO: 72108 - DNA, 201 bp, Homo sapiens
tgggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatactt

SEQ ID NO: 72109 - DNA, 201 bp, Homo sapiens
cagaatactgcctacctggtataagaatgtttaaaacaaggtgtccactctttgctgactcctggaatttaacaaggggtgttcttctaatcctttgtggsacagggcctgtggcagaggggcaaggagggaggatggagcatcaggccactgggatccgtccctgagagcaaaagtacttctgcactgaggaggggagga

SEQ ID NO: 72110 - DNA, 201 bp, Homo sapiens; identical to SEQ ID NO: 27891

SEQ ID NO: 72111 - DNA, 201 bp, Homo sapiens
gggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatacttt

SEQ ID NO: 72112 - DNA, 201 bp, Homo sapiens
ggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatacttta

SEQ ID NO: 72113 - DNA, 201 bp, Homo sapiens
acagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcaga

SEQ ID NO: 72114 - DNA, 201 bp, Homo sapiens
ttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatctttttttttttttt

SEQ ID NO: 72115 - DNA, 201 bp, Homo sapiens
tttttaatttcttttttctagtactgtaatttgtttttgttatagtttacaatttattggttcctcataaattgaaatacacacacaaaaaggtaaggtayttttccacaggtggtttgagaagcactgctctagaatagctatctcaaagtagaattgatgggtcatagggtagcatgtcttcacattcaacatattgac

SEQ ID NO: 72116 - DNA, 201 bp, Homo sapiens
ttttctagtactgtaatttgtttttgttatagtttacaatttattggttcctcataaattgaaatacacacacaaaaaggtaaggtatttttccacaggtrgtttgagaagcactgctctagaatagctatctcaaagtagaattgatgggtcatagggtagcatgtcttcacattcaacatattgacaaattgctctctc

SEQ ID NO: 72117 - DNA, 201 bp, Homo sapiens; identical to SEQ ID NO: 4982

SEQ ID NO: 72118 - DNA, 201 bp, Homo sapiens
ttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaa

SEQ ID NO: 72119 - DNA, 201 bp, Homo sapiens
tccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgg

SEQ ID NO: 72120 - DNA, 201 bp, Homo sapiens
gaaattatatgaaaaccttcagccttcataaagtaaccatagattcactttttaaataaattttctgtcatactgggaaagtaatttttaagaggacataraagaaatataaaagtacataaagatagggtgttaaatggaagatttaacatttgaaccctttcctagttcttctgagtttgaaaattggctagagaatat

SEQ ID NO: 72121 - DNA, 201 bp, Homo sapiens
atttaaagttggtgtggaatatggaaactgaattaatgttataaaggaaataaatataatttgtctcttcatcaatccccttaacctagaactgccaccartgtttactgtcattctaatgtctcaacctaagagttattttttattctttcccctcctggaattttatatcaaccaagtatcagatacctcctctattat

SEQ ID NO: 72122 - DNA, 201 bp, Homo sapiens
tggcatgtctagtatgtacagaatattgtgtttggcaagaataatttgaaaagatgaaattacagcctttgccttcaggggttttaattttacttgagaaracataatacagagctaaaaaaggatatattgggatgtaaggtcataataaatttcacataaccggtacaggcacaaatagtgaaaagatttcagagtaga

SEQ ID NO: 72123 - DNA, 201 bp, Homo sapiens
agtttcctaatatgcaaatttaggagaattcagtgctaatttatgtaaattacctgatataaagcccagctcagttaatgttttaacaactttaaaaaatygcctttttaaaaacggtcttttgcaactgctttcttcttttatttctactgttcctcagtttgcctagtctctctttacctcttagctaaacttttgcag

SEQ ID NO: 72124 - DNA, 201 bp, Homo sapiens
caacacatgtgaaatgttgtctactagggaagctcattggagactcattgcccagggttttcactgggggctgattatgtaggcaccctctgcctaccacrtaaaaattccagactcctggaaggaatgcaggtgtttggcataagccacattgtataaacagttcacagcaagtcaattgtattagctctggggatagtg

SEQ ID NO: 72125 - DNA, 201 bp, Homo sapiens
cattgcccagggttttcactgggggctgattatgtaggcaccctctgcctaccacataaaaattccagactcctggaaggaatgcaggtgtttggcataarccacattgtataaacagttcacagcaagtcaattgtattagctctggggatagtgggacccttctacaaatccaagttcctaggtgccaaccaaggacga

SEQ ID NO: 72126 - DNA, 201 bp, Homo sapiens
aagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagaga

SEQ ID NO: 72127 - DNA, 201 bp, Homo sapiens
ctagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttct

SEQ ID NO: 72128 - DNA, 201 bp, Homo sapiens
ctgtattagacactggaagccttagaaaattctccttactgtaagccccagtttactacctaataactaccacctagttatatcttctgtgcaacaaatayggtcactgcacatgggtgcccacctgaggagggcaggggctgaaacccagcttcattctgcatgtcaaaccatgcacctgcaggactgtagaaacggctg

SEQ ID NO: 72129 - DNA, 201 bp, Homo sapiens
aagtcaattgtattagctctggggatagtgggacccttctacaaatccaagttcctaggtgccaaccaaggacgagtttacaaaaggcctttctaaggatygcagtatcagccctgctttcttaactcacttctgtacaacttacttttcatttatgatagtggaagttctgaccagggaatgagttgttgctgttggtag

SEQ ID NO: 72130 - DNA, 201 bp, Homo sapiens
tgttttattcagcaattatttgagatgctatggtgatttatagaatacctttctcaatttgactttagatctctgccaaaataaaatactcttgtagcttrctatgggtgacatttgtgaactcctagagggaactgataagctgaggctcttacaaggaagtaaaattcatatttctgccatgtatgaagcattaagata

SEQ ID NO: 72131 - DNA, 201 bp, Homo sapiens
gagtcatgaacagcattttaaataaaatggaatagaataggaaaagaaatggtatgtaataagtttaaatattctgtgacacttgtgtttcacagtgtggsggggtaggtgtttatattggacgtcagtgcaaaatgtgtttcttactgtgtccactgtcagtaacattcgaaagccactgctctggatccagatgaccta

SEQ ID NO: 72132 - DNA, 201 bp, Homo sapiens
agacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactttttttctttgtttttagtggtggggtcatgatctatattgaccgaata

SEQ ID NO: 72133 - DNA, 201 bp, Homo sapiens
ttgtttagaattccttgccttatattacttagccatttttctgttcccagttttttgctattaaacaatagtgtaatgaacattcatgacacatgttcttrtatgtacaaattatctttcaaactgactgtacaaatgtacattcttaacagcaatatgtgcaaataattgtgacccatgaactcaccaacattggaagca

SEQ ID NO: 72134 - DNA, 201 bp, Homo sapiens
cccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcat

SEQ ID NO: 72135 - DNA, 201 bp, Homo sapiens
ccaacattggaagcaatcagacatactgattgttaccatatggatgggtgggcaattatatctccctttgatttgcattcctttggttgttaatgaggttkaacatcttttgatacatttattggtcatttatactgtcttctgctgattgcctattcatatcttttgcccatttttctgttggattgttttctttcttac

SEQ ID NO: 72136 - DNA, 201 bp, Homo sapiens
acatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgatagg

SEQ ID NO: 72137 - DNA, 201 bp, Homo sapiens
agctaagctagctggatgttaaaccccaaccacagccctccaggagcatcccaacaagctgggccagcttctcatctttctcctggtctctgccctggtaygagcacttaaaatgaatttactgggccgggtgcagtggttcatgcctgtaatcccagcactttgggaggctgaggcggtcagatcatgaggtcaggagct

SEQ ID NO: 72138 - DNA, 201 bp, Homo sapiens
actgtaactggatttcagacacctaaggcaggttctgacaaactgggtgtgtctgatgcctctggcgccctatcgcaattccactccaccccacctctaaytccagctgtggccatggtagacagttccatgaggcatcaattcactttcctctgactgcatctcacctcacacatgagctgcacttactgcttttcaccc

SEQ ID NO: 72139 - DNA, 201 bp, Homo sapiens
ttgaataattaatgttaattttcttagctgtgttaatagtattacggttatgtaggaggatatcctaatcttaggagataaatggagatgtattcctgttktccgcactttattttattttattttttgacacggagtctcgctctgtcgcccaggctggagtgaagtggcgcgatctcggctcactgcaacttcctcctc

SEQ ID NO: 72140 - DNA, 201 bp, Homo sapiens
tcttagctgtgttaatagtattacggttatgtaggaggatatcctaatcttaggagataaatggagatgtattcctgttgtccgcactttattttattttwttttttgacacggagtctcgctctgtcgcccaggctggagtgaagtggcgcgatctcggctcactgcaacttcctcctcctgggttcaagcgattcccct

SEQ ID NO: 72141 - DNA, 201 bp, Homo sapiens
gagaggcttctgtccctcggcggtctccgtaagtaagtgaaccgttattggctggagggcgctgacgtctgattgttgcgcggtcgcatttttccggggarcgcggattcgcattcccaattttaggtggcagtcgcaacccatactattcggacagatggcacagaaaccgctgcgcctgtgagtgaccgtgaatggaag

SEQ ID NO: 72142 - DNA, 201 bp, Homo sapiens
ccttttcgcttctgagggggtttctcttggcgacgctcgttcggagaggcggaagctcccagagttaggcctcctccatcttagggggcagtcctggcctytgacacatcctttccccttcgtttctcctgaccccatttatttactcgccaaatagccattgggcccactgatgggccctgggcagtggtggacagagta

SEQ ID NO: 72143 - DNA, 201 bp, Homo sapiens
acggagtttcgctcttgttgtccaggctggagtgcaatggcgcgatcttgactcactgcaacccccgcctccctggttgaagcaattctccaccatgcccrgctaatttttgtatttttagaagagacggggtttcaccatgttgcccaggctggtcttgaacgcccgacctcaagtgatccgcccgcctcagccttccaa

SEQ ID NO: 72144 - DNA, 201 bp, Homo sapiens
acccgggaggcggaggttgctgtgagccgagatcgcgccactgcactccagcctgggcgacagaacgagactctcaaaacaaaacaaaacaaaacaaaacraacaaaaaacaatacaaataatggccgggcgcggtggctcacgcctgtaatcctagcactttgggaggctgaggcgggcggatcacttgcggtcaggagt

SEQ ID NO: 72145 - DNA, 201 bp, Homo sapiens
ctgtaatcctagcactttgggaggctgaggcgggcggatcacttgcggtcaggagttcgagaccagcctggccaacgtggtgacaccccgtctctactaayacaaaaaaaaaaaattagccaggcgtggtggcgcgtgcctgtaatcccagctacttgggaggctgaggcaggagaatcgcttgaacccggaggcggaggt

SEQ ID NO: 72146 - DNA, 201 bp, Homo sapiens
gtacgtcaagttactgtactgaatactgtaggcaattgtaacacaatggtaagcatttttgtatttaaatatagaaagggtacagtgaaaacacctggccrggtgtggtggcttatgcctgtaatcccaacactttgggaggccgaggtgggtggatcacctgaggtcagaagttcaagaccagcctggccaacatggtga

SEQ ID NO: 72147 - DNA, 201 bp, Homo sapiens
cgttattggctggagggcgctgacgtctgattgttgcgcggtcgcatttttccggggaacgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacac

SEQ ID NO: 72148 - DNA, 201 bp, Homo sapiens
acaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatag

SEQ ID NO: 72149 - DNA, 201 bp, Homo sapiens
ctgagccacctgtttggcttccactgcttctgtgaactccttcccgaaggtcagatgtgtcaaggacacgtcatccaggatgagcccaaaggtggctgctygctctgtaaggtcgttgctcatctgcctggagaccagctctctttaggtgattagttctccagcatcaaagtgagccaccactgacttgaggatctcagt

SEQ ID NO: 72150 - DNA, 201 bp, Homo sapiens
cacctgtttggcttccactgcttctgtgaactccttcccgaaggtcagatgtgtcaaggacacgtcatccaggatgagcccaaaggtggctgcttgctctrtaaggtcgttgctcatctgcctggagaccagctctctttaggtgattagttctccagcatcaaagtgagccaccactgacttgaggatctcagtagtgat

SEQ ID NO: 72151 - DNA, 201 bp, Homo sapiens
ttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtag

SEQ ID NO: 72152 - DNA, 201 bp, Homo sapiens
ctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatct

SEQ ID NO: 72153 - DNA, 201 bp, Homo sapiens
cccctaatgtcattatgttctttttctctaaagtatctttacgcgttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcattt

SEQ ID NO: 72154 - DNA, 201 bp, Homo sapiens
tatagtttagtacataagacaagtttaatcgttagaatctaaatcttttttttccccttgggaaatcatgatgatgtttagaaaatcttagtagatttcarctaagcttagtgttttttattgtagtttggggttaacagtttgatacattaggtctttctttgtccaaactggattcagacgtttggggttacagtttta

SEQ ID NO: 72155 - DNA, 201 bp, Homo sapiens
tgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacat

SEQ ID NO: 72156 - DNA, 201 bp, Homo sapiens
gcatggactatttacttttaatataagtattttttctatagagaggcatatcttaagttctaaagcagatctggtaactatatggtgtcatgtctgtttcyctcactagctcctattcagacatatgtgcttggtgctaataaccaggaaacagtaaaatatttccaggatgctgatggatgtgaattagctgaaaacatt

SEQ ID NO: 72157 - DNA, 201 bp, Homo sapiens
ctgatacttgttgtattttttttttgttttttgttttttgtttttgagacggagtcttgctctgtcacccaggctggagtgcagtggcgcaatcttggctyactgtaacctccacctcccgggttcaagtgattctcctgcctcagcctcctgagtagcttggattacaggcgtgtgtgaccatacccggctaattttttt

SEQ ID NO: 72158 - DNA, 201 bp, Homo sapiens
ctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagt

SEQ ID NO: 72159 - DNA, 201 bp, Homo sapiens
tcccataatgatgaaaaatagagctgagaagaggatcaaattattaaggaagaaatacaatcagaagggaagcaggttgatgatagtaccttggtgggtgrggatggtatatcttcatctagggggtaggaacaaagacataaaagtgcttagaggactgtttgagaggtaaagatattgtcaacttcatggaatctactg

SEQ ID NO: 72160 - DNA, 201 bp, Homo sapiens; identical to SEQ ID NO: 27867

SEQ ID NO: 72161 - DNA, 201 bp, Homo sapiens
ggaatctactgaagataacatagtttcaggagaacattggcaaatatagggtgacctttaagagagtgatgggagagggaaactgattgcagggggttaargaactaataaagtaggctgggcgtggtggctcacacctgtaatcctagcaccttgggaggtcgaggtgggcagttcacgaggtcaagaggttgagaccat

SEQ ID NO: 72162 - DNA, 201 bp, Homo sapiens; identical to SEQ ID NO: 27870

SEQ ID NO: 72163 - DNA, 201 bp, Homo sapiens
actccagcctggcaacagagcgagactccatctcaaaaaaaaaaaaaaaaaaaaaaaaaggtaaagcacttagcatggatgactcttcagaaattcaaaaytgaagaggaggaagtttcttagtatgtgtgttcattttggatggcgatgattgagcatatttttttctgaacaaaaagcgccagctgagtagactcagta

SEQ ID NO: 72164 - DNA, 201 bp, Homo sapiens
ggctgggtgtggtggctcacgcctgtaatcccagcactttgggaggccgaggcaggcagatcatgaggtcaggagatcgagaccatcctggccaacacggkgaaaccctgtctctactaaaaatacaaaaaattagctgggcatggtggcgggcgcctgtagtcccagctacttggaaggctaaggcaggagaatggcatg

SEQ ID NO: 72165 - DNA, 201 bp, Homo sapiens
tcaggagatcgagaccatcctggccaacacggtgaaaccctgtctctactaaaaatacaaaaaattagctgggcatggtggcgggcgcctgtagtcccagytacttggaaggctaaggcaggagaatggcatgaacccgggaggtggagcttgcagtgagcagagatcgcgccactgcactccagcctgggcaacagagtg

SEQ ID NO: 72166 - DNA, 201 bp, Homo sapiens
aggtatggtaatgaaaggtcaagtctctttgggtctttttgtaggagagtttaaagaagggtttgggaaaataggcccagaggaataaaggcaaaatatcraatgaacagtgttcctttacttccacatctatgtggttgtctctatgggtatttgtgaatttgccctcagatgcttgcttacttctttagcaacttcatt

SEQ ID NO: 72167 - DNA, 201 bp, Homo sapiens
gagaccagcctggccaacatggtgaaaccccatctctataaaaaataaaaaaaattagccaggtgtggtggggggcacctgtaatcccagctactcaggargctgaggcaggagaattgcttgaatgtgggaggtggagactgcagtgagctgagatcgggccactgcactccagcctgggtgacaaagtgagactctgtc

SEQ ID NO: 72168 - DNA, 201 bp, Homo sapiens
ttagtgaagtgggaaaataggcagataaagagtctgaagattattccactatcacatgccatagacaatgcatacaaaagataagcaaatcgatattttgwttttttcataatatttcaagctttttttgggggagggggcggatctgaagtgattttgcctttatttccttcactttaagccaatcatgaaatttcatag

SEQ ID NO: 72169 - DNA, 201 bp, Homo sapiens; identical to SEQ ID NO: 27876

SEQ ID NO: 72170 - DNA, 201 bp, Homo sapiens
tttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctg

SEQ ID NO: 72171 - DNA, 201 bp, Homo sapiens
tctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggt

SEQ ID NO: 72172 - DNA, 201 bp, Homo sapiens; identical to SEQ ID NO: 27881

SEQ ID NO: 72173 - DNA, 201 bp, Homo sapiens
aatgtgtgtgtctcatgggaaagtcattctatttcacatttccccagatacttttgcttgggtagggctggattagacattaaataataccagtgtttgastctgatttccctgggttttctgtagaccattgttctttttcattcatttagaatgaagaaaacttaatttttaacactatagtcaccagtgactagaatt

SEQ ID NO: 72174 - DNA, 201 bp, Homo sapiens
atggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacact

SEQ ID NO: 72175 - DNA, 201 bp, Homo sapiens
ttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctt

SEQ ID NO: 72176 - DNA, 201 bp, Homo sapiens
aactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaa

SEQ ID NO: 72177 - DNA, 201 bp, Homo sapiens; identical to SEQ ID NO: 27882

SEQ ID NO: 72178 - DNA, 201 bp, Homo sapiens
tcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcat

SEQ ID NO: 72179 - DNA, 201 bp, Homo sapiens; identical to SEQ ID NO: 27883

SEQ ID NO: 72180 - DNA, 201 bp, Homo sapiens
cttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactgg

SEQ ID NO: 72181 - DNA, 201 bp, Homo sapiens
agatttgtaatttttcttttaattgccctttcaaactgaataacacttagtattttcagtctgttttattctcagggacatgttagcctcagccataagcracttatactttcgtcaaaaggtgtgcacattataaaatttggcaagcattgttaaattcatctaaaaactttgttccaatttatacccctaccccagcag

SEQ ID NO: 72182 - DNA, 201 bp, Homo sapiens
tggccttggccaggtgtggtgactgcaccatcttatattcccactggcaatgtatgaaggtttctgcttttccacatccctgtcaacatttgttatagcartagccagttttacaagatagctccctcttttcctgtctcataaataggtatggttctctaggggtgatgcttttatatacttcttggactctgtattttt

SEQ ID NO: 72183 - DNA, 201 bp, Homo sapiens
cctaagcttcccaagtagctgggattacaggcacctgccatcacatctggctaatttttatatttttagtagagacagggtttcaccctgctggccaggcyggtctcaaactcccgacctcaggtgatctgcccgcctcagcctcccaaagtgctgggattacaggcgtgagccaccacccccggcctatgaatttttatc

SEQ ID NO: 72184 - DNA, 201 bp, Homo sapiens
tagctgggattacaggcacctgccatcacatctggctaatttttatatttttagtagagacagggtttcaccctgctggccaggctggtctcaaactcccracctcaggtgatctgcccgcctcagcctcccaaagtgctgggattacaggcgtgagccaccacccccggcctatgaatttttatctggaattatgtaatg

SEQ ID NO: 72185 - DNA, 201 bp, Homo sapiens
gtcattctatttcacatttccccagatacttttgcttgggtagggctggattagacattaaataataccagtgtttgactctgatttccctgggttttctrtagaccattgttctttttcattcatttagaatgaagaaaacttaatttttaacactatagtcaccagtgactagaattggatgttccccaagattcctga

SEQ ID NO: 72186 - DNA, 201 bp, Homo sapiens
gcttgggtagggctggattagacattaaataataccagtgtttgactctgatttccctgggttttctgtagaccattgttctttttcattcatttagaatraagaaaacttaatttttaacactatagtcaccagtgactagaattggatgttccccaagattcctgaggaaaatatttataagtcatttttgttttgtga

SEQ ID NO: 72187 - DNA, 201 bp, Homo sapiens
gtcaggagttcaagaccagcctggccaagaaggtgaaaccctgtctctactgaaaatacaaaaattagctgggcgtggtggcgggcgcctgcaatcccagytactcaggaggctgaggcagagaattgcttgaacctgggaggtggaggttgcaggccaagatcgcgccactgcactccagcctgggggacagagcaagac

SEQ ID NO: 72188 - DNA, 201 bp, Homo sapiens
gacgactcaggcttctagagtaaccttttaaacaaatacaatataaagtggttattatacaaataaaaaaaagtttttagtgcctgtgaggttttcatcarctttagtcatctggaaaattaactttgtcaatatgctcagtcctctctgccaaacaaatcaaggacaatcatgctttagtatctttccaatacatatcct

SEQ ID NO: 72189 - DNA, 201 bp, Homo sapiens
aacttctgacctcaggcggtccacctgcctcggcctctcaaagttttgggattacaagcgtgagccactatcccagccgaaagtggtcattttgaaatcaraagttgtatctttttgtggttgagggtgataaaaactgaaaaactgttttcaagtttggagcatgggagggaaaacccagcgatttgttctggtctccct

SEQ ID NO: 72190 - DNA, 201 bp, Homo sapiens
gttcaagaccagcctgggcaacacggtgaaaccctgtctctactaaaagtacaaaaaaattagctgggcgtggtggtgcatgcctgtaatcccagctactygggaggctgagacaggagaatagcttgaacctgggaggcagaggttgcagtgagccgagattgtgccactgcactccagcctgggcaacagagcgagact

SEQ ID NO: 72191 - DNA, 201 bp, Homo sapiens
aggtttcaccatattggtcagcctagtctggaacttctgacctcaggcggtccacctgcctcggcctctcaaagttttgggattacaagcgtgagccactrtcccagccgaaagtggtcattttgaaatcagaagttgtatctttttgtggttgagggtgataaaaactgaaaaactgttttcaagtttggagcatgggag

SEQ ID NO: 72192 - DNA, 201 bp, Homo sapiens
gttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatg

SEQ ID NO: 72193 - DNA, 201 bp, Homo sapiens
ccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgccttggcctcccgaaggtattacaggcatgagccaccca

SEQ ID NO: 72194 - DNA, 201 bp, Homo sapiens
gctactcaggaggctgagagtcaggaggatcacttaagcctaggagtttgaggatgcagtgaggtatgattgcaccactgtacttcagcctgggcaacatygcaagaccctgtctctaaaaaaaaaaaaaaaaaaaagaggcagtggacaatttggaactagagcactgggtattgactagactggagatgaacagggcat

SEQ ID NO: 72195 - DNA, 201 bp, Homo sapiens
tgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttct

SEQ ID NO: 72196 - DNA, 201 bp, Homo sapiens; identical to SEQ ID NO: 27892

SEQ ID NO: 72197 - DNA, 201 bp, Homo sapiens; identical to SEQ ID NO: 27893

SEQ ID NO: 72198 - DNA, 201 bp, Homo sapiens; identical to SEQ ID NO: 27894

SEQ ID NO: 72199 - DNA, 201 bp, Homo sapiens; identical to SEQ ID NO: 27895

SEQ ID NO: 72200 - DNA, 201 bp, Homo sapiens; identical to SEQ ID NO: 27896

SEQ ID NO: 72201 - DNA, 201 bp, Homo sapiens; identical to SEQ ID NO: 27897

SEQ ID NO: 72202 - DNA, 201 bp, Homo sapiens; identical to SEQ ID NO: 27899

SEQ ID NO: 72203 - DNA, 201 bp, Homo sapiens
cctttccctcttgattcttccttgaggcgcaaacacctgagagaggcttctgtccctcggcggtctccgtaagtaagtgaaccgttattggctggagggcrctgacgtctgattgttgcgcggtcgcatttttccggggaacgcggattcgcattcccaattttaggtggcagtcgcaacccatactattcggacagatgg

SEQ ID NO: 72204 - DNA, 201 bp, Homo sapiens
ctactaaaagtacaaaaaaattagctgggcgtggtggtgcatgcctgtaatcccagctactcgggaggctgagacaggagaatagcttgaacctgggaggyagaggttgcagtgagccgagattgtgccactgcactccagcctgggcaacagagcgagactccatctttaaaaaaaaaattatataaagtttagctttaa

SEQ ID NO: 72205 - DNA, 201 bp, Homo sapiens
tttaggatgggtagggtggaactaccctagggaatgacagaggcagagagtaatcaaattgccagttcagttaagaaaacttggagaaagtactagaaagrtgacaggtcagggcctgtggaaagctgtggttctataggcagtggggaacctcttaatgttttgaggaaagaacattaaactgactactttctgtaggat

SEQ ID NO: 72206 - DNA, 201 bp, Homo sapiens
cacttgaagccaggagtttgataccagcctgggcaacaaagtgagacaccttgtctctacaaaaaataaaaaaataagcttggcatggtggcatgtgcctrtagtcttagctactcaggaggctgagagtcaggaggatcacttaagcctaggagtttgaggatgcagtgaggtatgattgcaccactgtacttcagcctg

SEQ ID NO: 72207 - DNA, 201 bp, Homo sapiens
tctttgctatcagtgatgactggcacattacatggtcaagaacagcagtcaaagataataggtttgtgtacccatggaatgagaaagtgagtcccttcccstaccacagtgttctgtactccatggaatcggtcaaagatgacagctctttgctcagcatccacattatatagggcagagttcaccacgtctcctgcaaca

SEQ ID NO: 72208 - DNA, 201 bp, Homo sapiens; identical to SEQ ID NO: 27900

SEQ ID NO: 72209 - DNA, 201 bp, Homo sapiens; identical to SEQ ID NO: 27901

SEQ ID NO: 72210 - DNA, 201 bp, Homo sapiens; identical to SEQ ID NO: 27902

SEQ ID NO: 72211 - DNA, 201 bp, Homo sapiens; identical to SEQ ID NO: 27903

SEQ ID NO: 72212 - DNA, 201 bp, Homo sapiens; identical to SEQ ID NO: 27904

SEQ ID NO: 72213 - DNA, 201 bp, Homo sapiens; identical to SEQ ID NO: 27905

SEQ ID NO: 72214 - DNA, 201 bp, Homo sapiens
cactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgac

SEQ ID NO: 72215 - DNA, 201 bp, Homo sapiens; identical to SEQ ID NO: 27915

SEQ ID NO: 72216 - DNA, 201 bp, Homo sapiens
agttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcct

SEQ ID NO: 72217 - DNA, 201 bp, Homo sapiens; identical to SEQ ID NO: 27917

SEQ ID NO: 72218 - DNA, 201 bp, Homo sapiens; identical to SEQ ID NO: 27918

SEQ ID NO: 72219 - DNA, 201 bp, Homo sapiens
tttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataact

SEQ ID NO: 72220 - DNA, 201 bp, Homo sapiens
ctgtgcctggcctgtagttcttctttaatcttatgttttattaattttgaattatttagatgcccttgatgagtcttcctttccccgcagtcgtcaggaactctctcttgtttccatttccttacacacttgtttcctaccacttggcctgaacccttcaaaaaagtcaatattacaaaaactaaaaccaaataggtagga

SEQ ID NO: 72221 - DNA, 201 bp, Homo sapiens
tgtgcctggcctgtagttcttctttaatcttatgttttattaattttgaattatttagatgcccttgatgagtcttcctttccccgcagtcgtcaggaactctctcttgtttccatttccttacacacttgtttcctaccacttggcctgaacccttcaaaaaagtcaatattacaaaaactaaaaccaaataggtaggag

SEQ ID NO: 72222 - DNA, 201 bp, Homo sapiens
gtggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgagg

SEQ ID NO: 72223 - DNA, 201 bp, Homo sapiens
tggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggc

SEQ ID NO: 72224 - DNA, 201 bp, Homo sapiens
ggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcg

SEQ ID NO: 72225 - DNA, 201 bp, Homo sapiens
ttagtcgagacggggtttcaccatattggccaggctggtctcgaactcctgaccttgtgatctgcctgccttggcctcccgaaggtattacaggcatgagycacccacgcctggcaagatctggtttttgacatgttgagcctaaggtttttgacatgttgagctatcaaggcattccaaaaatgttattaaataggcaat

SEQ ID NO: 72226 - DNA, 201 bp, Homo sapiens; identical to SEQ ID NO: 27938

SEQ ID NO: 72227 - DNA, 201 bp, Homo sapiens
gtctattttgatcttttgctccccccgctttgtttttttaagagatgagttctcattatgttgcccatgctggaatcaaactgggctcaaacagtcctccygggactgggcatagtggctgaggcctgtaatcccagcactttgggaggctgagtaggtggaccatctgaggtcaggagttcaaggccagcctggccaaca

SEQ ID NO: 72228 - DNA, 201 bp, Homo sapiens
tactgatttttgtatgttgatttggtatcctgaaacttttactgaattcgtttattatttctaacagtctttttcgtggagtcttttgatttttcaatacgatgagtttttatgtcttacttttgtatcctcttctgggaattattacctgctcatgtttggcaaacttctactcttcttcaagattcagtcttgagtgct

SEQ ID NO: 72229 - DNA, 201 bp, Homo sapiens
ctgcactccagcctgggcgacagaacgagactctcaaaacaaaacaaaacaaaacaaaacaaacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctcta

SEQ ID NO: 72230 - DNA, 201 bp, Homo sapiens
gctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcgg

SEQ ID NO: 72231 - DNA, 201 bp, Homo sapiens
ctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctcacgcctgtaatcctagcactttgggaggctgaggcggg

SEQ ID NO: 72232 - DNA, 201 bp, Homo sapiens
gcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttc

SEQ ID NO: 72233 - DNA, 201 bp, Homo sapiens
gggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggt

SEQ ID NO: 72234 - DNA, 201 bp, Homo sapiens
taatcctagcactttgggaggctgaggcgggcggatcacttgcggtcaggagttcgagaccagcctggccaacgtggtgacaccccgtctctactaatacaaaaaaaaaaaattagccaggcgtggtggcgcgtgcctgtaatcccagctacttgggaggctgaggcaggagaatcgcttgaacccggaggcggaggttgc

SEQ ID NO: 72235 - DNA, 201 bp, Homo sapiens
tgtacgtcaagttactgtactgaatactgtaggcaattgtaacacaatggtaagcatttttgtatttaaatatagaaagggtacagtgaaaacacctggcygggtgtggtggcttatgcctgtaatcccaacactttgggaggccgaggtgggtggatcacctgaggtcagaagttcaagaccagcctggccaacatggtg

SEQ ID NO: 72236 - DNA, 201 bp, Homo sapiens
gaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgatagga

SEQ ID NO: 72237 - DNA, 201 bp, Homo sapiens
aagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggag

SEQ ID NO: 72238 - DNA, 201 bp, Homo sapiens
ttcagtagtaataacatgcatgaagctgtcatctcctatgataacagtgccctctggaatacttcctgaaggacctgcctgaggcttttttacagtcaactttttttttttttttttgaatacgtaggagtgtactctaaacagtaaagagcataccatactgaatatatttttttttttttgagatggagtcttgctctg

SEQ ID NO: 72239 - DNA, 201 bp, Homo sapiens; identical to SEQ ID NO: 27956

SEQ ID NO: 72240 - DNA, 201 bp, Homo sapiens
tctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaac

SEQ ID NO: 72241 - DNA, 201 bp, Homo sapiens
tctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccgcgatct

SEQ ID NO: 72242 - DNA, 201 bp, Homo sapiens
aggacctgcctgaggcttttttacagtcaactttttttttttttttttgaatacgtaggagtgtactctaaacagtaaagagcataccatactgaatatatttttttttttttgagatggagtcttgctctgttgcccaggctggagtgcagtgccgcgatctcagctcactgcaagctctgcctcgtgggttcatgctat

SEQ ID NO: 72243 - DNA, 201 bp, Homo sapiens
gggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacatt

SEQ ID NO: 72244 - DNA, 201 bp, Homo sapiens
tggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtc

SEQ ID NO: 72245 - DNA, 201 bp, Homo sapiens
atttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatac

SEQ ID NO: 72246 - DNA, 201 bp, Homo sapiens; identical to SEQ ID NO: 27957

SEQ ID NO: 72247 - DNA, 201 bp, Homo sapiens; identical to SEQ ID NO: 27960

SEQ ID NO: 72248 - DNA, 201 bp, Homo sapiens
ggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccag

SEQ ID NO: 72249 - DNA, 201 bp, Homo sapiens
aggagtgtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccg

SEQ ID NO: 72250 - DNA, 201 bp, Homo sapiens
acatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaat

SEQ ID NO: 72251 - DNA, 201 bp, Homo sapiens; identical to SEQ ID NO: 27967

SEQ ID NO: 72252 - DNA, 201 bp, Homo sapiens
catttttatatgtgttcttttcctagttatagtttagtacataagacaagtttaatcgttagaatctaaatcttttttttccccttgggaaatcatgatgrtgtttagaaaatcttagtagatttcagctaagcttagtgttttttattgtagtttggggttaacagtttgatacattaggtctttctttgtccaaactgg

SEQ ID NO: 72253 - DNA, 201 bp, Homo sapiens
ggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcc

SEQ ID NO: 72254 - DNA, 201 bp, Homo sapiens
tttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctccggatgtcactgaaaacccttacagaaaatctgggcaggaagcat

SEQ ID NO: 72255 - DNA, 201 bp, Homo sapiens
gtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtcca

SEQ ID NO: 72256 - DNA, 201 bp, Homo sapiens; identical to SEQ ID NO: 27968

SEQ ID NO: 72257 - DNA, 201 bp, Homo sapiens
ggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagattgcaccactgcactt

SEQ ID NO: 72258 - DNA, 201 bp, Homo sapiens
aggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccaca

SEQ ID NO: 72259 - DNA, 201 bp, Homo sapiens; identical to SEQ ID NO: 27969

SEQ ID NO: 72260 - DNA, 201 bp, Homo sapiens
gcagggcatggtggcgcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaaaaaaataaaataaataaaatagccaagctacaaggttgggtgtagta

SEQ ID NO: 72261 - DNA, 201 bp, Homo sapiens
ataatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtgg

SEQ ID NO: 72262 - DNA, 201 bp, Homo sapiens
cacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgag

SEQ ID NO: 72263 - DNA, 201 bp, Homo sapiens
taatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggc

SEQ ID NO: 72264 - DNA, 201 bp, Homo sapiens
tttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatgg

SEQ ID NO: 72265 - DNA, 201 bp, Homo sapiens
aatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggca

SEQ ID NO: 72266 - DNA, 201 bp, Homo sapiens
atagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaa

SEQ ID NO: 72267 - DNA, 201 bp, Homo sapiens
atgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctctgtcacctggctggagtgcagtggcat

SEQ ID NO: 72268 - DNA, 201 bp, Homo sapiens
gggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaa

SEQ ID NO: 72269 - DNA, 201 bp, Homo sapiens; identical to SEQ ID NO: 27971

SEQ ID NO: 72270 - DNA, 201 bp, Homo sapiens
taaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggagg

SEQ ID NO: 72271 - DNA, 201 bp, Homo sapiens
ccaggcgtggtggcagacgcccgtagtcccagctacttaggaggctgaggcaggagaatggcatgaacctgggaggcggagcttgcagtgagccgagatcrcgccactgtactccaccctaggcgacagagcgagactccgtctcaaaaaaaataaaataagaatggcctgacttcgaggctgttctgaggcgcttcctgt

SEQ ID NO: 72272 - DNA, 201 bp, Homo sapiens
ccgtagtcccagctacttaggaggctgaggcaggagaatggcatgaacctgggaggcggagcttgcagtgagccgagatcgcgccactgtactccaccctrggcgacagagcgagactccgtctcaaaaaaaataaaataagaatggcctgacttcgaggctgttctgaggcgcttcctgtactatggaaaaagcaccttt

SEQ ID NO: 72273 - DNA, 201 bp, Homo sapiens
cccttttccttttccgtgcatgtattgatctattttttttttttttttgagatgaagtcttgctctgtcgcctgggctggagtgcagtggtgcgatcttarctcactgcaacctctgtttcctgggttcaagcgattctcctgcctcagcctcccgagtagttgagatttacaggtgcccaccaccatgccaggctaattt

SEQ ID NO: 72274 - DNA, 201 bp, Homo sapiens
aaaaattagccaggcatggtggtgagcacctgtaatcccagctacttgggaggctgaggcaggagaatcacctggaccccagaggtggaagttgcagtgarctgagactgtgccactgcactccaacctgggtgacagagtgagactccatctccccaccccctccccctcccccaaaaaaaccctcctgcttcagcctcc

SEQ ID NO: 72275 - DNA, 201 bp, Homo sapiens
ctgaggcaggagaatcacctggaccccagaggtggaagttgcagtgagctgagactgtgccactgcactccaacctgggtgacagagtgagactccatctycccaccccctccccctcccccaaaaaaaccctcctgcttcagcctcctgagtagctgggactacaggcaagcaccaccacatatggctttgcccattttt

SEQ ID NO: 72276 - DNA, 201 bp, Homo sapiens
gaatcacctggaccccagaggtggaagttgcagtgagctgagactgtgccactgcactccaacctgggtgacagagtgagactccatctccccaccccctycccctcccccaaaaaaaccctcctgcttcagcctcctgagtagctgggactacaggcaagcaccaccacatatggctttgcccatttttagacaggattt

SEQ ID NO: 72277 - DNA, 201 bp, Homo sapiens
cctggaccccagaggtggaagttgcagtgagctgagactgtgccactgcactccaacctgggtgacagagtgagactccatctccccaccccctccccctyccccaaaaaaaccctcctgcttcagcctcctgagtagctgggactacaggcaagcaccaccacatatggctttgcccatttttagacaggattttttgtg

SEQ ID NO: 72278 - DNA, 201 bp, Homo sapiens
ctggaccccagaggtggaagttgcagtgagctgagactgtgccactgcactccaacctgggtgacagagtgagactccatctccccaccccctccccctcycccaaaaaaaccctcctgcttcagcctcctgagtagctgggactacaggcaagcaccaccacatatggctttgcccatttttagacaggattttttgtgg

SEQ ID NO: 72279 - DNA, 201 bp, Homo sapiens
aagccccaaatataaaatcagtttgtagggaaatatggagaactttaaatatggatgtatattaggtaatattattgaataattaatgttaattttcttarctgtgttaatagtattacggttatgtaggaggatatcctaatcttaggagataaatggagatgtattcctgttgtccgcactttattttattttattttt

SEQ ID NO: 72280 - DNA, 201 bp, Homo sapiens
ccccaaatataaaatcagtttgtagggaaatatggagaactttaaatatggatgtatattaggtaatattattgaataattaatgttaattttcttagctstgttaatagtattacggttatgtaggaggatatcctaatcttaggagataaatggagatgtattcctgttgtccgcactttattttattttattttttga

SEQ ID NO: 72281 - DNA, 201 bp, Homo sapiens
gtttgtagggaaatatggagaactttaaatatggatgtatattaggtaatattattgaataattaatgttaattttcttagctgtgttaatagtattacgsttatgtaggaggatatcctaatcttaggagataaatggagatgtattcctgttgtccgcactttattttattttattttttgacacggagtctcgctctg

SEQ ID NO: 72282 - DNA, 201 bp, Homo sapiens
ctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcgtgatctcagttcactgcaacctctgcctcccgggttcaa

SEQ ID NO: 72283 - DNA, 201 bp, Homo sapiens
gactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagt

SEQ ID NO: 72284 - DNA, 201 bp, Homo sapiens
cttagctactcaggaggctgagagtcaggaggatcacttaagcctaggagtttgaggatgcagtgaggtatgattgcaccactgtacttcagcctgggcarcatcgcaagaccctgtctctaaaaaaaaaaaaaaaaaaaagaggcagtggacaatttggaactagagcactgggtattgactagactggagatgaacagg

SEQ ID NO: 72285 - DNA, 201 bp, Homo sapiens; identical to SEQ ID NO: 27981

SEQ ID NO: 72286 - DNA, 201 bp, Homo sapiens
attttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaa

SEQ ID NO: 72287 - DNA, 201 bp, Homo sapiens
ttcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgct

SEQ ID NO: 72288 - DNA, 201 bp, Homo sapiens
agctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatcct

SEQ ID NO: 72289 - DNA, 201 bp, Homo sapiens
gtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatctt

SEQ ID NO: 72290 - DNA, 201 bp, Homo sapiens
gtttttactgaatttaattttacctttgtagtcacacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaat

SEQ ID NO: 72291 - DNA, 201 bp, Homo sapiens
acaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgca

SEQ ID NO: 72292 - DNA, 201 bp, Homo sapiens
tgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgagttcccttcatgagcataggaacttagtagctgct

SEQ ID NO: 72293 - DNA, 201 bp, Homo sapiens
aattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgc

SEQ ID NO: 72294 - DNA, 201 bp, Homo sapiens
atgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagc

SEQ ID NO: 72295 - DNA, 201 bp, Homo sapiens
tgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttga

SEQ ID NO: 72296 - DNA, 201 bp, Homo sapiens
gctctgtcgcccaggctggagtgcaatggcatgatctcggctcactgcaacctccgtctcccaggttcatgccattctcctgcctcagcctcctgagtagytgggactacaggcgaccgccaccacacctggctaattctttgtatttttagtagagacagggtttcaccgtgttagccaggatggtctcgatctcctgat

SEQ ID NO: 72297 - DNA, 201 bp, Homo sapiens; identical to SEQ ID NO: 27990

SEQ ID NO: 72298 - DNA, 201 bp, Homo sapiens
cactgcaacctccgtctcccaggttcatgccattctcctgcctcagcctcctgagtagctgggactacaggcgaccgccaccacacctggctaattctttrtatttttagtagagacagggtttcaccgtgttagccaggatggtctcgatctcctgatatagaggtcaagttcttaaagaatatactgccaagaaaacca

SEQ ID NO: 72299 - DNA, 201 bp, Homo sapiens
cctggctactttttgtatttttagtcgagacggggtttcaccatattggccaggctggtctcgaactcctgaccttgtgatctgcctgccttggcctcccraaggtattacaggcatgagccacccacgcctggcaagatctggtttttgacatgttgagcctaaggtttttgacatgttgagctatcaaggcattccaaa

SEQ ID NO: 72300 - DNA, 201 bp, Homo sapiens
gccaccatacctggctactttttgtatttttagtcgagacggggtttcaccatattggccaggctggtctcgaactcctgaccttgtgatctgcctgcctyggcctcccgaaggtattacaggcatgagccacccacgcctggcaagatctggtttttgacatgttgagcctaaggtttttgacatgttgagctatcaagg

SEQ ID NO: 72301 - DNA, 201 bp, Homo sapiens
cattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggaga

SEQ ID NO: 72302 - DNA, 201 bp, Homo sapiens
tgtatttttagtcgagacggggtttcaccatattggccaggctggtctcgaactcctgaccttgtgatctgcctgccttggcctcccgaaggtattacagkcatgagccacccacgcctggcaagatctggtttttgacatgttgagcctaaggtttttgacatgttgagctatcaaggcattccaaaaatgttattaaat

SEQ ID NO: 72303 - DNA, 201 bp, Homo sapiens
ccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgaca

SEQ ID NO: 72304 - DNA, 201 bp, Homo sapiens
gagaattgcttgaacctgggaggcggagattgcagtgagccgagattgcaccactgcacttcaccctgggcgacagagcaaggctctgtctcaaaaaaaawaaaataaaataaataaaatagccaagctacaaggttgggtgtagtatatccttagtggatagctgttccacatttaggattgctaaatatggggaatgtg

SEQ ID NO: 72305 - DNA, 201 bp, Homo sapiens; identical to SEQ ID NO: 28001

SEQ ID NO: 72306 - DNA, 201 bp, Homo sapiens
gatgtatattaggtaatattattgaataattaatgttaattttcttagctgtgttaatagtattacggttatgtaggaggatatcctaatcttaggagatraatggagatgtattcctgttgtccgcactttattttattttattttttgacacggagtctcgctctgtcgcccaggctggagtgaagtggcgcgatctcg

SEQ ID NO: 72307 - DNA, 201 bp, Homo sapiens; identical to SEQ ID NO: 28002

SEQ ID NO: 72308 - DNA, 201 bp, Homo sapiens
tattgaataattaatgttaattttcttagctgtgttaatagtattacggttatgtaggaggatatcctaatcttaggagataaatggagatgtattcctgwtgtccgcactttattttattttattttttgacacggagtctcgctctgtcgcccaggctggagtgaagtggcgcgatctcggctcactgcaacttcctcc

SEQ ID NO: 72309 - DNA, 201 bp, Homo sapiens
tcttgaccagaggccagcaaactacaacccacaagctaaatccagtctaccacctgtttttctaaataaagttttattgtcacacaaccatgcccattggyttatagattatctatgtgctttcactaatgcatgatagcttagtagttgtgataggtaccttgtaggccacaaagcagaaaatatttatcatgtgaacct

SEQ ID NO: 72310 - DNA, 201 bp, Homo sapiens
ggctactgccaagtttttgaagagaatcaacagcagagtcttagctcaaatcatatccacatcagtactacggattaaatgtttgcgtcctcgcaaaattsgtatgttgaatttttttttttttttttttttttttgagacagtcttgctctgtcacccaggctggagtgcagtggtgtgatctcagctcactgcaacctc

SEQ ID NO: 72311 - DNA, 201 bp, Homo sapiens
gttggtattggtttttcccacatgaaaagcatttctctttgcttccaaatgtctatgtgatcatagataggtagaatcaggtcttaaggtaaataataataatcatgataattggtctttccctgtgttagcaagcttgggtattcagaaacaagcagaggcaaaatctaatagcccactacaaaaaggaagtccaaatgg

SEQ ID NO: 72312 - DNA, 201 bp, Homo sapiens
aatgaacaaatgataagttacttaaaatctgctttttcttaggaggagaaagaactaacagagatgcagaagtcctcttctactcgggctggggatatgcrtgagaaagacacgcgtggatgccgtatgagctctcgttctgaatgcggaaatctgacctcccaccggatactcagttcagggggctcctggaccctccag

SEQ ID NO: 72313 - DNA, 201 bp, Homo sapiens
catttatttaagctggcattctcatttttcttattggcatggctcagaagagtcctcctctggcatttgtgggcaaagtcaaacaagaggcttcttttgcrctccttgtgaaatcattccaaatgtggagtcatttggaactgcaggggcttcttacttccagtccaaagggtgaacattgtcccttttgccttgctcata

SEQ ID NO: 72314 - DNA, 201 bp, Homo sapiens
taatcaccaatataatatattaggaggtagggcctttgggaggtgattaggtcattgaggcaaagccttcatgaatgggttaagggcttaaaagaggccaratagagagaccctttgcccctcccccgatatgaggacatagcaaggaggtgaacatctaggaaccagaaagtgggccgttgccaaacactcaatctgcca

SEQ ID NO: 72315 - DNA, 201 bp, Homo sapiens
tgagaaacggggcgggggcaggtggggcgggggcagtggcatcaggtgcctgcctcccgccgagggtattcaccattcaaagcacaggcgcgaagagcaamcagctaccagacagaatcctttaggtctaggctattcctttcctttgaaccagagacaggaacagaacaccttagcccagcctccctgcaacattccaac

SEQ ID NO: 72316 - DNA, 201 bp, Homo sapiens
ggtgattaggtcattgaggcaaagccttcatgaatgggttaagggcttaaaagaggccagatagagagaccctttgcccctcccccgatatgaggacatarcaaggaggtgaacatctaggaaccagaaagtgggccgttgccaaacactcaatctgccagcagcttgatcttggacttcccagcctcaagaactatgaga

SEQ ID NO: 72317 - DNA, 201 bp, Homo sapiens
gcctttatattccaattcttcattccacactcctgactttttcccaagttattcaaggatggaaaagcgtatcatctccaagctagctctttcccgccttyccatccaaccaccccactctgctgccatccccagcacagcccaggagtaagatatttgacaagaattgtcagggttaacaagaactcccaaagcaagcac

SEQ ID NO: 72318 - DNA, 201 bp, Homo sapiens
tatgcatggatatgtatcatacaatatatgtacatatatcaaggtctttacctatatctattactgtgcatatatgtgtatatatgtatctatatctatcmcttctaccaacccatcagccagaactgttttcatatgctaggttttactgtatggagcttaaaacccatttatgcctcaggttgcaattttttgaatttt

SEQ ID NO: 72319 - DNA, 201 bp, Homo sapiens
agacaatgctacacaaaagtttggaagacgagatatctaaagatcacccagaaaaaagatataggagcatgctgttttcattaggtttcttcaaaaatcastggtatgatttcacagtattttgtttcatggaatatattcacgatatttgtttcatggaataaattcatgatatttgtttcatggaatatactggatatc

SEQ ID NO: 72320 - DNA, 201 bp, Homo sapiens
ggtagggcctttgggaggtgattaggtcattgaggcaaagccttcatgaatgggttaagggcttaaaagaggccagatagagagaccctttgcccctcccmcgatatgaggacatagcaaggaggtgaacatctaggaaccagaaagtgggccgttgccaaacactcaatctgccagcagcttgatcttggacttcccagc

SEQ ID NO: 72321 - DNA, 201 bp, Homo sapiens
ggtgcatgctgtgtcgtttgtgagctatgtgaccttagatacacatctaacctctctgtccctcatttttttcatctgtaaattggggatactaatagtgycccctctagtagaattgtattaatttgaaagagctgatgtacacaaagcatttgttatagtgtctccgatgtaaaggctcaatcaatgttcatctcaccc

SEQ ID NO: 72322 - DNA, 201 bp, Homo sapiens
tacggagtgagacggcctcatcggaacggcattacaagtatcatcttttgaggggaaatggggttaatcaagtccagctttaattggaggtcacatttgcwtgtgaaattctgggtccctgtaaggactgcctgggtccctgggtcatcaggccagtaacctctccaccattttctttccagagggagccccaggtaatgc

SEQ ID NO: 72323 - DNA, 201 bp, Homo sapiens
atctgcgtgccctgaatggaaggctgccttaggccacctctacggtcctattcaactgcagcattttaaaagccaaatgagactgtcctggggattttttyttgtccaaaggcacatatatatttgtgtgtacctgtgtgtgtacacccacgtatatgcatggatatgtatcatacaatatatgtacatatatcaaggtct

SEQ ID NO: 72324 - DNA, 201 bp, Homo sapiens
gaccttaaatggcaagggagccagaagttgtctgccaggccctgctggtttatccgggccccttttcttcttactcagtgctttgtgggagaacaggccgyctatgcagcaaaattaatgcttgggtaaggcttacagtctttgtgaaaggaatggattgtctccagcaccaggtcccacctctgtcttcagaaagcactg

SEQ ID NO: 72325 - DNA, 201 bp, Homo sapiens
tggaacactaggcatattactacggggcttataccactgatagtgaaaatcttgacagttcttctcttccctttccatcatgtccacatgcatctggccascaagtcctccccatccctgctctagtgctactgccttagggcaggccaccttcagcacttttctgcatggtagcaagaagctgataagagggaaggggtg

SEQ ID NO: 72326 - DNA, 201 bp, Homo sapiens
tctgcatggtagcaagaagctgataagagggaaggggtgccacatggtttagcctgttacccattaccaacttgtactgcactcaaagtatctgtggaacractcagatttgttgcctccctgcttgacggcgtgtttgatgccctcagaaaaacacttccactcctcagtagagcatcacagccctctgctgtatgacac

SEQ ID NO: 72327 - DNA, 201 bp, Homo sapiens
ccaattctgatggggttcctgccctacatacaccatacaaatgtttgttacaggtatttggatatctcagatcatctaagacgttcatcttacccttaggsttcatatctaaactgtaggattaagccgttcagaatgtacttgattcctataatatgtagtgattttgctaatgttgttcagttttgtttccttgcccag

SEQ ID NO: 72328 - DNA, 201 bp, Homo sapiens
tgtagtgattttgctaatgttgttcagttttgtttccttgcccagaatgatttccattagctcgcttgcagattagcagcctaatctcctaacaagagctyttcgatcaaatggtctggagtggccacatgtcttgctgctgccaagtgactgatttaagagatggacaaaaaggagacacacagaagtcgagatagcatg

SEQ ID NO: 72329 - DNA, 201 bp, Homo sapiens
ttgctaatgttgttcagttttgtttccttgcccagaatgatttccattagctcgcttgcagattagcagcctaatctcctaacaagagctcttcgatcaawtggtctggagtggccacatgtcttgctgctgccaagtgactgatttaagagatggacaaaaaggagacacacagaagtcgagatagcatgattaatggtc

SEQ ID NO: 72330 - DNA, 201 bp, Homo sapiens
tcacagccccacatctgtgacctaagttagtcaacaaatgctcactgagggccgactatgtgcttggcactgttccaggctctgaaaaagcagcagtgtasaaatccaatgaaattcctgctctgcactttgggaggccaaggtgggcagatcacctgaggtcaggagttcgagagcagcctggccaacctggtgaaacac

SEQ ID NO: 72331 - DNA, 201 bp, Homo sapiens
gtgactcagaaatagagaagaagggagctgaggaaccaaatctgcgtgccctgaatggaaggctgccttaggccacctctacggtcctattcaactgcagyattttaaaagccaaatgagactgtcctggggatttttttttgtccaaaggcacatatatatttgtgtgtacctgtgtgtgtacacccacgtatatgcatg

SEQ ID NO: 72332 - DNA, 201 bp, Homo sapiens
agcctggccaacctggtgaaacactgtttctactaaaaaatacaaaaattagctgggtatggtggtaggtgactataatcccagctactcaggaggctgasgtaggagaattgtttgaacccaggaggcggaggttgcagtgagctgacatcgcgccactgcactccagcttggacaacagagtgagactcctgtctcaaa

SEQ ID NO: 72333 - DNA, 201 bp, Homo sapiens
ccctcagcctttatattccaattcttcattccacactcctgactttttcccaagttattcaaggatggaaaagcgtatcatctccaagctagctctttccygccttcccatccaaccaccccactctgctgccatccccagcacagcccaggagtaagatatttgacaagaattgtcagggttaacaagaactcccaaagc

SEQ ID NO: 72334 - DNA, 201 bp, Homo sapiens
caattcttcattccacactcctgactttttcccaagttattcaaggatggaaaagcgtatcatctccaagctagctctttcccgccttcccatccaaccamcccactctgctgccatccccagcacagcccaggagtaagatatttgacaagaattgtcagggttaacaagaactcccaaagcaagcactttgagttatgt

SEQ ID NO: 72335 - DNA, 201 bp, Homo sapiens
gtgtgtgtacacccacgtatatgcatggatatgtatcatacaatatatgtacatatatcaaggtctttacctatatctattactgtgcatatatgtgtatrtatgtatctatatctatcacttctaccaacccatcagccagaactgttttcatatgctaggttttactgtatggagcttaaaacccatttatgcctcagg

SEQ ID NO: 72336 - DNA, 201 bp, Homo sapiens
aaaagcatttctctttgcttccaaatgtctatgtgatcatagataggtagaatcaggtcttaaggtaaataataataatcatgataattggtctttccctktgttagcaagcttgggtattcagaaacaagcagaggcaaaatctaatagcccactacaaaaaggaagtccaaatggagcaatgtggacttctcacaatca

SEQ ID NO: 72337 - DNA, 201 bp, Homo sapiens
atccctgcactttgggaggctgaggtgggtgaatcacctgaggtcaagagttcaagaccagcctgaccaatatggcaaaacctcatctctattgaaaatasaaaaattagccgggcttggtggtgggcacctgtaatcccagttacttgggaggctgaggtgcgacaattgcttgaacccgggggcgggggtagtttgcag

SEQ ID NO: 72338 - DNA, 201 bp, Homo sapiens
ggcaaaatctaatagcccactacaaaaaggaagtccaaatggagcaatgtggacttctcacaatcatccttccacattttcatctctgcttctcacttagsacaatcccttttctttttattttattgcaatgtgttttaaagtaagtttgccggctgggctcggtggctcacgccttaatccctgcactttgggaggctg

SEQ ID NO: 72339 - DNA, 201 bp, Homo sapiens
gccccttctttcctgtgaaaatcacaataaaaacattttttaaaaaaatttaagttccagggtacatgtgcaggatgtgcaggtttgttacataggtaaayctgtgccatggtggtttgctgcacctatcaacccatcgcctaggtattaagcccaacatccattagctattcttcctgatgctctccctcccccaacccc

SEQ ID NO: 72340 - DNA, 201 bp, Homo sapiens
agcaatgtggacttctcacaatcatccttccacattttcatctctgcttctcacttaggacaatcccttttctttttattttattgcaatgtgttttaaartaagtttgccggctgggctcggtggctcacgccttaatccctgcactttgggaggctgaggtgggtgaatcacctgaggtcaagagttcaagaccagcct

SEQ ID NO: 72341 - DNA, 201 bp, Homo sapiens
cgccttaatccctgcactttgggaggctgaggtgggtgaatcacctgaggtcaagagttcaagaccagcctgaccaatatggcaaaacctcatctctattkaaaatagaaaaattagccgggcttggtggtgggcacctgtaatcccagttacttgggaggctgaggtgcgacaattgcttgaacccgggggcgggggtag

SEQ ID NO: 72342 - DNA, 201 bp, Homo sapiens
aatcatgtccctggagtctcggcagaggacaaacaaagctgatggaggaagacaaagtctgctttttcaggatgcttcatgggaggctggggtgttaagcrctcctcagcctgcctgtgtgatctgagaaacggggcgggggcaggtggggcgggggcagtggcatcaggtgcctgcctcccgccgagggtattcaccatt

SEQ ID NO: 72343 - DNA, 201 bp, Homo sapiens
aagaatgggtgccccccaccccccaaccaagagccagttctgttaacacagcagagagccctccccaggtctcaaagtctccctgcctttgctgccacagktaagagggggtggttttgctcactgcaaaccacataacagaaacaacacctgcttgggcacttaaccctggaacgggaaagctgaaagtggtttctgttt

SEQ ID NO: 72344 - DNA, 201 bp, Homo sapiens
caatgaaattcctgctctgcactttgggaggccaaggtgggcagatcacctgaggtcaggagttcgagagcagcctggccaacctggtgaaacactgtttytactaaaaaatacaaaaattagctgggtatggtggtaggtgactataatcccagctactcaggaggctgacgtaggagaattgtttgaacccaggaggcg

SEQ ID NO: 72345 - DNA, 201 bp, Homo sapiens
cagaaaatatttatcatgtgaacctttgcaaagtttgcagatgctgttctagactcaaaattcatttcagtgtctctcaaataattgggtttgctttgttmctctgagtataaatggaatgatccagtgagaacttttaatgacaatagtaaggaattattaatttgggtttagtgaagaagagaatgttaaagaaccaaa

SEQ ID NO: 72346 - DNA, 201 bp, Homo sapiens
tgcactttgggaggctgaggtgggtgaatcacctgaggtcaagagttcaagaccagcctgaccaatatggcaaaacctcatctctattgaaaatagaaaamttagccgggcttggtggtgggcacctgtaatcccagttacttgggaggctgaggtgcgacaattgcttgaacccgggggcgggggtagtttgcagtgagc

SEQ ID NO: 72347 - DNA, 201 bp, Homo sapiens
gccactgcactccagcttggacaacagagtgagactcctgtctcaaaaaaaaaaaaaaaaaaaaaaatccttccctagaggaatgcacttatgtgtcgcayttccgggcaaaatgaaaaataagacagttttcagtggttttagcaaaggctgtgatagagggtcatcctcttcagctatagtgccactcccttcttggaa

SEQ ID NO: 72348 - DNA, 201 bp, Homo sapiens
agaaaatatttatcatgtgaacctttgcaaagtttgcagatgctgttctagactcaaaattcatttcagtgtctctcaaataattgggtttgctttgttaytctgagtataaatggaatgatccagtgagaacttttaatgacaatagtaaggaattattaatttgggtttagtgaagaagagaatgttaaagaaccaaag

SEQ ID NO: 72349 - DNA, 201 bp, Homo sapiens
gctgttctagactcaaaattcatttcagtgtctctcaaataattgggtttgctttgttactctgagtataaatggaatgatccagtgagaacttttaatgmcaatagtaaggaattattaatttgggtttagtgaagaagagaatgttaaagaaccaaagaaatttttaaagattcacagccactctttttgaaataaaga

SEQ ID NO: 72350 - DNA, 201 bp, Homo sapiens
aggatgtctttagattaaaataatatgttaacatgttcatcacttagaaaattcggattctgctctgcgtgagtcacatttattttctaagcaatctggatttttttttttctttaggaacaaaaattaataaaatacatgactgttgaatgcaattaatgggatccaagggctactgccaagtttttgaagagaatcaac

SEQ ID NO: 72351 - DNA, 201 bp, Homo sapiens
acttagaaaattcggattctgctctgcgtgagtcacatttattttctaagcaatctggatttttttttttctttaggaacaaaaattaataaaatacatgmctgttgaatgcaattaatgggatccaagggctactgccaagtttttgaagagaatcaacagcagagtcttagctcaaatcatatccacatcagtactacg

SEQ ID NO: 72352 - DNA, 201 bp, Homo sapiens
actgccaagtttttgaagagaatcaacagcagagtcttagctcaaatcatatccacatcagtactacggattaaatgtttgcgtcctcgcaaaattcgtawgttgaatttttttttttttttttttttttttgagacagtcttgctctgtcacccaggctggagtgcagtggtgtgatctcagctcactgcaacctccacc

SEQ ID NO: 72353 - DNA, 201 bp, Homo sapiens
atagtgaaaatcttgacagttcttctcttccctttccatcatgtccacatgcatctggccaccaagtcctccccatccctgctctagtgctactgccttarggcaggccaccttcagcacttttctgcatggtagcaagaagctgataagagggaaggggtgccacatggtttagcctgttacccattaccaacttgtact

SEQ ID NO: 72354 - DNA, 201 bp, Homo sapiens
catctaacctctctgtccctcatttttttcatctgtaaattggggatactaatagtgtcccctctagtagaattgtattaatttgaaagagctgatgtacrcaaagcatttgttatagtgtctccgatgtaaaggctcaatcaatgttcatctcaccctatccccgtgggttgaaactggcagacattccaacaggcctgg

SEQ ID NO: 72355 - DNA, 201 bp, Homo sapiens
ttttcatctgtaaattggggatactaatagtgtcccctctagtagaattgtattaatttgaaagagctgatgtacacaaagcatttgttatagtgtctccratgtaaaggctcaatcaatgttcatctcaccctatccccgtgggttgaaactggcagacattccaacaggcctggtagttgtttttttttttttttttct

SEQ ID NO: 72356 - DNA, 201 bp, Homo sapiens
atgcatggatatgtatcatacaatatatgtacatatatcaaggtctttacctatatctattactgtgcatatatgtgtatatatgtatctatatctatcayttctaccaacccatcagccagaactgttttcatatgctaggttttactgtatggagcttaaaacccatttatgcctcaggttgcaattttttgaattttc

SEQ ID NO: 72357 - DNA, 201 bp, Homo sapiens
aggtctttacctatatctattactgtgcatatatgtgtatatatgtatctatatctatcacttctaccaacccatcagccagaactgttttcatatgctargttttactgtatggagcttaaaacccatttatgcctcaggttgcaattttttgaattttcacgatcagaccttggtgatggctttgagcggtaggatata

SEQ ID NO: 72358 - DNA, 201 bp, Homo sapiens
ggatgtatccccaacacctagaatggtgcctgcacgtgctaacatctgctgaatgaatgtgacaattgagggctaagagatattcccaagagcccggtgcrgggggcggagaaataatatcactgaagttggtattggtttttcccacatgaaaagcatttctctttgcttccaaatgtctatgtgatcatagataggtag

SEQ ID NO: 72359 - DNA, 201 bp, Homo sapiens
agcgtatcatctccaagctagctctttcccgccttcccatccaaccaccccactctgctgccatccccagcacagcccaggagtaagatatttgacaagawttgtcagggttaacaagaactcccaaagcaagcactttgagttatgtcagacaaaaatgaaaattcaaaagaggagcattcatccatagtagaaaatatc

SEQ ID NO: 72360 - DNA, 201 bp, Homo sapiens
ccacatgtcttgctgctgccaagtgactgatttaagagatggacaaaaaggagacacacagaagtcgagatagcatgattaatggtcgatccaactttctytgaaccgcatatcatgactgaatgggaaaccctgaagagattaaaggggggaattacattaccatgaataatataaaaaagtgatattctgtctaaaaac

SEQ ID NO: 72361 - DNA, 201 bp, Homo sapiens
accaatatggcaaaacctcatctctattgaaaatagaaaaattagccgggcttggtggtgggcacctgtaatcccagttacttgggaggctgaggtgcgasaattgcttgaacccgggggcgggggtagtttgcagtgagccgagatcatgccacttcactccaggctgggcaaaaaagcgaaagtccatctcgaaaaata

SEQ ID NO: 72362 - DNA, 201 bp, Homo sapiens
tgagtgcaagtgactcgaacaaatatattaacagagcttacagcagattcaatcaggttgaacgctccccagaatttattttgaaataagctttatatatytgagacgtgaagaatgaatctattcgtggctggcaggaaagctattaacatgcagattttaattctgcctttgattctacagaggttctattgtccctcc

SEQ ID NO: 72363 - DNA, 201 bp, Homo sapiens
gatgccctcagaaaaacacttccactcctcagtagagcatcacagccctctgctgtatgacacccgacctttctacacttttctctctgcaccaagctgtkggagtttgctctcttaaactcccacgttccaacctcagccaagctctccgggcagccacacttccctttgccagctgtgaccaccaatactgccaccagg

SEQ ID NO: 72364 - DNA, 201 bp, Homo sapiens
aatgggaaaccctgaagagattaaaggggggaattacattaccatgaataatataaaaaagtgatattctgtctaaaaaccttttgagtgcaagtgactcraacaaatatattaacagagcttacagcagattcaatcaggttgaacgctccccagaatttattttgaaataagctttatatatctgagacgtgaagaatg

SEQ ID NO: 72365 - DNA, 201 bp, Homo sapiens
acctgcagggccacactcattggcacctcggtgacttcacttactctggtcaccctgctgtctctcccaggcctcctccctcacagaccttctagggaaarcttctctatcatggtcaactttgagccgtgtatattggccacaggcatccctccttctattagggcgccatactgctcacttattattgcctaaaacctg

SEQ ID NO: 72366 - DNA, 201 bp, Homo sapiens
cctgcagggccacactcattggcacctcggtgacttcacttactctggtcaccctgctgtctctcccaggcctcctccctcacagaccttctagggaaagsttctctatcatggtcaactttgagccgtgtatattggccacaggcatccctccttctattagggcgccatactgctcacttattattgcctaaaacctgc

SEQ ID NO: 72367 - DNA, 201 bp, Homo sapiens
cttttttcttaatccttaaaaaaaaaattaggtccgccctcagcctttatattccaattcttcattccacactcctgactttttcccaagttattcaaggrtggaaaagcgtatcatctccaagctagctctttcccgccttcccatccaaccaccccactctgctgccatccccagcacagcccaggagtaagatatttg

SEQ ID NO: 72368 - DNA, 201 bp, Homo sapiens; identical to SEQ ID NO: 44628

SEQ ID NO: 72369 - DNA, 201 bp, Homo sapiens; identical to SEQ ID NO: 44805

SEQ ID NO: 72370 - DNA, 201 bp, Homo sapiens; identical to SEQ ID NO: 45049

SEQ ID NO: 72371 - DNA, 201 bp, Homo sapiens; identical to SEQ ID NO: 39792

SEQ ID NO: 72372 - DNA, 201 bp, Homo sapiens; identical to SEQ ID NO: 39793

SEQ ID NO: 72373 - DNA, 201 bp, Homo sapiens; identical to SEQ ID NO: 45078

SEQ ID NO: 72374 - DNA, 201 bp, Homo sapiens; identical to SEQ ID NO: 39557

SEQ ID NO: 72375 - DNA, 201 bp, Homo sapiens; identical to SEQ ID NO: 45080

SEQ ID NO: 72376 - DNA, 201 bp, Homo sapiens; identical to SEQ ID NO: 40950

SEQ ID NO: 72377 - DNA, 201 bp, Homo sapiens; identical to SEQ ID NO: 40951

SEQ ID NO: 72378 - DNA, 201 bp, Homo sapiens; identical to SEQ ID NO: 43716

SEQ ID NO: 72379 - DNA, 201 bp, Homo sapiens; identical to SEQ ID NO: 43718

SEQ ID NO: 72380 - DNA, 201 bp, Homo sapiens; identical to SEQ ID NO: 40400

SEQ ID NO: 72381 - DNA, 201 bp, Homo sapiens; identical to SEQ ID NO: 43720

SEQ ID NO: 72382 - DNA, 201 bp, Homo sapiens; identical to SEQ ID NO: 40402

SEQ ID NO: 72383 - DNA, 201 bp, Homo sapiens; identical to SEQ ID NO: 43722

SEQ ID NO: 72384 - DNA, 201 bp, Homo sapiens; identical to SEQ ID NO: 40404

SEQ ID NO: 72385 - DNA, 201 bp, Homo sapiens; identical to SEQ ID NO: 43648

SEQ ID NO: 72386 - DNA, 201 bp, Homo sapiens; identical to SEQ ID NO: 43724

SEQ ID NO: 72387 - DNA, 201 bp, Homo sapiens; identical to SEQ ID NO: 43649

SEQ ID NO: 72388 - DNA, 201 bp, Homo sapiens; identical to SEQ ID NO: 43264

SEQ ID NO: 72389 - DNA, 201 bp, Homo sapiens; identical to SEQ ID NO: 43726

SEQ ID NO: 72390 - DNA, 201 bp, Homo sapiens; identical to SEQ ID NO: 43650

SEQ ID NO: 72391 - DNA, 201 bp, Homo sapiens; identical to SEQ ID NO: 43728

SEQ ID NO: 72392 - DNA, 201 bp, Homo sapiens; identical to SEQ ID NO: 43730

SEQ ID NO: 72393 - DNA, 201 bp, Homo sapiens; identical to SEQ ID NO: 43731

SEQ ID NO: 72394 - DNA, 201 bp, Homo sapiens; identical to SEQ ID NO: 39372

SEQ ID NO: 72395 - DNA, 201 bp, Homo sapiens; identical to SEQ ID NO: 39621

SEQ ID NO: 72396 - DNA, 201 bp, Homo sapiens; identical to SEQ ID NO: 39373

SEQ ID NO: 72397 - DNA, 201 bp, Homo sapiens; identical to SEQ ID NO: 39374

SEQ ID NO: 72398 - DNA, 201 bp, Homo sapiens; identical to SEQ ID NO: 39375

SEQ ID NO: 72399 - DNA, 201 bp, Homo sapiens; identical to SEQ ID NO: 39784

SEQ ID NO: 72400 - DNA, 201 bp, Homo sapiens; identical to SEQ ID NO: 39806

SEQ ID NO: 72401 - DNA, 201 bp, Homo sapiens; identical to SEQ ID NO: 41972

SEQ ID NO: 72402 - DNA, 201 bp, Homo sapiens; identical to SEQ ID NO: 39807

SEQ ID NO: 72403 - DNA, 201 bp, Homo sapiens; identical to SEQ ID NO: 40415

SEQ ID NO: 72404 - DNA, 201 bp, Homo sapiens; identical to SEQ ID NO: 39808

SEQ ID NO: 72405 - DNA, 201 bp, Homo sapiens; identical to SEQ ID NO: 40416

SEQ ID NO: 72406 - DNA, 201 bp, Homo sapiens; identical to SEQ ID NO: 40419

SEQ ID NO: 72407 - DNA, 201 bp, Homo sapiens; identical to SEQ ID NO: 40420

SEQ ID NO: 72408 - DNA, 201 bp, Homo sapiens; identical to SEQ ID NO: 40421

SEQ ID NO: 72409 - DNA, 201 bp, Homo sapiens; identical to SEQ ID NO: 40422

SEQ ID NO: 72410 - DNA, 201 bp, Homo sapiens; identical to SEQ ID NO: 40423

SEQ ID NO: 72411 - DNA, 201 bp, Homo sapiens; identical to SEQ ID NO: 39521

SEQ ID NO: 72412 - DNA, 201 bp, Homo sapiens; identical to SEQ ID NO: 40424

SEQ ID NO: 72413 - DNA, 201 bp, Homo sapiens; identical to SEQ ID NO: 39522

SEQ ID NO: 72414 - DNA, 201 bp, Homo sapiens; identical to SEQ ID NO: 43673

SEQ ID NO: 72415 - DNA, 201 bp, Homo sapiens; identical to SEQ ID NO: 41682

SEQ ID NO: 72416 - DNA, 201 bp, Homo sapiens; identical to SEQ ID NO: 41683

SEQ ID NO: 72417 - DNA, 201 bp, Homo sapiens; identical to SEQ ID NO: 43679

SEQ ID NO: 72418 - DNA, 201 bp, Homo sapiens; identical to SEQ ID NO: 41684

SEQ ID NO: 72419 - DNA, 201 bp, Homo sapiens; identical to SEQ ID NO: 43682

SEQ ID NO: 72420 - DNA, 201 bp, Homo sapiens; identical to SEQ ID NO: 40432

SEQ ID NO: 72421 - DNA, 201 bp, Homo sapiens; identical to SEQ ID NO: 43685

SEQ ID NO: 72422 - DNA, 201 bp, Homo sapiens; identical to SEQ ID NO: 45258

SEQ ID NO: 72423 - DNA, 201 bp, Homo sapiens; identical to SEQ ID NO: 43687

SEQ ID NO: 72424 - DNA, 201 bp, Homo sapiens; identical to SEQ ID NO: 43688

SEQ ID NO: 72425 - DNA, 201 bp, Homo sapiens; identical to SEQ ID NO: 43689

SEQ ID NO: 72426 - DNA, 201 bp, Homo sapiens; identical to SEQ ID NO: 43690

SEQ ID NO: 72427 - DNA, 201 bp, Homo sapiens; identical to SEQ ID NO: 43691

SEQ ID NO: 72428 - DNA, 201 bp, Homo sapiens; identical to SEQ ID NO: 39790

SEQ ID NO: 72429 - DNA, 201 bp, Homo sapiens; identical to SEQ ID NO: 39547

SEQ ID NO: 72430 - DNA, 201 bp, Homo sapiens; identical to SEQ ID NO: 39549

SEQ ID NO: 72431 - DNA, 201 bp, Homo sapiens; identical to SEQ ID NO: 39550

SEQ ID NO: 72432 - DNA, 201 bp, Homo sapiens; identical to SEQ ID NO: 39551

SEQ ID NO: 72433 - DNA, 201 bp, Homo sapiens; identical to SEQ ID NO: 42575

SEQ ID NO: 72434 - DNA, 201 bp, Homo sapiens; identical to SEQ ID NO: 40322

SEQ ID NO: 72435 - DNA, 201 bp, Homo sapiens; identical to SEQ ID NO: 42577

SEQ ID NO: 72436 - DNA, 201 bp, Homo sapiens; identical to SEQ ID NO: 41614

SEQ ID NO: 72437 - DNA, 201 bp, Homo sapiens; identical to SEQ ID NO: 39801

SEQ ID NO: 72438 - DNA, 201 bp, Homo sapiens; identical to SEQ ID NO: 45018

SEQ ID NO: 72439 - DNA, 201 bp, Homo sapiens; identical to SEQ ID NO: 40114

SEQ ID NO: 72440 - DNA, 201 bp, Homo sapiens; identical to SEQ ID NO: 42589

SEQ ID NO: 72441 - DNA, 201 bp, Homo sapiens; identical to SEQ ID NO: 42489

SEQ ID NO: 72442 - DNA, 201 bp, Homo sapiens; identical to SEQ ID NO: 42492

SEQ ID NO: 72443 - DNA, 201 bp, Homo sapiens; identical to SEQ ID NO: 39572

SEQ ID NO: 72444 - DNA, 201 bp, Homo sapiens; identical to SEQ ID NO: 42497

SEQ ID NO: 72445 - DNA, 201 bp, Homo sapiens; identical to SEQ ID NO: 39577

SEQ ID NO: 72446 - DNA, 201 bp, Homo sapiens; identical to SEQ ID NO: 44593

SEQ ID NO: 72447 - DNA, 201 bp, Homo sapiens; identical to SEQ ID NO: 39580

SEQ ID NO: 72448 - DNA, 201 bp, Homo sapiens; identical to SEQ ID NO: 41321

SEQ ID NO: 72449 - DNA, 201 bp, Homo sapiens; identical to SEQ ID NO: 39582

SEQ ID NO: 72450 - DNA, 201 bp, Homo sapiens; identical to SEQ ID NO: 44594

SEQ ID NO: 72451 - DNA, 201 bp, Homo sapiens; identical to SEQ ID NO: 39583

SEQ ID NO: 72452 - DNA, 201 bp, Homo sapiens; identical to SEQ ID NO: 44596

SEQ ID NO: 72453 - DNA, 201 bp, Homo sapiens; identical to SEQ ID NO: 44598

SEQ ID NO: 72454 - DNA, 201 bp, Homo sapiens; identical to SEQ ID NO: 40340

SEQ ID NO: 72455 - DNA, 201 bp, Homo sapiens; identical to SEQ ID NO: 40341

SEQ ID NO: 72456 - DNA, 201 bp, Homo sapiens; identical to SEQ ID NO: 43553

SEQ ID NO: 72457 - DNA, 201 bp, Homo sapiens; identical to SEQ ID NO: 40343

SEQ ID NO: 72458 - DNA, 201 bp, Homo sapiens; identical to SEQ ID NO: 40345

SEQ ID NO: 72459 - DNA, 201 bp, Homo sapiens; identical to SEQ ID NO: 40347

SEQ ID NO: 72460 - DNA, 201 bp, Homo sapiens; identical to SEQ ID NO: 40348

SEQ ID NO: 72461 - DNA, 201 bp, Homo sapiens; identical to SEQ ID NO: 40349

SEQ ID NO: 72462 - DNA, 201 bp, Homo sapiens; identical to SEQ ID NO: 41137

SEQ ID NO: 72463 - DNA, 201 bp, Homo sapiens; identical to SEQ ID NO: 40351

SEQ ID NO: 72464 - DNA, 201 bp, Homo sapiens; identical to SEQ ID NO: 40356

SEQ ID NO: 72465 - DNA, 201 bp, Homo sapiens; identical to SEQ ID NO: 40359

SEQ ID NO: 72466 - DNA, 201 bp, Homo sapiens; identical to SEQ ID NO: 40983

SEQ ID NO: 72467 - DNA, 201 bp, Homo sapiens; identical to SEQ ID NO: 40985

SEQ ID NO: 72468 - DNA, 201 bp, Homo sapiens; identical to SEQ ID NO: 40140

SEQ ID NO: 72469 - DNA, 201 bp, Homo sapiens; identical to SEQ ID NO: 39959

SEQ ID NO: 72470 - DNA, 201 bp, Homo sapiens; identical to SEQ ID NO: 44616

SEQ ID NO: 72471 - DNA, 201 bp, Homo sapiens; identical to SEQ ID NO: 39350

SEQ ID NO: 72472 - DNA, 201 bp, Homo sapiens; identical to SEQ ID NO: 44618

SEQ ID NO: 72473 - DNA, 201 bp, Homo sapiens; identical to SEQ ID NO: 39351

SEQ ID NO: 72474 - DNA, 201 bp, Homo sapiens; identical to SEQ ID NO: 39481

SEQ ID NO: 72475 - DNA, 201 bp, Homo sapiens; identical to SEQ ID NO: 44619

SEQ ID NO: 72476 - DNA, 201 bp, Homo sapiens; identical to SEQ ID NO: 39353

SEQ ID NO: 72477 - DNA, 201 bp, Homo sapiens; identical to SEQ ID NO: 39482

SEQ ID NO: 72478 - DNA, 201 bp, Homo sapiens; identical to SEQ ID NO: 44620

SEQ ID NO: 72479 - DNA, 201 bp, Homo sapiens; identical to SEQ ID NO: 39354

SEQ ID NO: 72480 - DNA, 201 bp, Homo sapiens; identical to SEQ ID NO: 39483

SEQ ID NO: 72481 - DNA, 201 bp, Homo sapiens; identical to SEQ ID NO: 39355

SEQ ID NO: 72482 - DNA, 201 bp, Homo sapiens; identical to SEQ ID NO: 44951

SEQ ID NO: 72483 - DNA, 201 bp, Homo sapiens; identical to SEQ ID NO: 42532

SEQ ID NO: 72484 - DNA, 201 bp, Homo sapiens; identical to SEQ ID NO: 40379

SEQ ID NO: 72485 - DNA, 201 bp, Homo sapiens; identical to SEQ ID NO: 42534

SEQ ID NO: 72486 - DNA, 201 bp, Homo sapiens; identical to SEQ ID NO: 40380

SEQ ID NO: 72487 - DNA, 201 bp, Homo sapiens; identical to SEQ ID NO: 42537

SEQ ID NO: 72488 - DNA, 201 bp, Homo sapiens; identical to SEQ ID NO: 40381

SEQ ID NO: 72489 - DNA, 201 bp, Homo sapiens; identical to SEQ ID NO: 41018

SEQ ID NO: 72490 - DNA, 201 bp, Homo sapiens; identical to SEQ ID NO: 39368

SEQ ID NO: 72491 - DNA, 201 bp, Homo sapiens; identical to SEQ ID NO: 39498

SEQ ID NO: 72492 - DNA, 201 bp, Homo sapiens; identical to SEQ ID NO: 39500

SEQ ID NO: 72493 - DNA, 201 bp, Homo sapiens; identical to SEQ ID NO: 39503

SEQ ID NO: 72494 - DNA, 201 bp, Homo sapiens; identical to SEQ ID NO: 39505

SEQ ID NO: 72495 - DNA, 201 bp, Homo sapiens; identical to SEQ ID NO: 39506

SEQ ID NO: 72496 - DNA, 201 bp, Homo sapiens; identical to SEQ ID NO: 39507

SEQ ID NO: 72497 - DNA, 201 bp, Homo sapiens; identical to SEQ ID NO: 39508

SEQ ID NO: 72498 - DNA, 201 bp, Homo sapiens; identical to SEQ ID NO: 39509

SEQ ID NO: 72499 - DNA, 201 bp, Homo sapiens; identical to SEQ ID NO: 43356

SEQ ID NO: 72500 - DNA, 201 bp, Homo sapiens; identical to SEQ ID NO: 39510

SEQ ID NO: 72501 - DNA, 201 bp, Homo sapiens; identical to SEQ ID NO: 39511

SEQ ID NO: 72502 - DNA, 201 bp, Homo sapiens; identical to SEQ ID NO: 44556

SEQ ID NO: 72503 - DNA, 201 bp, Homo sapiens; identical to SEQ ID NO: 44897

SEQ ID NO: 72504 - DNA, 201 bp, Homo sapiens; identical to SEQ ID NO: 39534

SEQ ID NO: 72505 - DNA, 201 bp, Homo sapiens; identical to SEQ ID NO: 39543

SEQ ID NO: 72506 - DNA, 201 bp, Homo sapiens; identical to SEQ ID NO: 39544

SEQ ID NO: 72507 - DNA, 201 bp, Homo sapiens; identical to SEQ ID NO: 54664

SEQ ID NO: 72508 - DNA, 201 bp, Homo sapiens; identical to SEQ ID NO: 54775

SEQ ID NO: 72509 - DNA, 201 bp, Homo sapiens; identical to SEQ ID NO: 54774

SEQ ID NO: 72510 - DNA, 201 bp, Homo sapiens; identical to SEQ ID NO: 54666

SEQ ID NO: 72511 - DNA, 201 bp, Homo sapiens; identical to SEQ ID NO: 54776

SEQ ID NO: 72512 - DNA, 201 bp, Homo sapiens; identical to SEQ ID NO: 54667

SEQ ID NO: 72513 - DNA, 201 bp, Homo sapiens; identical to SEQ ID NO: 54777

SEQ ID NO: 72514 - DNA, 201 bp, Homo sapiens; identical to SEQ ID NO: 54705

SEQ ID NO: 72515 - DNA, 201 bp, Homo sapiens; identical to SEQ ID NO: 54668

SEQ ID NO: 72516 - DNA, 201 bp, Homo sapiens; identical to SEQ ID NO: 54669

SEQ ID NO: 72517 - DNA, 201 bp, Homo sapiens; identical to SEQ ID NO: 54919

SEQ ID NO: 72518 - DNA, 201 bp, Homo sapiens; identical to SEQ ID NO: 54852

SEQ ID NO: 72519 - DNA, 201 bp, Homo sapiens; identical to SEQ ID NO: 54854

SEQ ID NO: 72520 - DNA, 201 bp, Homo sapiens; identical to SEQ ID NO: 54677

SEQ ID NO: 72521 - DNA, 201 bp, Homo sapiens; identical to SEQ ID NO: 54856

SEQ ID NO: 72522 - DNA, 201 bp, Homo sapiens; identical to SEQ ID NO: 54857

SEQ ID NO: 72523 - DNA, 201 bp, Homo sapiens; identical to SEQ ID NO: 54924

SEQ ID NO: 72524 - DNA, 201 bp, Homo sapiens; identical to SEQ ID NO: 54859

SEQ ID NO: 72525 - DNA, 201 bp, Homo sapiens; identical to SEQ ID NO: 54748

SEQ ID NO: 72526 - DNA, 201 bp, Homo sapiens; identical to SEQ ID NO: 54927

SEQ ID NO: 72527 - DNA, 201 bp, Homo sapiens; identical to SEQ ID NO: 54750

SEQ ID NO: 72528 - DNA, 201 bp, Homo sapiens; identical to SEQ ID NO: 54782

SEQ ID NO: 72529 - DNA, 201 bp, Homo sapiens; identical to SEQ ID NO: 54753

SEQ ID NO: 72530 - DNA, 201 bp, Homo sapiens; identical to SEQ ID NO: 54715

SEQ ID NO: 72531 - DNA, 201 bp, Homo sapiens; identical to SEQ ID NO: 54891

SEQ ID NO: 72532 - DNA, 201 bp, Homo sapiens; identical to SEQ ID NO: 54784

SEQ ID NO: 72533 - DNA, 201 bp, Homo sapiens; identical to SEQ ID NO: 54872

SEQ ID NO: 72534 - DNA, 201 bp, Homo sapiens; identical to SEQ ID NO: 54683

SEQ ID NO: 72535 - DNA, 201 bp, Homo sapiens; identical to SEQ ID NO: 54873

SEQ ID NO: 72536 - DNA, 201 bp, Homo sapiens; identical to SEQ ID NO: 54718

SEQ ID NO: 72537 - DNA, 201 bp, Homo sapiens; identical to SEQ ID NO: 54945

SEQ ID NO: 72538 - DNA, 201 bp, Homo sapiens; identical to SEQ ID NO: 54726

SEQ ID NO: 72539 - DNA, 201 bp, Homo sapiens; identical to SEQ ID NO: 54898

SEQ ID NO: 72540 - DNA, 201 bp, Homo sapiens; identical to SEQ ID NO: 54899

SEQ ID NO: 72541 - DNA, 201 bp, Homo sapiens; identical to SEQ ID NO: 54900

SEQ ID NO: 72542 - DNA, 201 bp, Homo sapiens; identical to SEQ ID NO: 54835

SEQ ID NO: 72543 - DNA, 201 bp, Homo sapiens; identical to SEQ ID NO: 54836

SEQ ID NO: 72544 - DNA, 201 bp, Homo sapiens; identical to SEQ ID NO: 54837

SEQ ID NO: 72545 - DNA, 201 bp, Homo sapiens; identical to SEQ ID NO: 54955

SEQ ID NO: 72546 - DNA, 201 bp, Homo sapiens; identical to SEQ ID NO: 54839

SEQ ID NO: 72547 - DNA, 201 bp, Homo sapiens; identical to SEQ ID NO: 54840

SEQ ID NO: 72548 - DNA, 201 bp, Homo sapiens; identical to SEQ ID NO: 54842

SEQ ID NO: 72549 - DNA, 201 bp, Homo sapiens; identical to SEQ ID NO: 54843

SEQ ID NO: 72550 - DNA, 201 bp, Homo sapiens; identical to SEQ ID NO: 54805

SEQ ID NO: 72551 - DNA, 201 bp, Homo sapiens
tgaggcccaaggtcacggtgtcagcaaggtgtcagcaaggttccttgggtatgggacccaaagcctccggatcccagcctggagcaattagagtagtagtrgtggtggagatttatggagttctgttctggtgttcattatacgttaactcattagatccttgggacaattctgtgtggtgagggtcccatctttcagatg

SEQ ID NO: 72552 - DNA, 201 bp, Homo sapiens; identical to SEQ ID NO: 48168

SEQ ID NO: 72553 - DNA, 201 bp, Homo sapiens
caaaggtgggttgggggtctgggttgaagggccaggggtcaggcctggcaaaagaggtcaaagactaaaggtcataactcaaggtcaagggtgtgtccccrgttggtgcttaatgcattgagatgtgttcaggattccatgggggaggtcaggggtgaaaaggcccaaggtcacaaggttagaatttaaagtcacttgggg

SEQ ID NO: 72554 - DNA, 201 bp, Homo sapiens; identical to SEQ ID NO: 48169

SEQ ID NO: 72555 - DNA, 201 bp, Homo sapiens
ggaggatcacttggggtcaggagttcgagaccagcctgtgcaacatggtgaaaccccgtctctactcaaaacacaaaaaattagttgggtgtggtggtgcsagcctgtaatcttagctacccggggcgctgaggaggaagaatcgcctgaacccaggaggccgaggttacagtgagctaagatcacaccactgcactccag

SEQ ID NO: 72556 - DNA, 201 bp, Homo sapiens; identical to SEQ ID NO: 8947

SEQ ID NO: 72557 - DNA, 201 bp, Homo sapiens; identical to SEQ ID NO: 8948

SEQ ID NO: 72558 - DNA, 201 bp, Homo sapiens; identical to SEQ ID NO: 48172

SEQ ID NO: 72559 - DNA, 201 bp, Homo sapiens
caagctcacagtcaacaaagggttgagtaaccattttcaggtgagccttcctggtgtccttacccaccagagatcgtccccgccgtccccctccctgcatstgcacactcggcccaattactcctccctcaagagctgggctccctgatacttgaaaagactcggagatatagtgccagactgactactcagtttggggac

SEQ ID NO: 72560 - DNA, 201 bp, Homo sapiens; identical to SEQ ID NO: 48173

SEQ ID NO: 72561 - DNA, 201 bp, Homo sapiens; identical to SEQ ID NO: 48175

SEQ ID NO: 72562 - DNA, 201 bp, Homo sapiens
ggatttctcaactgtgaatcttcagtccctcttcccccttcatttctgtctctgcagatgtgttgtttctttttttttttttcttttttttttttttttgkctttttgagatgaagtcttgcactgtctcccaggctggagtgcagtggcacaatcacaatctcagcttactgcaacttccgcctcccgggttcaagcgat

SEQ ID NO: 72563 - DNA, 201 bp, Homo sapiens; identical to SEQ ID NO: 8949

SEQ ID NO: 72564 - DNA, 201 bp, Homo sapiens; identical to SEQ ID NO: 48178

SEQ ID NO: 72565 - DNA, 201 bp, Homo sapiens
tggtagtgattttttttttcttttcttcccctgccccacctcacatacctctgccctgagacgcagtctctgttgcccaggccagagtgcagtggcacagkgtcagctcacctcaacctccaccttctgggttcaagtgattctcctgtctcagcctcccaagtagctgggattacaggcacgcactgccacacccggcta

SEQ ID NO: 72566 - DNA, 201 bp, Homo sapiens; identical to SEQ ID NO: 48179

SEQ ID NO: 72567 - DNA, 201 bp, Homo sapiens
ttctggatgttgtttgaaggcagagctgccaggatttgttgagaccggatggaggcgatgactctgtagtttttggctggaactggaaggatggagtttcrgattgccagctttgtgtctttgtgcagccatccactgtgtcgtggagagcaggctcttgagcgctgagtcctgagtgaatgactcgtgcaggcggggagg

SEQ ID NO: 72568 - DNA, 201 bp, Homo sapiens; identical to SEQ ID NO: 48180

SEQ ID NO: 72569 - DNA, 201 bp, Homo sapiens; identical to SEQ ID NO: 48181

SEQ ID NO: 72570 - DNA, 201 bp, Homo sapiens
tggggctttcggaaaccaaggcatagcttctcacaggaccctgcagctggcgtagagagcagactccaaagggggtaccactgggagggagtggacggggrgaggaggttggattctggatgttgtttgaaggcagagctgccaggatttgttgagaccggatggaggcgatgactctgtagtttttggctggaactggaa

SEQ ID NO: 72571 - DNA, 201 bp, Homo sapiens; identical to SEQ ID NO: 48182

SEQ ID NO: 72572 - DNA, 201 bp, Homo sapiens; identical to SEQ ID NO: 48184

SEQ ID NO: 72573 - DNA, 201 bp, Homo sapiens; identical to SEQ ID NO: 8951

SEQ ID NO: 72574 - DNA, 201 bp, Homo sapiens; identical to SEQ ID NO: 48186

SEQ ID NO: 72575 - DNA, 201 bp, Homo sapiens
tcacccgtggggcaggggacagactgttcccagagagtaacaagccaggatgggcaaggctgacatgggggaacccaaaggtcggggagcctaactcagcytaggtggtcagagagcacttcgtggaggaggggacccccatccgaggctttctgaccctaggcttctcaccccggcccatctcacatacttgcacagtgc

SEQ ID NO: 72576 - DNA, 201 bp, Homo sapiens; identical to SEQ ID NO: 48187

SEQ ID NO: 72577 - DNA, 201 bp, Homo sapiens
caggttcccgctgtagaaatctctggggcatctctggggtggccatgtgggggctagttattaggaagggcaaaactggaggcccagacagggttgggggkactgaatgaggtctctgcttctgtcatttcccttcagcaaatgtgtttattctgcaaaccttcattgcacaacacattctgtgcccagccctgtgctggc

SEQ ID NO: 72578 - DNA, 201 bp, Homo sapiens; identical to SEQ ID NO: 48188

SEQ ID NO: 72579 - DNA, 201 bp, Homo sapiens
gagactccatctcaaaaaaaaaaaaaaaaaattaaatttcttattttttgaaacaggatctctgttgcccacgttggagtgcagtggcgtgatcatagctyagtgtaaccttgaccttctgagctcaagtgatcctcctgcctcagcctcccaagtagctgggactataagcatgtgccatcatgcctggctacgttttta

SEQ ID NO: 72580 - DNA, 201 bp, Homo sapiens
gggtctctggagagagctgggggtggtagggaaggaagagatgagagttggtgtggggttggagtggagtgtgacagcgtttctcttctccagagctgttwcccattcagatggagggtgtcaagctcacagtcaacaaagggttgagtaaccattttcaggtgagccttcctggtgtccttacccaccagagatcgtccc

SEQ ID NO: 72581 - DNA, 201 bp, Homo sapiens; identical to SEQ ID NO: 48189

SEQ ID NO: 72582 - DNA, 201 bp, Homo sapiens
tctcactctgtcactcaggctggagtgcagtggcactatcatggctcactgcagcctccacctcctgggcttaagcaatcctcccacgtccacccccttastacctgggactacaggtgtgcaccacctcacccaactaatttttgtattcgctatgtttcccaagctggtttcgaattcctgggctcaaatgaacccact

SEQ ID NO: 72583 - DNA, 201 bp, Homo sapiens; identical to SEQ ID NO: 48190

SEQ ID NO: 72584 - DNA, 201 bp, Homo sapiens; identical to SEQ ID NO: 48191

SEQ ID NO: 72585 - DNA, 201 bp, Homo sapiens; identical to SEQ ID NO: 48192

SEQ ID NO: 72586 - DNA, 201 bp, Homo sapiens
ttcccaagctggtttcgaattcctgggctcaaatgaacccactttggcctcccaaactgctgggattacaacaagcatgagccactgtgcctggccttgatttttttttttttttatgataatctgtagttagatgaagtttttaaattttttgtagagatggggtctcactatgtcacctaggcttgtctccaactgctg

SEQ ID NO: 72587 - DNA, 201 bp, Homo sapiens
tgggcaagcctatctgtccagtatcgtcacagctctcgctttccttccaggtcaaccacacagtagccctcagcacaatcggggagtccaactaccacttyggggtcacatatgtggggacaaagcagctgagtcccacagaggtgagcttcctttttcatccattcattgtatccttctaataacaaatttgtagccaaa

SEQ ID NO: 72588 - DNA, 201 bp, Homo sapiens
caggggccgccgaggatggggcctgcggctgcctgcccaacccgggcacattcgaggagtgccaccggaagtgcaagggtgaggggcgaggggcccccgckgggctgcgatggcctggatctcgggggaagggggaggacactggggactctgggatttggcgcgcaccattggaattatttaacagcactaggaggtgat

SEQ ID NO: 72589 - DNA, 201 bp, Homo sapiens; identical to SEQ ID NO: 48193

SEQ ID NO: 72590 - DNA, 201 bp, Homo sapiens; identical to SEQ ID NO: 8961

SEQ ID NO: 72591 - DNA, 201 bp, Homo sapiens; identical to SEQ ID NO: 48196

SEQ ID NO: 72592 - DNA, 201 bp, Homo sapiens; identical to SEQ ID NO: 48197

SEQ ID NO: 72593 - DNA, 201 bp, Homo sapiens; identical to SEQ ID NO: 8946

SEQ ID NO: 72594 - DNA, 201 bp, Homo sapiens
acggtcaggacccttgcaccctggagccacaagcctggggtcccccatcccggtgcctccagggccacctgctgtggaagacgtttccctggatctagagratgaggagggggaggaggaggaagagtatctggacaagatcaaccccatctatgatgctctgtcctatagcagcccctctgattcctaccagggcaaagg

SEQ ID NO: 72595 - DNA, 201 bp, Homo sapiens; identical to SEQ ID NO: 48201

SEQ ID NO: 72596 - DNA, 201 bp, Homo sapiens
tctatgatgctctgtcctatagcagcccctctgattcctaccagggcaaaggctttgtcatgtcccgggccatgtatgtgtgagctgccatgcgcctggcrtctcacatctcacctgttgatcccttagctttcttgccaaggatctagtgccccctgacctctggccaggccactgtcagttaacacatatgcattccat

SEQ ID NO: 72597 - DNA, 201 bp, Homo sapiens
actacactccagcctgggcatcagggtgagaccctatctcaaaaaaaaaaaaaaagaggaaaagtcattaggtcaatgaaaattgattatctggtcaggcrtggtggctcacacctgtaatcccagcactttgggaggctgagacgggcagatcacctgacgtcaggagttccagaccaccctggctaacaaggtgaaacc

SEQ ID NO: 72598 - DNA, 201 bp, Homo sapiens
actgttaacctggaagactactgaatcattttacccttgcccagtggaataggacctaaacatcccccttccggggaaagtgggtcatctgaattgggggyagcaattgatactgttttgtaaactacatttcctacaaaatatgaatttatactttgaccaggtcttgccttttctgtgggatgtgaaggggatggggtg

SEQ ID NO: 72599 - DNA, 201 bp, Homo sapiens
gcaagaaaagggggcaggggaaagggagacccaggtagagggaacagcatgtgccataaccccggagtcagagggatgcctgggtcttaatctccacttgwcctacctcctaccccacagcctggagggacctccctcctacaagccaccgaccccaaaagcgaagctggaggcacaggagatggtgagcactttccctgg

SEQ ID NO: 72600 - DNA, 201 bp, Homo sapiens; identical to SEQ ID NO: 48202

SEQ ID NO: 72601 - DNA, 201 bp, Homo sapiens; identical to SEQ ID NO: 48204

SEQ ID NO: 72602 - DNA, 201 bp, Homo sapiens; identical to SEQ ID NO: 48206

SEQ ID NO: 72603 - DNA, 201 bp, Homo sapiens; identical to SEQ ID NO: 48208

SEQ ID NO: 72604 - DNA, 201 bp, Homo sapiens; identical to SEQ ID NO: 48210

SEQ ID NO: 72605 - DNA, 201 bp, Homo sapiens; identical to SEQ ID NO: 48212

SEQ ID NO: 72606 - DNA, 201 bp, Homo sapiens; identical to SEQ ID NO: 8958

SEQ ID NO: 72607 - DNA, 201 bp, Homo sapiens; identical to SEQ ID NO: 8959

SEQ ID NO: 72608 - DNA, 201 bp, Homo sapiens; identical to SEQ ID NO: 8963

SEQ ID NO: 72609 - DNA, 201 bp, Homo sapiens
ggcgtctcacatctcacctgttgatcccttagctttcttgccaaggatctagtgccccctgacctctggccaggccactgtcagttaacacatatgcattmcatttgtgatgtctaccttggtggctccactatgacccctaacccatgagcccagagaaattcaccgtgataatggaatcctggcaaccttatctcatga

SEQ ID NO: 72610 - DNA, 201 bp, Homo sapiens; identical to SEQ ID NO: 48217

SEQ ID NO: 72611 - DNA, 201 bp, Homo sapiens; identical to SEQ ID NO: 48218

SEQ ID NO: 72612 - DNA, 201 bp, Homo sapiens
ggagacccaggtagagggaacagcatgtgccataaccccggagtcagagggatgcctgggtcttaatctccacttgtcctacctcctaccccacagcctgsagggacctccctcctacaagccaccgaccccaaaagcgaagctggaggcacaggagatggtgagcactttccctggagcccaagctatccccacctccac

SEQ ID NO: 72613 - DNA, 201 bp, Homo sapiens
tttagggacctgaggagccccgggatcagccaagccagacttctcttgtgatcgggaaggcaactgaggcccaaggtcacggtgtcagcaaggtgtcagcraggttccttgggtatgggacccaaagcctccggatcccagcctggagcaattagagtagtagtagtggtggagatttatggagttctgttctggtgttca

SEQ ID NO: 72614 - DNA, 201 bp, Homo sapiens; identical to SEQ ID NO: 48219

SEQ ID NO: 72615 - DNA, 201 bp, Homo sapiens
ctggagctaaaagtagtctgggcaatgaagctcaaatgaatggggcagaggcatgatgggtaatgggagaggaatgaatgggccaaagatagaagccgcartgacgcgaggaacaagaggcatgatgggtaacgaaaggggtgggtctaaggcaactgtttcgctaagaggtgatgagggcattgtgggtaacgaggagca

SEQ ID NO: 72616 - DNA, 201 bp, Homo sapiens; identical to SEQ ID NO: 48220

SEQ ID NO: 72617 - DNA, 201 bp, Homo sapiens
gtgccataaccccggagtcagagggatgcctgggtcttaatctccacttgtcctacctcctaccccacagcctggagggacctccctcctacaagccaccraccccaaaagcgaagctggaggcacaggagatggtgagcactttccctggagcccaagctatccccacctccacacccaccccagggctgggaggggcct

SEQ ID NO: 72618 - DNA, 201 bp, Homo sapiens
ggagaagaatttactgttaacctggaagactactgaatcattttacccttgcccagtggaataggacctaaacatcccccttccggggaaagtgggtcatytgaattgggggtagcaattgatactgttttgtaaactacatttcctacaaaatatgaatttatactttgaccaggtcttgccttttctgtgggatgtgaa

SEQ ID NO: 72619 - DNA, 201 bp, Homo sapiens; identical to SEQ ID NO: 48223

SEQ ID NO: 72620 - DNA, 201 bp, Homo sapiens; identical to SEQ ID NO: 48225

SEQ ID NO: 72621 - DNA, 201 bp, Homo sapiens; identical to SEQ ID NO: 8953

SEQ ID NO: 72622 - DNA, 201 bp, Homo sapiens
gatctgcccgcctcggcctcccaaagtgctgggattacaggcgtgagccaccacgcctggctgatctttctttctttcttttttttttttttttaattttkgagatggcatctcactctattgcacaggctggagtggagtgatctcatctcactgcaacctctgcctcccgagttcaagcgattcttgtgcctcagcctc

SEQ ID NO: 72623 - DNA, 201 bp, Homo sapiens; identical to SEQ ID NO: 48228

SEQ ID NO: 72624 - DNA, 201 bp, Homo sapiens; identical to SEQ ID NO: 48232

SEQ ID NO: 72625 - DNA, 201 bp, Homo sapiens; identical to SEQ ID NO: 48229

SEQ ID NO: 72626 - DNA, 201 bp, Homo sapiens; identical to SEQ ID NO: 8956

SEQ ID NO: 72627 - DNA, 201 bp, Homo sapiens; identical to SEQ ID NO: 8957

SEQ ID NO: 72628 - DNA, 201 bp, Homo sapiens; identical to SEQ ID NO: 48233

SEQ ID NO: 72629 - DNA, 201 bp, Homo sapiens
acagagcgagactccatctcaaaaaaaaaaaaaaaaaattaaatttcttattttttgaaacaggatctctgttgcccacgttggagtgcagtggcgtgatyatagctcagtgtaaccttgaccttctgagctcaagtgatcctcctgcctcagcctcccaagtagctgggactataagcatgtgccatcatgcctggctac

SEQ ID NO: 72630 - DNA, 201 bp, Homo sapiens; identical to SEQ ID NO: 48234

SEQ ID NO: 72631 - DNA, 201 bp, Homo sapiens; identical to SEQ ID NO: 48235

SEQ ID NO: 72632 - DNA, 201 bp, Homo sapiens; identical to SEQ ID NO: 48236
  misc_feature (1)...(201): n = A,T,C or G, or insertion/deletion polymorphism (see Tables 1-2)

SEQ ID NO: 72633 - DNA, 201 bp, Homo sapiens; identical to SEQ ID NO: 48238

SEQ ID NO: 72634 - DNA, 201 bp, Homo sapiens; identical to SEQ ID NO: 8964

SEQ ID NO: 72635 - DNA, 201 bp, Homo sapiens; identical to SEQ ID NO: 48239

SEQ ID NO: 72636 - DNA, 201 bp, Homo sapiens
gtcccacagaggtgagcttcctttttcatccattcattgtatccttctaataacaaatttgtagccaaatgtcaagctaagacggcctcatcaggaaaagrtcacagctaccgagagcctggagatggggattgcatctctccgaggtgcactgggacacaaataattccttcatccagcaaacatccgccaaacccctgc

SEQ ID NO: 72637 - DNA, 201 bp, Homo sapiens
gccactggagaagtggctcagcaggagtgattttgaaacatcaggcaacatactacagtgggtgagacggtcacccactgaccatgagtgggtgagtcagmgcagtcttttttttttttttttttgagatggagtcttgctttatcacccaggttggagtgccgtggcacgatcttggctcactgcaacctccatctcctg

SEQ ID NO: 72638 - DNA, 201 bp, Homo sapiens; identical to SEQ ID NO: 48240

SEQ ID NO: 72639 - DNA, 201 bp, Homo sapiens
gcgcaattttaactgagattttcttttgtattaaaaaatgttttaagatggggtcttgctgtattggccaggctggtcttggaactcctggcttcaagcartcctcccaccttgaccttccaaagtgctgggatgacaggcgtgagccacctcgcctggccagggaaacagcttttcagcctgcaagtagtgcagtcggga

SEQ ID NO: 72640 - DNA, 201 bp, Homo sapiens; identical to SEQ ID NO: 48241

SEQ ID NO: 72641 - DNA, 201 bp, Homo sapiens; identical to SEQ ID NO: 48242

SEQ ID NO: 72642 - DNA, 201 bp, Homo sapiens; identical to SEQ ID NO: 48243

SEQ ID NO: 72643 - DNA, 201 bp, Homo sapiens; identical to SEQ ID NO: 48244

SEQ ID NO: 72644 - DNA, 201 bp, Homo sapiens; identical to SEQ ID NO: 48245

SEQ ID NO: 72645 - DNA, 201 bp, Homo sapiens; identical to SEQ ID NO: 8952

SEQ ID NO: 72646 - DNA, 201 bp, Homo sapiens
ctttttgagatgaagtcttgcactgtctcccaggctggagtgcagtggcacaatcacaatctcagcttactgcaacttccgcctcccgggttcaagcgatyctcctgcctcagcctcctgagtagctgggactacaggtgtgcaccaccacactcagctaatgtttgtatttttagtagagacagggtttcaccatgttgg

SEQ ID NO: 72647 - DNA, 201 bp, Homo sapiens; identical to SEQ ID NO: 48247

SEQ ID NO: 72648 - DNA, 201 bp, Homo sapiens
agtcccagctactcggagaggctgaggcaggagaatggcgtgaacccgggaggtggagcttgcagtgagccgagatagtgccactgcactccagcctgggygacagagcgagactccatctcaaaaaaaaaaaaaaaaaattaaatttcttattttttgaaacaggatctctgttgcccacgttggagtgcagtggcgtga

SEQ ID NO: 72649 - DNA, 201 bp, Homo sapiens; identical to SEQ ID NO: 48249

SEQ ID NO: 72650 - DNA, 201 bp, Homo sapiens; identical to SEQ ID NO: 48251

SEQ ID NO: 72651 - DNA, 201 bp, Homo sapiens; identical to SEQ ID NO: 48252

SEQ ID NO: 72652 - DNA, 201 bp, Homo sapiens
tttcctgtccccaactcacctggtgacatcaccccatcttctcatacactacagttgaaccacatgagccttttttgttggtttgtttttgtttttgagayggagtcttgctctgttgcccaggctggagtgctgtggtgcaatctcggctcactgcaacctctgcctccctggttcaagcgattctcctgcctcaggctc

SEQ ID NO: 72653 - DNA, 201 bp, Homo sapiens
tcttcgcacctgctttgctctgtgctgtctcagcttctctgtgtgccctcagtctcgtggcccccaacctcccttcccttctccacgtgtcttcctctccrgggctgcaccctaggagattgctcgatcgtggtggatttctcaactgtgaatcttcagtccctcttcccccttcatttctgtctctgcagatgtgttgtt

SEQ ID NO: 72654 - DNA, 201 bp, Homo sapiens
ggccatccaggtgagtggggcacggaggctgctgctcccctcggccaccgtgagcagggagccgccctcacaccccctcctctccacagacccagcagtcraagtttgtgaactggcaggtggacggggagtatcggggctctgacttcacagcagccgtcaccctggggaacccagacgtcctcgtgggttcaggtaaga

SEQ ID NO: 72655 - DNA, 201 bp, Homo sapiens
catggcagaaaacccaggagacagggaagctggaggtgcagcaggtgcagagaggcctcctaggtgaggctgatctgtaggggccccatgaggaagaaacmtttcctgtccccaactcacctggtgacatcaccccatcttctcatacactacagttgaaccacatgagccttttttgttggtttgtttttgtttttgaga

SEQ ID NO: 72656 - DNA, 201 bp, Homo sapiens
aaggggctaccccggctgggggacaggagcaagaagattccaggcagggagaagcaggaacaggggtgagggaagggaagggccatggcagaaaacccagsagacagggaagctggaggtgcagcaggtgcagagaggcctcctaggtgaggctgatctgtaggggccccatgaggaagaaacatttcctgtccccaactc

SEQ ID NO: 72657 - DNA, 201 bp, Homo sapiens
gcagactccaaagggggtaccactgggagggagtggacggggagaggaggttggattctggatgttgtttgaaggcagagctgccaggatttgttgagacyggatggaggcgatgactctgtagtttttggctggaactggaaggatggagtttcggattgccagctttgtgtctttgtgcagccatccactgtgtcgtgg

SEQ ID NO: 72658 - DNA, 201 bp, Homo sapiens
caatcggggagtccaactaccacttcggggtcacatatgtggggacaaagcagctgagtcccacagaggtgagcttcctttttcatccattcattgtatcyttctaataacaaatttgtagccaaatgtcaagctaagacggcctcatcaggaaaaggtcacagctaccgagagcctggagatggggattgcatctctccg

SEQ ID NO: 72659 - DNA, 201 bp, Homo sapiens
agagctgggctccctgatacttgaaaagactcggagatatagtgccagactgactactcagtttggggacctagaatccagaggtactgtctccccatagsagctaggctggagtgaaggaacaggtctgtgggcctaccggcagcacctcctttctctgagtctcttagtcaggccgtgcctcccagtcttcatcccctg

SEQ ID NO: 72660 - DNA, 201 bp, Homo sapiens; identical to SEQ ID NO: 8962

SEQ ID NO: 72661 - DNA, 201 bp, Homo sapiens; identical to SEQ ID NO: 48256

SEQ ID NO: 72662 - DNA, 201 bp, Homo sapiens
ccagagatcgtccccgccgtccccctccctgcatctgcacactcggcccaattactcctccctcaagagctgggctccctgatacttgaaaagactcggaratatagtgccagactgactactcagtttggggacctagaatccagaggtactgtctccccatagcagctaggctggagtgaaggaacaggtctgtgggcc

SEQ ID NO: 72663 - DNA, 201 bp, Homo sapiens; identical to SEQ ID NO: 48257

SEQ ID NO: 72664 - DNA, 201 bp, Homo sapiens
gttggagtggagtgtgacagcgtttctcttctccagagctgtttcccattcagatggagggtgtcaagctcacagtcaacaaagggttgagtaaccatttycaggtgagccttcctggtgtccttacccaccagagatcgtccccgccgtccccctccctgcatctgcacactcggcccaattactcctccctcaagagct

SEQ ID NO: 72665 - DNA, 201 bp, Homo sapiens
tctttacaggtggaatcctttgtgagatgttctgctgtgggtctctggagagagctgggggtggtagggaaggaagagatgagagttggtgtggggttggrgtggagtgtgacagcgtttctcttctccagagctgtttcccattcagatggagggtgtcaagctcacagtcaacaaagggttgagtaaccattttcaggt

SEQ ID NO: 72666 - DNA, 201 bp, Homo sapiens
tccatcacacactctgtgcagccaggaccctacacctacagccccactttctgtctgtaggctgcagcctaccccgctctgtctgtaaccttcaagaatayggctagtaactgatcacaaagccatgttttttctctatcatcagcaacttactatttcacagaatgtccaagatatatcatatgaaactgttgtttagta

SEQ ID NO: 72667 - DNA, 201 bp, Homo sapiens
atcatacatggtataagtgtcaaaaggcagatataaaaaaatttttgaaatcatctagtgaattaaagatatatatatatagaacaaagaaacaaataatggctatgttgtcataaggatgaatgaaatccagaaaataatggtgccacatctttaaagtgctaaacaaagaagaaaacacacacctctgtaactatgtgg

SEQ ID NO: 72668 - DNA, 201 bp, Homo sapiens
atactgtatatacaagatttattttccagatgtaataggaaaaaaaaaaaaaactaaattatttgcccaagaaatgcccacctattcaatatagttcataygtatatatatctaggcttaatttacaaatgaaaacttgtttgctactataaatcagagtgttaaaattagacttatttatatacctcactgaatctcaat

SEQ ID NO: 72669 - DNA, 201 bp, Homo sapiens
ttccccattcactttctcctctctctcctgtaccatgtaagatgtgcctgctccctcttcccctttgatcataagtttcctgaggcctcctagccatgcavaagggtgagtcaactaaacctctttcctttataaattacccagtctcgggtagtatctttacagcagtgtgaaaacggagtgatacagacagggtctcac

SEQ ID NO: 72670 - DNA, 201 bp, Homo sapiens
taaaggaaataaaatggaatactgaaaaatatttgtttaacataaaagtagacagaaaaggaagaatgggaacaaaaattttgtgacacaaatgggaaacwaatagcaaaacccaatcatattattaactatattaaatttagggactaaacacacagtaattgtcaggataaaaaatccatctattttactctttataag

SEQ ID NO: 72671 - DNA, 201 bp, Homo sapiens
gaagagacgccgggagcgacttatgaaaatatgcatcagtttaatactgtcttggaattcatgagatggaagcataggtcaaagctgtttggagaaaatcrgaagtacagttttatctagccacatcttggaggagtcgtaagaaagcagtgggagttgaagtcattgtcaagtgcttgcgatcttttacaagaaaatctc

SEQ ID NO: 72672 - DNA, 201 bp, Homo sapiens
atcaactggggttcctggaacatatcctctgtgaataaaggaggactactgtattagatatacaggaaagaaacaggaaaatgttgaccttattaaaaaargaagttgataaaagcagatcctgaggtgacccagatattgaaattagcatacaaggaagtcaacgtaagttctgtaaatatgtccgagaatataaaggaa

SEQ ID NO: 72673 - DNA, 201 bp, Homo sapiens
cctagccatgcagaagggtgagtcaactaaacctctttcctttataaattacccagtctcgggtagtatctttacagcagtgtgaaaacggagtgatacasacagggtctcactatgtggcccaggctggcctcaaactcctgggctcaagagatcctcccaccatagcttctttccagtagctgggattataggagcatg

SEQ ID NO: 72674 - DNA, 201 bp, Homo sapiens
acgccctagcacacatgcagctggagtcctagaaagagaaggaaaaacactggtcaaaaaacaggttttaaacaaaagcctaaaaaaaataagtaaaaataaaaaaaatagcctaaaatttcctaaatgtggaataaaatctcaatttatagttcctagaagctttgtgaatcaagcaaggtaagcttgaaagccaaacat

SEQ ID NO: 72675 - DNA, 201 bp, Homo sapiens
acgccggacaatagaatgttgtcggaccaatttatgtaaccagtatttgcaacccacatgccccctgttgtcataggtccgttttttgatggcagcattcsatggctggttttgctcatttctatggctgtctgcataattgctatgatcatcttctccagctgcttttgttacaaacattattgcaagagcatctcaagc

SEQ ID NO: 72676 - DNA, 201 bp, Homo sapiens
ccagggagaaaccacattagcttcagggtgtatgaaatatgaaggatctgattttcagtgcaaagattctccaaaagcccagctacgccggacaatagaaygttgtcggaccaatttatgtaaccagtatttgcaacccacatgccccctgttgtcataggtccgttttttgatggcagcattcgatggctggttttgctc

SEQ ID NO: 72677 - DNA, 201 bp, Homo sapiens
ttacaggtgcctgccaccatgcctggctaaattttgtatttttaatagagacagggtttcaccatgttggccaggttggtcttaaactcctgaccgcaagygacttgcctgcttcggccttccaaagtactgggattcctggggtgaaccactgtgcccggcctaatgagaatattttaaaatcagctagtaaattaaaga

SEQ ID NO: 72678 - DNA, 201 bp, Homo sapiens
ctctctatgacttcctgaaatgtgctacgctggacaccagagccctgcttaaattggcttattcagctgcctgtggtctgtgccacctgcacacagaaacktatggcacccaaggaaagcccgcaattgctcatcgagacctaaagagcaaaaacatcctcatcaagaaaaatgggagttgctgcattgctgacctgggcc

SEQ ID NO: 72679 - DNA, 201 bp, Homo sapiens
ttgttattaactacagtcaccatgctgtacaataaatatcttcaatgtattcctactatctaactgaaattttatattctttgaccaacatctcctcaagmtccattttccatatttgtatatagagtctaagcaataatcctaatattttctgtaattgacaagttgattctaaaattgtatagaaacacacacaaaaaa

SEQ ID NO: 72680 - DNA, 201 bp, Homo sapiens
cctgccaccatgcctggctaaattttgtatttttaatagagacagggtttcaccatgttggccaggttggtcttaaactcctgaccgcaagcgacttgccygcttcggccttccaaagtactgggattcctggggtgaaccactgtgcccggcctaatgagaatattttaaaatcagctagtaaattaaagatacattata

SEQ ID NO: 72681 - DNA, 201 bp, Homo sapiens
tctctctatgacttcctgaaatgtgctacgctggacaccagagccctgcttaaattggcttattcagctgcctgtggtctgtgccacctgcacacagaaaygtatggcacccaaggaaagcccgcaattgctcatcgagacctaaagagcaaaaacatcctcatcaagaaaaatgggagttgctgcattgctgacctgggc

SEQ ID NO: 72682 - DNA, 201 bp, Homo sapiens
tcagatcataaacatccagtgtagaaatcaaaaatataatatttaataaagctcaaatatttggaaattaacaaaaaataaatcacaagagaaattagaarttatgttaaataaatgacaatgaacataaagcattcctgaattcatgagaaacagctaaagaactgctagaaggaaatctatatttaaaagtttatatga

SEQ ID NO: 72683 - DNA, 201 bp, Homo sapiens
tcaaactttagggaacacatagtaatcaatacaaatcactaggcattgtaagcagttttatatctttagggcaacatacaagaattccttttttttcttcwgaaagacagtgatatggtttggctctgtgtccccacccaaatctcatttgaaattgtaatctccacgtatggagggagggaggagactggatcaaggggg

SEQ ID NO: 72684 - DNA, 201 bp, Homo sapiens
aacctgctgacatttgatttagaatatagtagttttgctatgttaatggagagtttcaaactttagggaacacatagtaatcaatacaaatcactaggcaytgtaagcagttttatatctttagggcaacatacaagaattccttttttttcttcagaaagacagtgatatggtttggctctgtgtccccacccaaatctc

SEQ ID NO: 72685 - DNA, 201 bp, Homo sapiens
aatctcatttgaaattgtaatctccacgtatggagggagggaggagactggatcaagggggcagctcccccatgctgtcctcatgatagtgagtgagttcktacaagatctgatggttttataaggggctcttccccattcactttctcctctctctcctgtaccatgtaagatgtgcctgctccctcttcccctttgatc

SEQ ID NO: 72686 - DNA, 201 bp, Homo sapiens
atgacagatgaatggaaatgatccaatctaaagaacggagaaagaaaaaaaattacttagcactgcctcagatacaatgaacgccctagcacacatgcagytggagtcctagaaagagaaggaaaaacactggtcaaaaaacaggttttaaacaaaagcctaaaaaaaataagtaaaaataaaaaaaatagcctaaaattt

SEQ ID NO: 72687 - DNA, 201 bp, Homo sapiens
actatgagctactatatgtaaaaccctgatgccaaataaacggtccatcacacactctgtgcagccaggaccctacacctacagccccactttctgtctgyaggctgcagcctaccccgctctgtctgtaaccttcaagaatatggctagtaactgatcacaaagccatgttttttctctatcatcagcaacttactattt

SEQ ID NO: 72688 - DNA, 201 bp, Homo sapiens
tttgtatatagagtctaagcaataatcctaatattttctgtaattgacaagttgattctaaaattgtatagaaacacacacaaaaaagcccctactatagacaatcttgaaaataaaaaataaagttggtacattatattacctaaattctagacttactaaagcaatgaagatagtatggtattagcacgcagagggaaa

SEQ ID NO: 72689 - DNA, 201 bp, Homo sapiens
taccttgccttttttcaagtgctattgctgagggcactgcccagatgatgctattaataacacatgcataactaatggacgttgctttgccatcatagaakaagatgaccagggagaaaccacattagcttcagggtgtatgaaatatgaaggatctgattttcagtgcaaagattctccaaaagcccagctacgccggac

SEQ ID NO: 72690 - DNA, 201 bp, Homo sapiens
tgccatcatagaagaagatgaccagggagaaaccacattagcttcagggtgtatgaaatatgaaggatctgattttcagtgcaaagattctccaaaagccyagctacgccggacaatagaatgttgtcggaccaatttatgtaaccagtatttgcaacccacatgccccctgttgtcataggtccgttttttgatggcagc

SEQ ID NO: 72691 - DNA, 201 bp, Homo sapiens
ttatcttacatcctcaaagatttaggtcagtttcaactacgaaatgttcctacttaccttttaatttgaagttcaactgtttacagaagctttcaaaattmttatttttttgtataaaacatttttgtatgaaaaagcaaaaaaataactctttatgaaagaaaaagcatactttacccctttgggtctgaagaagccatc

SEQ ID NO: 72692 - DNA, 201 bp, Homo sapiens
agttttcaggtgctaccaaccataaagtaaagagaattcagactttaagttaactacattagaaatgtttgatgaatacctggagttttccactaatctgycctaacaaagtatgaaagtaaactttcatgacttcatggtgatcactcagcaagtttattactaattagaaccaattcaaactcttcagaggaacataac

SEQ ID NO: 72693 - DNA, 201 bp, Homo sapiens
aattattcaatgatggcactgaatgattaacagctaggtaatctgtaatgaattactaccatatggaaatttctgtattagagcctgtgggtaaagaaaartatgtataatataattcctttcttttaatactaataacaactaaaacataggttttctcaatgccagacactgttctaaatgctccatatttgttgctac

SEQ ID NO: 72694 - DNA, 201 bp, Homo sapiens
gattctccaaaagcccagctacgccggacaatagaatgttgtcggaccaatttatgtaaccagtatttgcaacccacatgccccctgttgtcataggtccrttttttgatggcagcattcgatggctggttttgctcatttctatggctgtctgcataattgctatgatcatcttctccagctgcttttgttacaaacatt

SEQ ID NO: 72695 - DNA, 201 bp, Homo sapiens
cagaaacgtatggcacccaaggaaagcccgcaattgctcatcgagacctaaagagcaaaaacatcctcatcaagaaaaatgggagttgctgcattgctgayctgggccttgctgttaaattcaacagtgacacaaatgaagttgatgtgcccttgaataccagggtgggcaccaaacgctacctggctccagaagtgctgg

SEQ ID NO: 72696 - DNA, 201 bp, Homo sapiens
tcctagaaagagaaggaaaaacactggtcaaaaaacaggttttaaacaaaagcctaaaaaaaataagtaaaaataaaaaaaatagcctaaaatttcctaawtgtggaataaaatctcaatttatagttcctagaagctttgtgaatcaagcaaggtaagcttgaaagccaaacatagacacatcatagtttatttaactct

SEQ ID NO: 72697 - DNA, 201 bp, Homo sapiens; identical to SEQ ID NO: 51862

SEQ ID NO: 72698 - DNA, 201 bp, Homo sapiens
aaaagaaaaatggggcaaagaaaacaggaaaggcatctgtgagacccttgggtgagttcatgtctgagacctgttggcatcagcatggcgtgattgtccgyttcttgtgtgaggcatgtggcactggtagactgtgaccagtgctgctcacgatttgaatttgcccttcccaaagtcagactatgctgagggaggagaaaa

SEQ ID NO: 72699 - DNA, 201 bp, Homo sapiens; identical to SEQ ID NO: 51865

SEQ ID NO: 72700 - DNA, 201 bp, Homo sapiens; identical to SEQ ID NO: 51867

SEQ ID NO: 72701 - DNA, 201 bp, Homo sapiens; identical to SEQ ID NO: 51870

SEQ ID NO: 72702 - DNA, 201 bp, Homo sapiens
acccaggaggacggggctcctgcctgcttcatagagcaggaagcctgggtctgcagctgaggtttggaggactgaggtttgcagggctgcagcagcacctkggggagcccccaccccaactcagaagaggcgaagctcccactggctgcatggggcatgatagcaagcagccactgccattaataggaagctaatgaaatc

SEQ ID NO: 72703 - DNA, 201 bp, Homo sapiens; identical to SEQ ID NO: 51872

SEQ ID NO: 72704 - DNA, 201 bp, Homo sapiens; identical to SEQ ID NO: 51874

SEQ ID NO: 72705 - DNA, 201 bp, Homo sapiens; identical to SEQ ID NO: 51876

SEQ ID NO: 72706 - DNA, 201 bp, Homo sapiens; identical to SEQ ID NO: 51878

SEQ ID NO: 72707 - DNA, 201 bp, Homo sapiens
gtaggtggttctatcatgcagttagttttcagaaccattcacactgacagtaaaggctatttattcccagcagttgaaagaccactaaggacacaggaatrgttagcaaagctacttaaagatgccagggctggggccgggtgcgatggctcacgcctgtaatcccagcactttgggaggccaaggtgggcagatcatgag

SEQ ID NO: 72708 - DNA, 201 bp, Homo sapiens
caaacaaacaaacaaacaaacaaaatacaaaaaattagccggatgtggtggcaggcacctgtagtcccaactactcgggaggctgaggcagcagaatggcktgaacccaggaggcggagcttgcagtgagccgagatcacgccactgcactccagcctgggcgacagagcgaaactccatctcaaaaaaaaaaaaaaaaaa

SEQ ID NO: 72709 - DNA, 201 bp, Homo sapiens
tgaggcagcagaatggcttgaacccaggaggcggagcttgcagtgagccgagatcacgccactgcactccagcctgggcgacagagcgaaactccatctcaaaaaaaaaaaaaaaaaaaaaaaaaaagatgccagggctggctgggcacagtggctcacacctgtaaccccaacactttggtttgggaggccaaggcggat

SEQ ID NO: 72710 - DNA, 201 bp, Homo sapiens
acttgagatagtagcaacaagggtggaagtggaggccaaacctcaattcttaaaggaataaaagtgtggtaaacccttgtacatcttgttttcagtttaayctgtctccataacttattttttcttccttggcctacaaaactactgccaaaactacctgtaatatacatgtatattgatatgtaagcctatcagtcgtgc

SEQ ID NO: 72711 - DNA, 201 bp, Homo sapiens
gctgaggcaggacgatcattggaacccaggagtttgaggctgcagtgagtgaaagagtgagaccccatccctaaaatacacacacacacacacacacacaccccccaagtaaaatttcagctggaatataaatcgtgggtattatactgatttatggagagaattatgctaagtctttcagatgaggaaaacatataagaa

SEQ ID NO: 72712 - DNA, 201 bp, Homo sapiens
ctgaggcaggacgatcattggaacccaggagtttgaggctgcagtgagtgaaagagtgagaccccatccctaaaatacacacacacacacacacacacacmccccaagtaaaatttcagctggaatataaatcgtgggtattatactgatttatggagagaattatgctaagtctttcagatgaggaaaacatataagaaa

SEQ ID NO: 72713 - DNA, 201 bp, Homo sapiens; identical to SEQ ID NO: 51882

SEQ ID NO: 72714 - DNA, 201 bp, Homo sapiens; identical to SEQ ID NO: 51883

SEQ ID NO: 72715 - DNA, 201 bp, Homo sapiens
cccatccctaaaatacacacacacacacacacacacaccccccaagtaaaatttcagctggaatataaatcgtgggtattatactgatttatggagagaaktatgctaagtctttcagatgaggaaaacatataagaaatatcatgcaagaaaaaagaagcaaatatggaacaagaactgaaagaacacatacccgcgtga

SEQ ID NO: 72716 - DNA, 201 bp, Homo sapiens; identical to SEQ ID NO: 51887

SEQ ID NO: 72717 - DNA, 201 bp, Homo sapiens
atttccccagtgagctgacatttttgtgatcacgcaggccctgattcagtatggtttgcagtccttaaataggtcaaagcctctccacatagccctgtccygttgaagctcccattctcaagcttttctcccattgtgtgtttcagatgaagcaaatttgctgaatacagtgtcccctgcagccgataggcagtttgctct

SEQ ID NO: 72718 - DNA, 201 bp, Homo sapiens
gttgaaaagtcaggacagtgttgatggcagtgataaaaagtgaggctagagaaatcagttgagactcatttatcaagcgtgttaacagaagttttcatgtkattttataagtaatggtcttaggggatttttgggggtgttgattttcccgtatgcagacaagtgaagggtgaacaagacaaagatgagctatactaagcg

SEQ ID NO: 72719 - DNA, 201 bp, Homo sapiens
tagtgcttaatgctgagtgtgctgcaagctgggtttattttcatttctccccctcccttcttccctgattaattttataaagtttatagggatggtttccktagtggtgatgggttaaatcaaggaagaaatgtttacaaaccaaagttttggtaggaagtagcacctcctaccagcatgcagttcaacaacaaatgagaa

SEQ ID NO: 72720 - DNA, 201 bp, Homo sapiens
aaatcaataattgacactaggtggcaagtcaggatcaacaattactgtgttcccagcgtagttatgcatcttgatttgaagtgaggaatgggggagtactrtgataaggttagacacagactaatagcattctgaaagacatatactgatacataagacacgtatagcatatatcagattcatgccccagataccgagcag

SEQ ID NO: 72721 - DNA, 201 bp, Homo sapiens
gtttacaaaccaaagttttggtaggaagtagcacctcctaccagcatgcagttcaacaacaaatgagaacaaatgtggtggggtcgcgagcattttcatcmtgcatcatttattgccatgtatctgtatgattatcatctacttcacagggtagacatctgatggatcccattcttagccattaatttcacaaattattgt

SEQ ID NO: 72722 - DNA, 201 bp, Homo sapiens; identical to SEQ ID NO: 51900

SEQ ID NO: 72723 - DNA, 201 bp, Homo sapiens; identical to SEQ ID NO: 51977

SEQ ID NO: 72724 - DNA, 201 bp, Homo sapiens
agtccaagattatgaataatccactatcctgtatttaataaaagggtcagagaatctccatcctcagaattggatccagccatgcctgcagacgctcttayataaggcacatgagattcctgttgtaaatctcaatcacaagagagctgcatcagctggggcccagatttgcagggctccccaacaaatggacacaataga

SEQ ID NO: 72725 - DNA, 201 bp, Homo sapiens
agatagctagatagataatagataaataaggtagatgacagattagatacagatgataaacagatatgctatcagtctagatctattactcacagtcagtygtatcacagtgtaattccatcaacttcatttgcagcaaaagaacagcccctgatgtacgcctgtttcctgaatatttggaaatattaatattaatataga

SEQ ID NO: 72726 - DNA, 201 bp, Homo sapiens; identical to SEQ ID NO: 51981

SEQ ID NO: 72727 - DNA, 201 bp, Homo sapiens; identical to SEQ ID NO: 51983

SEQ ID NO: 72728 - DNA, 201 bp, Homo sapiens; identical to SEQ ID NO: 51985

SEQ ID NO: 72729 - DNA, 201 bp, Homo sapiens; identical to SEQ ID NO: 51902

SEQ ID NO: 72730 - DNA, 201 bp, Homo sapiens
tgtttcagatgaagcaaatttgctgaatacagtgtcccctgcagccgataggcagtttgctctacatatcccaagccttcattttgctctcaaaagcagtyctcctaaatacaaaatcatctacatcttttattagttgatatcagatttatcatactgcaaggtaacgcagaactatacagctttggagaggaacactaa

SEQ ID NO: 72731 - DNA, 201 bp, Homo sapiens
actgaatgaggttggcaaataaatatgtatttctagagactctataattgattccttcttcatttaatgcaaatttactccatgcgcacttactgcttttyattgtaccctgtatttgcaataaacaaataatggcatccaaattgaggtaagagcacctagcataaatttaggaacaattcacaacagcctcactactgc

SEQ ID NO: 72732 - DNA, 201 bp, Homo sapiens; identical to SEQ ID NO: 52002

SEQ ID NO: 72733 - DNA, 201 bp, Homo sapiens; identical to SEQ ID NO: 52014

SEQ ID NO: 72734 - DNA, 201 bp, Homo sapiens; identical to SEQ ID NO: 52017

SEQ ID NO: 72735 - DNA, 201 bp, Homo sapiens; identical to SEQ ID NO: 52019

SEQ ID NO: 72736 - DNA, 201 bp, Homo sapiens; identical to SEQ ID NO: 52021

SEQ ID NO: 72737 - DNA, 201 bp, Homo sapiens
gtttattttagcaccaggtaaaatgactggcctgtctagatagaagctccgtattgcagaaaggtgaaaatttatcaatcaatcaattaattaataagttwtgtttaggtgggagtcataatattacgacaatttcatggaattagaaatgcttaacttctggtccaaaatctgccactgaccatttgtatgactttgggt

SEQ ID NO: 72738 - DNA, 201 bp, Homo sapiens; identical to SEQ ID NO: 52022

SEQ ID NO: 72739 - DNA, 201 bp, Homo sapiens; identical to SEQ ID NO: 52024

SEQ ID NO: 72740 - DNA, 201 bp, Homo sapiens; identical to SEQ ID NO: 52046

SEQ ID NO: 72741 - DNA, 201 bp, Homo sapiens
agggctggggccgggtgcgatggctcacgcctgtaatcccagcactttgggaggccaaggtgggcagatcatgaggtcaggagatcgagaccatcctggctaacacaatgaagccccgtctctacaaacaaacaaacaaacaaacaaaatacaaaaaattagccggatgtggtggcaggcacctgtagtcccaactactcg

SEQ ID NO: 72742 - DNA, 201 bp, Homo sapiens; identical to SEQ ID NO: 51922

SEQ ID NO: 72743 - DNA, 201 bp, Homo sapiens; identical to SEQ ID NO: 52047

SEQ ID NO: 72744 - DNA, 201 bp, Homo sapiens
tcaggagatcgagaccatcctggctaacacaatgaagccccgtctctacaaacaaacaaacaaacaaacaaaatacaaaaaattagccggatgtggtggcrggcacctgtagtcccaactactcgggaggctgaggcagcagaatggcttgaacccaggaggcggagcttgcagtgagccgagatcacgccactgcactcc

SEQ ID NO: 72745 - DNA, 201 bp, Homo sapiens; identical to SEQ ID NO: 51928

SEQ ID NO: 72746 - DNA, 201 bp, Homo sapiens; identical to SEQ ID NO: 52055

SEQ ID NO: 72747 - DNA, 201 bp, Homo sapiens; identical to SEQ ID NO: 52059

SEQ ID NO: 72748 - DNA, 201 bp, Homo sapiens; identical to SEQ ID NO: 52057

SEQ ID NO: 72749 - DNA, 201 bp, Homo sapiens; identical to SEQ ID NO: 52062

SEQ ID NO: 72750 - DNA, 201 bp, Homo sapiens; identical to SEQ ID NO: 52061

SEQ ID NO: 72751 - DNA, 201 bp, Homo sapiens
ctgagcttgcgaacaggagtgtgggagggaccttcctgggcccatgagggtgcacactgcagagatgcccaggtcctgcgccaggggagctcccacctcgscaacttgaaaggggggaggttcccacgtgtccctggctcctgcctgctccgtggagcgcgaggcccaggtctgcagctgaggattgggcagctgcagctg

SEQ ID NO: 72752 - DNA, 201 bp, Homo sapiens
atgaactctgtaggtggttctatcatgcagttagttttcagaaccattcacactgacagtaaaggctatttattcccagcagttgaaagaccactaaggacacaggaatggttagcaaagctacttaaagatgccagggctggggccgggtgcgatggctcacgcctgtaatcccagcactttgggaggccaaggtgggca

SEQ ID NO: 72753 - DNA, 201 bp, Homo sapiens; identical to SEQ ID NO: 52069

SEQ ID NO: 72754 - DNA, 201 bp, Homo sapiens; identical to SEQ ID NO: 52070

SEQ ID NO: 72755 - DNA, 201 bp, Homo sapiens; identical to SEQ ID NO: 52072

SEQ ID NO: 72756 - DNA, 201 bp, Homo sapiens
atgtcagggcttatgttgaaccttaactgagagcaagattcaaaagacactgaggcttatttttctttcttatatctatagttacacagggagctgtctartcttggatgtatccaagttgatatctggttttatccattgaaacccacagtgaaaatggtaaataggtgctaggtgtttggatttttttaatccaatgta

SEQ ID NO: 72757 - DNA, 201 bp, Homo sapiens
ccttttctttcactcttctgcaagacaaccccataagaaagctgaaacctgcttttgtgaaagcctatgattactataagacaggtgagcaaaacagaatmctagataaactcagttctttccagtgtggtgtctttgatggaaaaataaaataaaagccaatgtgtttggggtttttttcttttttactttatatagatt

SEQ ID NO: 72758 - DNA, 201 bp, Homo sapiens
cccttaactacttctcagtgctactcagctgtgaggaaggagacggctgtctcttcttttgagatatcagatgatggtgggaggctgaatgcagaaggacrgatgtgttcaaaagaagagaaagtatgtaaaagcaaagcagaaaaaagaaaaatggggcaaagaaaacaggaaaggcatctgtgagacccttgggtgagt

SEQ ID NO: 72759 - DNA, 201 bp, Homo sapiens
atgtccatgtgtacaaattatttagctcccacttataagtgagaatgtgaagtatttgacctcctgtttctgagttatttcacttgagatagtagcaacawgggtggaagtggaggccaaacctcaattcttaaaggaataaaagtgtggtaaacccttgtacatcttgttttcagtttaatctgtctccataacttattt

SEQ ID NO: 72760 - DNA, 201 bp, Homo sapiens
actggtagactgtgaccagtgctgctcacgatttgaatttgcccttcccaaagtcagactatgctgagggaggagaaaaggtaacacctacaaaacttctkgcttagagtctctttatttaaagattatgtggccctaccttctttcttcccagagtagagaaagaaaagagcctctcagtgtcctcgaaagagccaatag

SEQ ID NO: 72761 - DNA, 201 bp, Homo sapiens
aagtgagaatgtgaagtatttgacctcctgtttctgagttatttcacttgagatagtagcaacaagggtggaagtggaggccaaacctcaattcttaaagsaataaaagtgtggtaaacccttgtacatcttgttttcagtttaatctgtctccataacttattttttcttccttggcctacaaaactactgccaaaacta

SEQ ID NO: 72762 - DNA, 201 bp, Homo sapiens
atgccaccttcgtgcatagtgctgtatttggtgggaaacgaaggaacagagaacatcctgttgattggtctctgactcttaatactctgatatttttgtckaattgcaatgaaaagatctaagtaaggcttaggacagaaaacagagcagttctcaattggggcctatgctaaaagagttagacatggtttaatgttgaaa

SEQ ID NO: 72763 - DNA, 201 bp, Homo sapiens
ccctggccattgtctcatcaacattataacaaaacgaggttgaacaggaacaatcttattggaggacctgctgtacaggaacaagttttctaaggagattwaaaaaatgtagaagcacaaaagagatagaagggttaattttttaaaaggcaatactgagtatctaccatctgcctggcactgctttaagcatttttctgg

SEQ ID NO: 72764 - DNA, 201 bp, Homo sapiens
tcatggaaaattttcctgaaaaatgggctataaggatattccacttcttaaaactgtatttcttaccgcttagggagagccaaaatgctttgcaccaatgygacacgttttagaccaactgaaagtctacaaagagctctattttaataattaagtctactgtagatttcaggttcagcttcctacgaagattttttttct

SEQ ID NO: 72765 - DNA, 201 bp, Homo sapiens
actggactgggggaccaggtcgatgggatggccgaatggggccaggctctgtgcctcggtctgtacgctgtgatcgttctgtgccaatggggccagggggyagaggctgctcccggggcagctcctggattgggcacacagtaaagtgcattgggggagggaaagggaaatccaaattggaatgcccagaacacacacgca

SEQ ID NO: 72766 - DNA, 201 bp, Homo sapiens
aaagtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcc

SEQ ID NO: 72767 - DNA, 201 bp, Homo sapiens
ggaaagtccacatccctattccgtttcaccttccagttgggggagtccgtgatgatccaggtcccccaaggttgctgctcagtttttgataatcctggaayggctttagttccactggatgcagctgaggggaaaaaaatcatgagctgcctaccttgaaatacagaatccctactcccaagtcttggcgctccctagccc

SEQ ID NO: 72768 - DNA, 201 bp, Homo sapiens
ggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggg

SEQ ID NO: 72769 - DNA, 201 bp, Homo sapiens
ggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtc

SEQ ID NO: 72770 - DNA, 201 bp, Homo sapiens
ctcccaaggcttaggtatccagcgcagggcatctggtggggaggcctaggggacaggcatgtgttaaagagtgagtcacagtgagaggtcagcgatgagayggaaggacaggaaatcaggtggcaactcgaatttagagttggggccacaagggtttctccttcacctgctggtaaaggtcgacgcgctgggtgcggaaga

SEQ ID NO: 72771 - DNA, 201 bp, Homo sapiens
ctatcggggaaacggaagtggccgtcggtggcaggtttgggggagaccggaagtgacggtccgtggggaagtcgggggcggagccgcggggtggtgggtgkgtgtgtgtgtgtgtgtgtgtgtgtgtgtgtgtgtgtgtttggctgtgggttagttgtgccgttctgctggaacaccgtgggaaggcagtagacgcgggca

SEQ ID NO: 72772 - DNA, 201 bp, Homo sapiens
ctcaagggagggtgagggctgggaagaaccaaccttcagttctgagatctgtgctcccttcagtcaggtggtagatccatttccggggcacacagagcccrtctttcctgcagaggtggtggtggcaaggaggaaagaatgagcatcaccccaaccatagtgtcccagcttcttttttttttttttgagacagagtctcac

SEQ ID NO: 72773 - DNA, 201 bp, Homo sapiens
aagggacaggcatggctctggcctttgggaagggaaacagcacaggaaccctaagcaagtgtgtcttactgatagacattggtcaggtctatgctgtgttyttaaagggtagaaatcagaacccataatggagataggtccttgatagactgttgagtgaaattactaatttttatggcatagcttgagtctcttgagctt

SEQ ID NO: 72774 - DNA, 201 bp, Homo sapiens
cctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaag

SEQ ID NO: 72775 - DNA, 201 bp, Homo sapiens
tccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccttccttccttcgttcttctttagag

SEQ ID NO: 72776 - DNA, 201 bp, Homo sapiens
cttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagtt

SEQ ID NO: 72777 - DNA, 201 bp, Homo sapiens
tgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcg

SEQ ID NO: 72778 - DNA, 201 bp, Homo sapiens
ggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagc

SEQ ID NO: 72779 - DNA, 201 bp, Homo sapiens
atcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggag

SEQ ID NO: 72780 - DNA, 201 bp, Homo sapiens
tggacaccccaacagcgatgtgtctttctggaggactcgcagtttcgcggggccgaggcccttggcccagggcaggttaagagaagagggcacggagaggmggtaatgcctccacccccggccttcggaagcacgctggccggcctttaaattccccacggtcagggtcttgtctttctgtccactcggactccatttgct

SEQ ID NO: 72781 - DNA, 201 bp, Homo sapiens
aggcagtgtgggggaagcactgaagcctgtagtccccacttgggggctaggggtttgctcactcagcaataaataactgtgtcacatcaaatcctaaatawaccactacaaagtgagagttactgccactctgttcttactgacaccgtccagctgggagtttaggtggtagaggatccagggggaatgttgaaatgggag

SEQ ID NO: 72782 - DNA, 201 bp, Homo sapiens
cagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtgg

SEQ ID NO: 72783 - DNA, 201 bp, Homo sapiens
tttttttttttaaatccttttattactcttttttaacaaacagccccagggacaggggaccaggggaagggggaggaggggaagtgaggccccagccccasaacccctccccgcccacccctttcccccttatatatttataatctatatacaagccccgggggtagggggcaagaggaactccctcagcggggtgggggc

SEQ ID NO: 72784 - DNA, 201 bp, Homo sapiens
ccgagggctgaggcttgcgatttagttaaaaaacaaacaaaatttgggtgaccagtatattagagtttattaatactgttctattttggtgtaatgtttgmatttttttttttttttttttgagatgggagtctcgttctgttgcccaagctggagtgcagtggcgcgatcttggctcactgcaatctccacctcccgggt

SEQ ID NO: 72785 - DNA, 201 bp, Homo sapiens
atgtctgttttttcatctgtaaaattggcaaatcatcaatcttataggattaaatgaaataatgcacataaagcccttagcaaagacttgcacatggtaaktccaaagtatatatttgctataattaatagtaatgtttgcaaagcacttagtttctggtgggtaataagttctcaaataataggcagtaagaattgccaa

SEQ ID NO: 72786 - DNA, 201 bp, Homo sapiens
tgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccat

SEQ ID NO: 72787 - DNA, 201 bp, Homo sapiens
gcaaaactctgtctctacaaaaaatacaaaaattagccgatgtggtggcacacgcctgtagtcccagctactagggaggctgaggagggaggattgcttgrgcctgggatgtcgaggctgcaatgagccctgattgtgccactgcactccagcttgggcgacagagactctgtctccaaacaaacaaaacaccaccaaccc

SEQ ID NO: 72788 - DNA, 201 bp, Homo sapiens
gaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttc

SEQ ID NO: 72789 - DNA, 201 bp, Homo sapiens
gtccttctaagggttcctatgcatacagatgcacagactggaaagcaaagaaccagcaatgaatacataggtgggtgttcttgactctaacaccctaccarccgctttccagttgccttagccagacatggaaatcctactgacattctagagcccatggcccctcaggccacaatctccactccacccaaacttatcttt

SEQ ID NO: 72790 - DNA, 201 bp, Homo sapiens
agagtggggtgacacagggtgtggggacaacaagggagacacatgggagactaatactgagaattctggagtaaaaacacagtgaaagaaacaggaaagaraacagagaaaacataacccagaagaattttcacgagtaagagtgcagtgaagcacaatctcaaacccatcccttacctcctgtagcagctctggttttct

SEQ ID NO: 72791 - DNA, 201 bp, Homo sapiens
ttcacagtatttaagaaataaaagtcggatttttctggctgctttctctctacattgtctccattaggtagtgtgtcccttaatcttgtgtgaactttttwaaattaatacttccttggaacactgttgtgttctactcagcacgctaaattgtacaagccagttttgatgtttgtttttttttttttttgagacagagta

SEQ ID NO: 72792 - DNA, 201 bp, Homo sapiens
ctgctcgccccaagctagcggggaagggcctggcaggtgaaggcagcacccgagtagcaggagcaggtgggggccgcacagccaggctggggggctgcagrgcagggcccacaggtaacagagaaaggggaggtggggcaggaggtggtgctggcggcagggagccaaagttcaccacaggcagctgtgagtctaccatgg

SEQ ID NO: 72793 - DNA, 201 bp, Homo sapiens
gtttttttttttaaatccttttattactcttttttaacaaacagccccagggacaggggaccaggggaagggggaggaggggaagtgaggccccagccccrcaacccctccccgcccacccctttcccccttatatatttataatctatatacaagccccgggggtagggggcaagaggaactccctcagcggggtggggg

SEQ ID NO: 72794 - DNA, 201 bp, Homo sapiens
agctagacctcttggaacatgagctcacggacatttaacaggcctgctggagagtccatgtgaagacactggttgataacccagtaatgttacagatgtcycaccaaggccctagatatgcaaaggaagccatattgggaccagcccaggtgtcagctgcagactgataaccagttgacctcgctcactggcacaaaaaag

SEQ ID NO: 72795 - DNA, 201 bp, Homo sapiens
gagggcccttctcgaggtggcggccctgtccgctcccaaggcttaggtatccagcgcagggcatctggtggggaggcctaggggacaggcatgtgttaaasagtgagtcacagtgagaggtcagcgatgagacggaaggacaggaaatcaggtggcaactcgaatttagagttggggccacaagggtttctccttcacctg

SEQ ID NO: 72796 - DNA, 201 bp, Homo sapiens
tccatattttcttggttcctgctttcctggaatggggctgctgtagtgtcttgtgtcttcaggtttcagcttttttttttttttttttttttttttttgaratggagtctcactctgttgctaggctggagtgcagtgtacaatcttggctcactgcaacctctgcctcccgggttcaagtgattctcctgcctcagcctc

SEQ ID NO: 72797 - DNA, 201 bp, Homo sapiens
ctggcaggtgaaggcagcacccgagtagcaggagcaggtgggggccgcacagccaggctggggggctgcagagcagggcccacaggtaacagagaaagggraggtggggcaggaggtggtgctggcggcagggagccaaagttcaccacaggcagctgtgagtctaccatgggtagaagcatctgtaacaagaaatttggg

SEQ ID NO: 72798 - DNA, 201 bp, Homo sapiens
gcagccagtccttgtgggtgagttttcattcttccccactcagagtttaaactcctttcctagtctgctcactggcactttccagttctttccatattttsttggttcctgctttcctggaatggggctgctgtagtgtcttgtgtcttcaggtttcagcttttttttttttttttttttttttttttgagatggagtctc

SEQ ID NO: 72799 - DNA, 201 bp, Homo sapiens
tttccctccctggaaaaacattgcaacagggccaggtgcagtggctcacgcctgtaatcccagcactttgggaggccaaggtgggcggatcatctgagatygggagtttgagaccagcctggccaacatggtgcaaccccatctctactgaaaatataaacattagctggatgtagtggtgcacacctgtaatcccagcta

SEQ ID NO: 72800 - DNA, 201 bp, Homo sapiens
aggttcatgctgaggtgtgagggaacagggtggggaagggagaggcacatgctggtggtggtagcctggggaccagagcagaagcttaagtagacagatgwggggggtgtgggggttggtttgtctttggaggtgtgtttgtgtggtgaagggagtacctctccctgtttagatggagggaaaggcaggctttctgattgg

SEQ ID NO: 72801 - DNA, 201 bp, Homo sapiens
ccatacgaccgtccatagcccctctcgaggcagtggtagagtcccagctggtgactgtttttcaggcatttacggtagccacctcaatcttctagcgctcmagcgcgcgcacagacgtgaacgccgccagaggggggagggggtggggcgatgcttaagtgtccacgcatccgtagtgcgacgcacgcaggcgtagtacgg

SEQ ID NO: 72802 - DNA, 201 bp, Homo sapiens
ccaggagacggagcttgcagtgagctgaggtcgcaccactgcactccagcctgggtgatagagcgagactctgtctcaaaaaaaaaaaaaaaaaaaaaaamcaaaaattagccgggtgtggtggcaggcaacttaatcccagctacttgggaggcagaggcaggagaatcgtttgaacctgggaggcggaggttgaagaga

SEQ ID NO: 72803 - DNA, 201 bp, Homo sapiens
ccacacacttttcgggaggatgtggtgagcgatctggaagggcaaggtggggtcaggccagtcaaaacccctggaagcacctagctcttcctgggagggtrtcataggacccagagtgaggagttctcctgccctcccttgtttccctccaacccttcctgccttgtatccctactcactgtagaggagaaagcgctggta

SEQ ID NO: 72804 - DNA, 201 bp, Homo sapiens
caaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggt

SEQ ID NO: 72805 - DNA, 201 bp, Homo sapiens
gtaatctcagcactttgagaggccaaggtgggcggatggcttgagcccaggagttcaaaaccagcctgggctacatggcaaaactctgtctctacaaaaartacaaaaattagccgatgtggtggcacacgcctgtagtcccagctactagggaggctgaggagggaggattgcttgagcctgggatgtcgaggctgcaat

SEQ ID NO: 72806 - DNA, 201 bp, Homo sapiens
aacactcacacccccttcctctcttcctttcccaagatggtctccagtcatcctaggccatccacccaagtccctcagagcctccaccataggcttccccyaatctcagtccatacctccttcccatccacgcccagagttgtcagttgactgtgctcagggcactggtagatggagttaaggataataccatagaagtag

SEQ ID NO: 72807 - DNA, 201 bp, Homo sapiens
cccagtctctgggacactggtgagcaagggtcggggagttctagtgcgtaacagtctagggagagactcctgtggtggtgcatggaagggcaggtctgaarttctcccttgctctctatccagcagggcgccggtctgggtaccaatgcctcgttggcccagatggtgagcggccttgtggggcagcttcttatgcagcca

SEQ ID NO: 72808 - DNA, 201 bp, Homo sapiens
agaacccatcctgcctccctcaggtgacatcacagctcttagccacatccctctggtgacatcacacgagcctctttcaccctgtaacaccagaagacttkgtgagtcctaatcctgttttatgagattttaaccccttaccttgattcctaggagtcaataagaaggctttggagtccaggcaggaagtcagggacttga

SEQ ID NO: 72809 - DNA, 201 bp, Homo sapiens
tgcagtggtgcaatccagtgagttaaagctcactgtaaccttgaactcctgggctcaaacagttctcccacctcagcctcctgagtagctagcagtactakctcctggctagtaattgtctttttttttttctggtagagatggggtcttgctatgtggcctagactcctgggctcaagcagttctcatgccttggcctcc

SEQ ID NO: 72810 - DNA, 201 bp, Homo sapiens
agcacaggaaccctaagcaagtgtgtcttactgatagacattggtcaggtctatgctgtgtttttaaagggtagaaatcagaacccataatggagataggkccttgatagactgttgagtgaaattactaatttttatggcatagcttgagtctcttgagcttaaagccttggacatagctatctgtgtctttactcctgt

SEQ ID NO: 72811 - DNA, 201 bp, Homo sapiens
gagagttactgccactctgttcttactgacaccgtccagctgggagtttaggtggtagaggatccagggggaatgttgaaatgggaggagtgggaatgacrtctggagacaaaccccagaatgagatgaggattgaaaaattatctttattatcttgagtgggagctggagctggaagtctccagcttctccctccaacaa

SEQ ID NO: 72812 - DNA, 201 bp, Homo sapiens
aggctggtctcgaactccttacctcaggtgatgtgccctcctcggcctcccaaagtgctggtattacaggcatgagccaccgcacctggcctcagattttmtttttattgatccctttgttcgtattccagtagaacgttttctgatgttttgtgagtgaggctgattttgttctgtcctccacatggatagaacttaatg

SEQ ID NO: 72813 - DNA, 201 bp, Homo sapiens
ggtgtgaacccaggagacggagcttgcagtgagctgaggtcgcaccactgcactccagcctgggtgatagagcgagactctgtctcaaaaaaaaaaaaaamaaaaaaaaacaaaaattagccgggtgtggtggcaggcaacttaatcccagctacttgggaggcagaggcaggagaatcgtttgaacctgggaggcggagg

SEQ ID NO: 72814 - DNA, 201 bp, Homo sapiens
gccggcaacttccccagctctgtagcttgcattgtggagaaatccagaaactggcccttgagagctaccccagagagcagtgctgagggaggggctgggcyggggggtaggtataggggctgtgatctgaaaataaattgtggggagaaaagctgttaggaagccagagtcctagcaatgccttaagtccactagcttcta

SEQ ID NO: 72815 - DNA, 201 bp, Homo sapiens
ctagttaagtcagggtagaaagcaccccaatacctgactgatgcacacatacaaactgcagaaaggggacagccaagtgagagaacagctccagactcaamccagagcaggtggggggtatgaccagtgctcaaaaaagtcccagctcagacacaccctcccaccctcactcacttctgtgccagccacatcctcaaaagg

SEQ ID NO: 72816 - DNA, 201 bp, Homo sapiens
tggctaacatgatgaaaccccgtctctactaaaaatacaaaaaattagctgggcatggtggcgggcacctgtagtcccagctactcgggaggctgagtcasgagaatggtgtgaacccaggagacggagcttgcagtgagctgaggtcgcaccactgcactccagcctgggtgatagagcgagactctgtctcaaaaaaaa

SEQ ID NO: 72817 - DNA, 201 bp, Homo sapiens
tcaggatacccagatccagcccacacagaccttgtcactagtgccaaactggactgggggaccaggtcgatgggatggccgaatggggccaggctctgtgsctcggtctgtacgctgtgatcgttctgtgccaatggggccagggggcagaggctgctcccggggcagctcctggattgggcacacagtaaagtgcattgg

SEQ ID NO: 72818 - DNA, 201 bp, Homo sapiens
tgtggtgagcgatctggaagggcaaggtggggtcaggccagtcaaaacccctggaagcacctagctcttcctgggagggtgtcataggacccagagtgagkagttctcctgccctcccttgtttccctccaacccttcctgccttgtatccctactcactgtagaggagaaagcgctggtaaccctggcctgtctcattca

SEQ ID NO: 72819 - DNA, 201 bp, Homo sapiens
gagcttgattttctggtcaccagattttctttttttttcttttttttgagatggagtcacgccctgtcttccaggctggagtgcagtggcgcgatctcgaytcactgaaacttccacctcttgggttcaagcgattttcctatctcagcctcctgagtagctgggattataggcgtgtgccactatacccagctgattttt

SEQ ID NO: 72820 - DNA, 201 bp, Homo sapiens
gtgcatctgtggtccctactagggaggctgaggtgggaagatcggttgggctcgggaggcagaggctacagtgagttgtgattgcgccactgcactccagsctgggcgacaaagcgagaccctctctcaaaaaaataagctaaaatgttaacagctttttattggggcagtaaagtacaagtgctcgatctggagtcctgt

SEQ ID NO: 72821 - DNA, 201 bp, Homo sapiens
acgccaggctaatttttgtatttttagtagagatggggtttcaccattttggccaggctggtcttgaactcctgacctcgtgatccacccgcctcatcctyccaagtgtgagtcactgcgcccggccgaaaatttttgtaataaaaagctaaaatgtggttaggcacagtagctcacacctataatcccagcactttggga

SEQ ID NO: 72822 - DNA, 201 bp, Homo sapiens
tttattaatactgttctattttggtgtaatgtttgaatttttttttttttttttttgagatgggagtctcgttctgttgcccaagctggagtgcagtggcrcgatcttggctcactgcaatctccacctcccgggttcaaagcaattctctgcctcagcctcccaagtagctgggattacaggcgcccgccaccacgccag

SEQ ID NO: 72823 - DNA, 201 bp, Homo sapiens
ccagggaaaatcaaagccagcaactggacagagaaatcaaatgaaggggaagtgtgaagatacaatatacctgctgggcaggagcccctgaagggagaaakccactttggccaccaggctgcagaggagtagaataaaaatccgaaggggatggcagatcctggcgtacctgtcgggaaacagggagaaatatatcaaccc

SEQ ID NO: 72824 - DNA, 201 bp, Homo sapiens
tagagtttattaatactgttctattttggtgtaatgtttgaatttttttttttttttttttgagatgggagtctcgttctgttgcccaagctggagtgcaktggcgcgatcttggctcactgcaatctccacctcccgggttcaaagcaattctctgcctcagcctcccaagtagctgggattacaggcgcccgccaccac

SEQ ID NO: 72825 - DNA, 201 bp, Homo sapiens
ttagtagagacagggtttcaccatattggccaggctggtctcgaactcctgaccttgtgatccacccgccttggcctcccaaagtgctggaattacaggcstgggccaccgcgcccagcctgatgtttgtattttttgtgcgaaagcactttatatataaataaaaaacctgtattttgagttgggagcatattccaggtg

SEQ ID NO: 72826 - DNA, 201 bp, Homo sapiens
cggcccaccttagcctcctaaagtgttgggattacaggcatgagccaccacacctagcttgataaatttatatcccatggactgccacaaaaaatttgccragggctgaggcttgcgatttagttaaaaaacaaacaaaatttgggtgaccagtatattagagtttattaatactgttctattttggtgtaatgtttgaat

SEQ ID NO: 72827 - DNA, 201 bp, Homo sapiens
tgctgggaggtgggggaggcaggggaagccccgggggacgctcctctggaggacgactggagaaaacagagcattagctccagtatccactaaatcgttaytttttcccacaagttatgtttcccaacttctgcttacaacctattctcttccctattaaagtccaggtgtttttgagtccttctaagggttcctatgcat

SEQ ID NO: 72828 - DNA, 201 bp, Homo sapiens
cacatctccaagtacttctgtgatccacaggcatcgagtcttacctgtaagggtgcagtgagggtgtcccagggcggaagcctccactgtttggatgtaaytgagagtccatggctcccccagagatctgcaggagaggagcacggttgaaacagctttagtatctgtggtcaagaaaaaagatcaccatcccacccatag

SEQ ID NO: 72829 - DNA, 201 bp, Homo sapiens
aagatcaccatcccacccatagaagcaaaaagtagggagaaaaatgatgtgacaaagtggtatctcacaactctgcaacgtagaaaggcttgattataaayacataccaggcagaaaaaaattattattcactgaaggggtcatgcaatgggaagcggggcctacctgagaactggaaggcccagcactgccatagaaaac

SEQ ID NO: 72830 - DNA, 201 bp, Homo sapiens
ctggaggacgactggagaaaacagagcattagctccagtatccactaaatcgttactttttcccacaagttatgtttcccaacttctgcttacaacctatyctcttccctattaaagtccaggtgtttttgagtccttctaagggttcctatgcatacagatgcacagactggaaagcaaagaaccagcaatgaatacata

SEQ ID NO: 72831 - DNA, 201 bp, Homo sapiens
ccggcaacttccccagctctgtagcttgcattgtggagaaatccagaaactggcccttgagagctaccccagagagcagtgctgagggaggggctgggccsgggggtaggtataggggctgtgatctgaaaataaattgtggggagaaaagctgttaggaagccagagtcctagcaatgccttaagtccactagcttctag

SEQ ID NO: 72832 - DNA, 201 bp, Homo sapiens
gatccagcccacacagaccttgtcactagtgccaaactggactgggggaccaggtcgatgggatggccgaatggggccaggctctgtgcctcggtctgtaygctgtgatcgttctgtgccaatggggccagggggcagaggctgctcccggggcagctcctggattgggcacacagtaaagtgcattgggggagggaaagg

SEQ ID NO: 72833 - DNA, 201 bp, Homo sapiens
aaaacataacccagaagaattttcacgagtaagagtgcagtgaagcacaatctcaaacccatcccttacctcctgtagcagctctggttttctgggaggcygctcccgacgtttagggggaaagggactaaccccggcagagtcccgaggagtcccacccacccctctcaccattggccccggctcctcaaagtgggggtc

SEQ ID NO: 72834 - DNA, 201 bp, Homo sapiens
gcaagaggaactccctcagcggggtgggggcaacccaggctccttgtcccctcgggacccaggctcctctgcccgtcgggagggcccttctcgaggtggcrgccctgtccgctcccaaggcttaggtatccagcgcagggcatctggtggggaggcctaggggacaggcatgtgttaaagagtgagtcacagtgagaggtc

SEQ ID NO: 72835 - DNA, 201 bp, Homo sapiens
ctaaatcgttactttttcccacaagttatgtttcccaacttctgcttacaacctattctcttccctattaaagtccaggtgtttttgagtccttctaaggrttcctatgcatacagatgcacagactggaaagcaaagaaccagcaatgaatacataggtgggtgttcttgactctaacaccctaccaaccgctttccagt

SEQ ID NO: 72836 - DNA, 201 bp, Homo sapiens
gcagtgtgggggaagcactgaagcctgtagtccccacttgggggctaggggtttgctcactcagcaataaataactgtgtcacatcaaatcctaaatatamcactacaaagtgagagttactgccactctgttcttactgacaccgtccagctgggagtttaggtggtagaggatccagggggaatgttgaaatgggagga

SEQ ID NO: 72837 - DNA, 201 bp, Homo sapiens
actttttcccacaagttatgtttcccaacttctgcttacaacctattctcttccctattaaagtccaggtgtttttgagtccttctaagggttcctatgcrtacagatgcacagactggaaagcaaagaaccagcaatgaatacataggtgggtgttcttgactctaacaccctaccaaccgctttccagttgccttagcc

SEQ ID NO: 72838 - DNA, 201 bp, Homo sapiens
aatactatcggggaaacggaagtggccgtcggtggcaggtttgggggagaccggaagtgacggtccgtggggaagtcgggggcggagccgcggggtggtgkgtgtgtgtgtgtgtgtgtgtgtgtgtgtgtgtgtgtgtgtgtttggctgtgggttagttgtgccgttctgctggaacaccgtgggaaggcagtagacgcg

SEQ ID NO: 72839 - DNA, 201 bp, Homo sapiens
atcatccggacaaacctggaatttctccaagagcagtttaatagcattgctgcgcatgtgctgcattgcacaggtcaggggctggccaggcgggggcaagbggggcctgttgcatgtgcagggctgccacgtgccagcattccctccttgtattttgcccacagatagtggatttggggcccggttgctggagttgtgtaa

SEQ ID NO: 72840 - DNA, 201 bp, Homo sapiens
cgtttctccaacctgcttactttttctctttagctccggtctgatatacaaaaacgactgcaggaagaccccaactacagtccccagcgcttccccaatgsccagcgggcctttgctgatgatccttagctctttgctctatggcccttcctcatcaggggaccgtttcccccctcttccttcacagtatttaagaaataa

SEQ ID NO: 72841 - DNA, 201 bp, Homo sapiens
tgggcgacagagactctgtctccaaacaaacaaaacaccaccaacccctaactgctatgtctgttttttcatctgtaaaattggcaaatcatcaatcttayaggattaaatgaaataatgcacataaagcccttagcaaagacttgcacatggtaagtccaaagtatatatttgctataattaatagtaatgtttgcaaag

SEQ ID NO: 72842 - DNA, 201 bp, Homo sapiens
gcatctgcctggctctgccactgaccctaacttttcctctctactccacctcccaattcttctacccttgctccctgcagaaacgcacccagcagcagggyccctaggccaggttctccacccgctccctccagcacttgaccttctctggggatggagatattcccacccataacccctccagcttaccagaactgaggc

SEQ ID NO: 72843 - DNA, 201 bp, Homo sapiens
gccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactcccca

SEQ ID NO: 72844 - DNA, 201 bp, Homo sapiens
gagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttgg

SEQ ID NO: 72845 - DNA, 201 bp, Homo sapiens
agggtcagcatctgcctggctctgccactgaccctaacttttcctctctactccacctcccaattcttctacccttgctccctgcagaaacgcacccagcrgcagggcccctaggccaggttctccacccgctccctccagcacttgaccttctctggggatggagatattcccacccataacccctccagcttaccagaa

SEQ ID NO: 72846 - DNA, 201 bp, Homo sapiens
ggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatagggacttggccagcgtttctccaacctgcttactttttc

SEQ ID NO: 72847 - DNA, 201 bp, Homo sapiens
gggacctgatgacacctgagaatccccactcaggtccaccccactgtcagactgactcatctgagaggagtggagaaggagctagttaagtcagggtagaragcaccccaatacctgactgatgcacacatacaaactgcagaaaggggacagccaagtgagagaacagctccagactcaacccagagcaggtggggggta

SEQ ID NO: 72848 - DNA, 201 bp, Homo sapiens
tgggaaggcttgacagtgccaccccgggctatttgacagtgtgcttggggggggaaatgttagcttctgagggatggccttgtgtgcttgctgggatcatrgggacttggccagcgtttctccaacctgcttactttttctctttagctccggtctgatatacaaaaacgactgcaggaagaccccaactacagtccccag

SEQ ID NO: 72849 - DNA, 201 bp, Homo sapiens
aatttgggtgtgcatgttgggggcagggaggaatgtcagaaaaccagggaaaatcaaagccagcaactggacagagaaatcaaatgaaggggaagtgtgamgatacaatatacctgctgggcaggagcccctgaagggagaaagccactttggccaccaggctgcagaggagtagaataaaaatccgaaggggatggcaga

SEQ ID NO: 72850 - DNA, 201 bp, Homo sapiens
gtctaaggcaagcctaggatccagaccctggttccaaagtaaggaagcacttggaaagtccacatccctattccgtttcaccttccagttgggggagtccrtgatgatccaggtcccccaaggttgctgctcagtttttgataatcctggaacggctttagttccactggatgcagctgaggggaaaaaaatcatgagctg

SEQ ID NO: 72851 - DNA, 201 bp, Homo sapiens
catcttcctgtcccccggcccagccaggcagtggtaccttcttgccattacataaccactgggtaagagcccctagtgacatgttaggggaaggggccctrggaattcattgactctgaacctttcattttaaagatgaagaaaatgaggtttagaaaaagaaagtatagtaattagtgtcactgctttctgacagcctgt

SEQ ID NO: 72852 - DNA, 201 bp, Homo sapiens
gaatttagagttggggccacaagggtttctccttcacctgctggtaaaggtcgacgcgctgggtgcggaagactccactgtaggtggaaggcgtggccttsagacgggaattgaggccagagaaggacctaagggaagaagggcgtctaaggcaagcctaggatccagaccctggttccaaagtaaggaagcacttggaaa

SEQ ID NO: 72853 - DNA, 201 bp, Homo sapiens
gttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctca

SEQ ID NO: 72854 - DNA, 201 bp, Homo sapiens
caaacatcagaaccagttgaaagtgaagcacctccccgggagcccatggaggcagaagaagtggaggagcgtgccccagcccagaacccggagctcactcmtggcccagccccagcgggcccaacacctgccccggaaacaaatgcacccaagtgagagatggagggaatctttagtgggtggggaatcctaagtgaagta

SEQ ID NO: 72855 - DNA, 201 bp, Homo sapiens
tcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtc

SEQ ID NO: 72856 - DNA, 201 bp, Homo sapiens
atcggggaaacggaagtggccgtcggtggcaggtttgggggagaccggaagtgacggtccgtggggaagtcgggggcggagccgcggggtggtgggtgtgkgtgtgtgtgtgtgtgtgtgtgtgtgtgtgtgtgtgtttggctgtgggttagttgtgccgttctgctggaacaccgtgggaaggcagtagacgcgggcagt

SEQ ID NO: 72857 - DNA, 201 bp, Homo sapiens
cttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctgggggg

SEQ ID NO: 72858 - DNA, 201 bp, Homo sapiens
tagagtcccagctggtgactgtttttcaggcatttacggtagccacctcaatcttctagcgctcaagcgcgcgcacagacgtgaacgccgccagagggggragggggtggggcgatgcttaagtgtccacgcatccgtagtgcgacgcacgcaggcgtagtacggtcccccgggcgacagcggtggcggctcctcggggtg

SEQ ID NO: 72859 - DNA, 201 bp, Homo sapiens
atcaccccaaccatagtgtcccagcttcttttttttttttttgagacagagtctcactctgttgcccaggctggagtgcagtggcgccatctcggctcacygcaagctctgcctcccgggttcacgccattctcctgcctcaacctcgtgagtagctgggactacaggtgcccaccaccatgcccagctagttttttatat

SEQ ID NO: 72860 - DNA, 201 bp, Homo sapiens
ccagcgcagggcatctggtggggaggcctaggggacaggcatgtgttaaagagtgagtcacagtgagaggtcagcgatgagacggaaggacaggaaatcargtggcaactcgaatttagagttggggccacaagggtttctccttcacctgctggtaaaggtcgacgcgctgggtgcggaagactccactgtaggtggaag

SEQ ID NO: 72861 - DNA, 201 bp, Homo sapiens
ccagatggtgagcggccttgtggggcagcttcttatgcagccagtccttgtgggtgagttttcattcttccccactcagagtttaaactcctttcctagtytgctcactggcactttccagttctttccatattttcttggttcctgctttcctggaatggggctgctgtagtgtcttgtgtcttcaggtttcagcttttt

SEQ ID NO: 72862 - DNA, 201 bp, Homo sapiens
gctcttagccacatccctctggtgacatcacacgagcctctttcaccctgtaacaccagaagacttggtgagtcctaatcctgttttatgagattttaacmccttaccttgattcctaggagtcaataagaaggctttggagtccaggcaggaagtcagggacttgaattcctccacacacttttcgggaggatgtggtga

SEQ ID NO: 72863 - DNA, 201 bp, Homo sapiens
ctcgaactcttgaccttgtgatccacccaccttggcctcccaaagtgctgggattacaggcttgagccatcgtgcccggccagcttttttcttttttttttaagttacagagtcttgctctgtcacccagactggagtgcagtggtgcaatccagtgagttaaagctcactgtaaccttgaactcctgggctcaaacagtt

SEQ ID NO: 72864 - DNA, 201 bp, Homo sapiens
atcccggatggaggtaagtgggcaaggctggctagggtctctctccaccctccctctcccttttctctcagcctgggagttagggcttcactggccacatycacagggtttggccttcataatctagtcttctctgcagtattcattcttttgggcagaaaaagtatctttgtgaggctctctcatttctgccaatcctct

SEQ ID NO: 72865 - DNA, 201 bp, Homo sapiens
tgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttct

SEQ ID NO: 72866 - DNA, 201 bp, Homo sapiens
atattggccaggctggtctcgaactcctgaccttgtgatccacccgccttggcctcccaaagtgctggaattacaggcgtgggccaccgcgcccagcctgrtgtttgtattttttgtgcgaaagcactttatatataaataaaaaacctgtattttgagttgggagcatattccaggtgcacactagcatagagctctcaa

SEQ ID NO: 72867 - DNA, 201 bp, Homo sapiens
gagacagggtttcaccatattggccaggctggtctcgaactcctgaccttgtgatccacccgccttggcctcccaaagtgctggaattacaggcgtgggcyaccgcgcccagcctgatgtttgtattttttgtgcgaaagcactttatatataaataaaaaacctgtattttgagttgggagcatattccaggtgcacact

SEQ ID NO: 72868 - DNA, 201 bp, Homo sapiens
cccatcccttacctcctgtagcagctctggttttctgggaggccgctcccgacgtttagggggaaagggactaaccccggcagagtcccgaggagtcccayccacccctctcaccattggccccggctcctcaaagtgggggtctgggaaagagaaaaagggtcagcatctgcctggctctgccactgaccctaacttttc

SEQ ID NO: 72869 - DNA, 201 bp, Homo sapiens
caacaagggagacacatgggagactaatactgagaattctggagtaaaaacacagtgaaagaaacaggaaagaaaacagagaaaacataacccagaagaawtttcacgagtaagagtgcagtgaagcacaatctcaaacccatcccttacctcctgtagcagctctggttttctgggaggccgctcccgacgtttaggggg

SEQ ID NO: 72870 - DNA, 201 bp, Homo sapiens
gtgaatgtgtgtgtgtgcaggagaaactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaa

SEQ ID NO: 72871 - DNA, 201 bp, Homo sapiens
agaggagtggagaaggagctagttaagtcagggtagaaagcaccccaatacctgactgatgcacacatacaaactgcagaaaggggacagccaagtgagaraacagctccagactcaacccagagcaggtggggggtatgaccagtgctcaaaaaagtcccagctcagacacaccctcccaccctcactcacttctgtgcc

SEQ ID NO: 72872 - DNA, 201 bp, Homo sapiens
ccataacccctccagcttaccagaactgaggccgctgttgaccctctggggctcgtatcgggttgggggcctaggagaggggccctgaggggcttggggargcccaggcttgtgccttggatgaccccctggtgcagttacactcccttgacggctactaagctgggccagagcctgttggatgccagcagggttgctgtg

SEQ ID NO: 72873 - DNA, 201 bp, Homo sapiens
cctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcc

SEQ ID NO: 72874 - DNA, 201 bp, Homo sapiens
tcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgt

SEQ ID NO: 72875 - DNA, 201 bp, Homo sapiens
attgtcccgtgacagacatgtgtcctctatgtcccacctttagtccttcccttctctccacccaactcaggatacccagatccagcccacacagaccttgycactagtgccaaactggactgggggaccaggtcgatgggatggccgaatggggccaggctctgtgcctcggtctgtacgctgtgatcgttctgtgccaat

SEQ ID NO: 72876 - DNA, 201 bp, Homo sapiens
gaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccg

SEQ ID NO: 72877 - DNA, 201 bp, Homo sapiens
gtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggat

SEQ ID NO: 72878 - DNA, 201 bp, Homo sapiens
atctcgagctcggctcactacaacctccacctcccgggttcaagtgattctcactcatgcctcagcctcctgagtagctgggactacaggcgtccgccacsacgcccggctaatttttgtatttttagtagagacagggtttcaccatattggccaggctggtctcgaactcctgaccttgtgatccacccgccttggcct

SEQ ID NO: 72879 - DNA, 201 bp, Homo sapiens
tccccagaaatcttgggcctttccaccaaactcttactcccacttacctcagtgactgatgctgttagctccttctctgctttcaagctgtctcctaccaytaggcgtaagtctgagtcctgtgatcacaagaaggcaggagacattgtcccgtgacagacatgtgtcctctatgtcccacctttagtccttcccttctct

SEQ ID NO: 72880 - DNA, 201 bp, Homo sapiens
atggccttgtgtgcttgctgggatcatagggacttggccagcgtttctccaacctgcttactttttctctttagctccggtctgatatacaaaaacgactrcaggaagaccccaactacagtccccagcgcttccccaatgcccagcgggcctttgctgatgatccttagctctttgctctatggcccttcctcatcaggg

SEQ ID NO: 72881 - DNA, 201 bp, Homo sapiens
agtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctga

SEQ ID NO: 72882 - DNA, 201 bp, Homo sapiens
ttgacagtgtgcttggggggggaaatgttagcttctgagggatggccttgtgtgcttgctgggatcatagggacttggccagcgtttctccaacctgcttrctttttctctttagctccggtctgatatacaaaaacgactgcaggaagaccccaactacagtccccagcgcttccccaatgcccagcgggcctttgctga

SEQ ID NO: 72883 - DNA, 201 bp, Homo sapiens
tcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcac

SEQ ID NO: 72884 - DNA, 201 bp, Homo sapiens
ctcgtggagagggatgtctggcatcctggacgccctggtcactcccagcaatcttccccagaaatcttgggcctttccaccaaactcttactcccacttayctcagtgactgatgctgttagctccttctctgctttcaagctgtctcctaccactaggcgtaagtctgagtcctgtgatcacaagaaggcaggagacatt

SEQ ID NO: 72885 - DNA, 201 bp, Homo sapiens
gtgccaccccgggctatttgacagtgtgcttggggggggaaatgttagcttctgagggatggccttgtgtgcttgctgggatcatagggacttggccagcstttctccaacctgcttactttttctctttagctccggtctgatatacaaaaacgactgcaggaagaccccaactacagtccccagcgcttccccaatgcc

SEQ ID NO: 72886 - DNA, 201 bp, Homo sapiens
aacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaagttctcccttgctctctatccagcagggcgccggtctg

SEQ ID NO: 72887 - DNA, 201 bp, Homo sapiens
aggaaggaaggtggagggtagagaactcctccagccggcaacttccccagctctgtagcttgcattgtggagaaatccagaaactggcccttgagagctamcccagagagcagtgctgagggaggggctgggccggggggtaggtataggggctgtgatctgaaaataaattgtggggagaaaagctgttaggaagccaga

SEQ ID NO: 72888 - DNA, 201 bp, Homo sapiens
cggggagttctagtgcgtaacagtctagggagagactcctgtggtggtgcatggaagggcaggtctgaagttctcccttgctctctatccagcagggcgcyggtctgggtaccaatgcctcgttggcccagatggtgagcggccttgtggggcagcttcttatgcagccagtccttgtgggtgagttttcattcttcccca

SEQ ID NO: 72889 - DNA, 201 bp, Homo sapiens
gggtttctccttcacctgctggtaaaggtcgacgcgctgggtgcggaagactccactgtaggtggaaggcgtggccttgagacgggaattgaggccagagraggacctaagggaagaagggcgtctaaggcaagcctaggatccagaccctggttccaaagtaaggaagcacttggaaagtccacatccctattccgtttc

SEQ ID NO: 72890 - DNA, 201 bp, Homo sapiens
gctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcagtg

SEQ ID NO: 72891 - DNA, 201 bp, Homo sapiens
catctggtggggaggcctaggggacaggcatgtgttaaagagtgagtcacagtgagaggtcagcgatgagacggaaggacaggaaatcaggtggcaactcraatttagagttggggccacaagggtttctccttcacctgctggtaaaggtcgacgcgctgggtgcggaagactccactgtaggtggaaggcgtggccttg

SEQ ID NO: 72892 - DNA, 201 bp, Homo sapiens
atgtcagaaccagataaagatgccctggtcttgggatggctcctcaagtgccacccacctctctctgcctctcagaatccacggtccaaagagtgccaacwtgtggtgacttagccctgccaagacctttggccctggcaggaaaaccagataaagggggcaaacaagctgtcaggatgagcattggtttgtgagagcagt

SEQ ID NO: 72893 - DNA, 201 bp, Homo sapiens
gagtgcagtggcgcaatctcggctcactgcaacctctgcctcccaggttcaagcgattctcctgcctcagcctcccaagtagctgggaccacaggcgcccrccaccatgcccaggtaatttttttgtatttttagtacagatgggttttcaccatgttagccaggatggtctcaatctcctgatctcgtgatttgcccgcc

SEQ ID NO: 72894 - DNA, 201 bp, Homo sapiens
aagtcttgctgtgtctccagactggagtgcagtggcgcaatctcggctcactgcaacctctgcctcccaggttcaagcgattctcctgcctcagcctcccragtagctgggaccacaggcgcccaccaccatgcccaggtaatttttttgtatttttagtacagatgggttttcaccatgttagccaggatggtctcaatc

SEQ ID NO: 72895 - DNA, 201 bp, Homo sapiens
ccttcactttctagctgcttccatgggcagagggtgagtcatggcgcagaagccctcagcggcctccacccacctgctgtccccattgctgggggggggggcggtgggcggcaaaacttcctcaattctcctagtgtccctggctgggccttaaactgacaaagacattaataggaaaaaagcaaacaaattttacttcat

SEQ ID NO: 72896 - DNA, 201 bp, Homo sapiens
gatggagggattgagccagagtaaaaatagtagaatagaggaagtaggaaggacccaggcaaagcttgcctgggagctgagatcagtgacctggcgacgghgtgcacatgtagggggcctgggagcctagctccactactaccactctgcttggctgagatggagagcggcaccatcagggagaggactttaagatgctga

SEQ ID NO: 72897 - DNA, 201 bp, Homo sapiens
agaactgaagtttgctggaggctatagccttctcttggaggaaatccttgaatatatccctcctccttttctttctcctcttccttctttcctctcctccycctcctttcttcttctttgtcttttttgtcatcttcatcttcttcatctttgtctttgtccaattcgtcgtcttcgtcttctttatcgtcgtcttcgtct

SEQ ID NO: 72898 - DNA, 201 bp, Homo sapiens
ctactgttttatctttctgaatgagatggtttatgtggtggcttgaagagagagatgagtaaggtgagggcagaaaggaaggttggccagccagtcccccwggcagcctttcaagaatggcgctccaagattgagagaatcttaagagaatactgcatgcaattctcgggcgacagatataaaaacctagagtaaataaat

SEQ ID NO: 72899 - DNA, 201 bp, Homo sapiens
acgccgagacctcaggcagtgaagcagccctgcctaaatgggtggcagaagccagtgaaagcctggtctcctcatcctggcactggggtgtgtttgtcccrttctaggatgaaagcctggtctcctgatcctggctctggggtgtgtttgtcccattccaggatggatttcgctactgttttatctttctgaatgagatgg

SEQ ID NO: 72900 - DNA, 201 bp, Homo sapiens
ttaagtcacccagtagaaggtcattcattatggcatccccagtacacgaagagtctggcttcatgattggtctaggttggtgaaggaggacacggggtccyctgaggccattgtggtggcactgagtagcccaagggacccttttcagcatcagaatggtgggaagtggtgtgcagaccaaagccgcgaacacgcagagtg

SEQ ID NO: 72901 - DNA, 201 bp, Homo sapiens
cagggttcggtcatgaggtgcagctgcctcagcactgctggcctgagcttgactccttccagtgtgagttttgcctgtgacgttcttgggagcccgtaatyacacagtgtcctctccctccacattctcacccacttaggagtaggcttaggagcaagcgagggtgcagagtggcctttgtcactggcagagctgtagtag

SEQ ID NO: 72902 - DNA, 201 bp, Homo sapiens; identical to SEQ ID NO: 28055

SEQ ID NO: 72903 - DNA, 201 bp, Homo sapiens
tgttgacttggaaaataggagatggggaagtaactgcctgcggatagaaccagcctgtgcagtcagacctagaccatgccctgctcctgtgcagtgccccsctagggttggtggcacattgatgttagctcgtttgtggggttgtggcctttgtgccttcagtctgggcaagttcaactgcatgcaccggacaagagagga

SEQ ID NO: 72904 - DNA, 201 bp, Homo sapiens
agtttccaagatatggctacctctctcaaacatggttacatgtggaaaggaaacaagactcatggagagttcattttttatttgaagagctatgaaacatraagaatggcagattatagattttttaagaaatcaggttgttgcagttagattttaagcataaacagtcaaccaagtttaccaaattttattaacccgtaa

SEQ ID NO: 72905 - DNA, 201 bp, Homo sapiens
acatctgcgacttgagatttttctatcagttagatttttggtggtatatcagattgcactttcatcattagtaaactaagaaattggttcaatttgttctrtagcaaatcaaattcaaagtccacagaggccacttagtttggacttttcatgctcagatcaagaaaccagtgcaagaagttgctcttaagtcaattttaa

SEQ ID NO: 72906 - DNA, 201 bp, Homo sapiens
ttgttgctctggcgtagatataacacatctgcgacttgagatttttctatcagttagatttttggtggtatatcagattgcactttcatcattagtaaacyaagaaattggttcaatttgttctgtagcaaatcaaattcaaagtccacagaggccacttagtttggacttttcatgctcagatcaagaaaccagtgcaag

SEQ ID NO: 72907 - DNA, 201 bp, Homo sapiens; identical to SEQ ID NO: 28315

SEQ ID NO: 72908 - DNA, 201 bp, Homo sapiens
caggagaaataaaagtgctggaaaagacttggtgtcaccttaggttggaaatcacacttgttgatggtatactccctagaagtgcttagaacaatttactratggctgattaaaaacagtatttgaaaaccaaagagttctcagttaaaataatttccctaaaaagtagttaatgcgacgttttgaaaacatttttaaaat

SEQ ID NO: 72909 - DNA, 201 bp, Homo sapiens; identical to SEQ ID NO: 28317

SEQ ID NO: 72910 - DNA, 201 bp, Homo sapiens; identical to SEQ ID NO: 28321

SEQ ID NO: 72911 - DNA, 201 bp, Homo sapiens
atggactctgatttcatagcattttgataaaatgccacaaaataagggctatagagagatttttacaagtcagattttttgttccccaaatcttttaaatkaagccagtgactcccagttctcaacacatggccccagtcaagacagaacaccatggaaaaaaccctgtaagtattatggcactctccgaatcctcctgaa

SEQ ID NO: 72912 - DNA, 201 bp, Homo sapiens
gctcgtttgtggggttgtggcctttgtgccttcagtctgggcaagttcaactgcatgcaccggacaagagaggaaaataattaaaacactgtgggcagttstgtcagccgctcttctcttgagggtcagcctaggcagggagctggctctgctgtcccctctgccactctcaccttccatgggcctttgggagcaggagcc

SEQ ID NO: 72913 - DNA, 201 bp, Homo sapiens
tggggttgtggcctttgtgccttcagtctgggcaagttcaactgcatgcaccggacaagagaggaaaataattaaaacactgtgggcagttctgtcagccrctcttctcttgagggtcagcctaggcagggagctggctctgctgtcccctctgccactctcaccttccatgggcctttgggagcaggagccctgtgccct

SEQ ID NO: 72914 - DNA, 201 bp, Homo sapiens
atgctttttgaataagccaatttggaaaagagttattccacagatacagttgtgaagccctcccatcccctgagaccgccattaccccgtcacccctgccrccagcaccctctggcaagaatttaaaaggacccagaagagacttgagtaaattgcttcttgatgacatttttttcaagttcagcaatgttaaaagctgct

SEQ ID NO: 72915 - DNA, 201 bp, Homo sapiens
ctaagccatgagcccacaagcctccactttttattttattttattttattttatttatttatttatttatttatttattgagacggaatctcgctctgtgkcccaggctggagtgcagtggtgcaatctaggctcactgcaagctccacctcctgggttcatgccattctccttcctcagcctcctgagtagctgggacta

SEQ ID NO: 72916 - DNA, 201 bp, Homo sapiens
agcctcagaatgtgaccttggttggaaagagggtttttgcagaagtaattaaggaaagggtccaaatgagatcatactgcattcgggtggccctcactccratgactggtgtctttttaagatgagagggtgcacagaggcacatatacagcggaggcggccacgtggagacagaggtgaagactggagtggtgcagccag

SEQ ID NO: 72917 - DNA, 201 bp, Homo sapiens
tacgggacacctcctttcttttccctctgtcttagacttctcaggggccatagattatgccactcctcctttctcctaagccatgagcccacaagcctccrctttttattttattttattttattttatttatttatttatttatttatttattgagacggaatctcgctctgtgtcccaggctggagtgcagtggtgcaa

SEQ ID NO: 72918 - DNA, 201 bp, Homo sapiens
ttttttgttgttgttctcagaataaaaatgatgcttattgaagaaaatttggaaagtttagaaacataaaagaagcaggggaaaaaaaaccatccacaggyctatggcccaaagccaattgcacttaacagtttggcatcttcttttagttttgtttggattttttccctttgagcgttttttggtgcctctggtttttta

SEQ ID NO: 72919 - DNA, 201 bp, Homo sapiens
ttttagcaagttagttgcatccaggcaagtcagtcctctgctcgcatctcagtcttggtcttctaggtgagtccagcttcttgacccatgggggtggttayatgtaataggaaggattatgaaatagtatgtttgttgaaaagaattcagatagtactgaaatgcacaaagtaagtctcccatcactcttctgccagtccc

SEQ ID NO: 72920 - DNA, 201 bp, Homo sapiens
gtttatggtaggtttggtttgtttctgtgttttacgtgcccgcttgcttttggcgtgtccctttttgatttcagtgtttgatgatactcaaagtcaatcgytttctgtaaaggatctaacacatcttgggtacttaaaatttaaaccccactgtgcttgtgtctttgaaggagctgtgccgcatggagtcaaaaactggtc

SEQ ID NO: 72921 - DNA, 201 bp, Homo sapiens
cgttcgttcgtttgttcgttctttctctctctctctctcttttctttctttttctccagttctacttccttctttctttctttcttttttttttttttttycacagaatctcgctctgtcgcccaggctggagtacagtggtgccatctcagctcactgcaacctccgcctcctgggttcaggcaaattattctgcctcag

SEQ ID NO: 72922 - DNA, 201 bp, Homo sapiens
gttttttcctgggaggtgaaggttgcagtgagctgagatcgcgccactgcactccagcctggtcgacagagcgagactctgtttcaaaaaaaaaaaaaaaagtaaatgtagtgttttaggtaagaacttgcccactttggagattcttattccttatggttaaaaaaaccaaaacaatgttttgataattcaaaccattta

SEQ ID NO: 72923 - DNA, 201 bp, Homo sapiens
ctctggttcgttggatctgtgagtgactgctgtataactggcctgaggtcagacctcgctgacccccccactcccctctcccctttttttttgagatggartctcgctctgtcgcccaggctggagtgcagtggcacaatctctgctcaccgcaagctctgctcactgcaagctccgcctcccgggttcacgccattttcc

SEQ ID NO: 72924 - DNA, 201 bp, Homo sapiens
tatataaatagatatatctattatatataatagagatatatatctatatataatatatagatatctatatattatatatagatatatatctatatattatrtatagatataatatagtcacacagtcaaccatgcccggaacccccaagcccccactttttttttccgagatggagtctcactctgttgcccaggctggag

SEQ ID NO: 72925 - DNA, 201 bp, Homo sapiens
ctatatataaatagatatatctattatatataatagagatatatatctatatataatatatagatatctatatattatatatagatatatatctatatatwatgtatagatataatatagtcacacagtcaaccatgcccggaacccccaagcccccactttttttttccgagatggagtctcactctgttgcccaggctg

SEQ ID NO: 72926 - DNA, 201 bp, Homo sapiens
atagatatagatgtctctataatatctatatataaatagatatatctattatatataatagagatatatatctatatataatatatagatatctatatatwatatatagatatatatctatatattatgtatagatataatatagtcacacagtcaaccatgcccggaacccccaagcccccactttttttttccgagatg

SEQ ID NO: 72927 - DNA, 201 bp, Homo sapiens
aggcgtaatataatatagatattatatatagatatagatatagatgtctctataatatctatatataaatagatatatctattatatataatagagatatmtatctatatataatatatagatatctatatattatatatagatatatatctatatattatgtatagatataatatagtcacacagtcaaccatgcccgga

SEQ ID NO: 72928 - DNA, 201 bp, Homo sapiens
aagggctagagagcttagaaggtgccaagccagagcaccaagagccagaactttccttagcaagatgaagagaagaatacacacgttccgggaaggaacgmcttggaagtgggggagctgaggtgcagaggaagaaggcattgcagggtggaaggggccgttcttagagggaaatcctgctcagtggctgggctgctcagc

SEQ ID NO: 72929 - DNA, 201 bp, Homo sapiens
gttttgaactcctgagctcaagtgatcctctgggctcagcctcccaaagtgctggaattacaggcatgagccaccacgcctggctgagaacgctttttttkggggggggggggggcggggggaaaagggctagagagcttagaaggtgccaagccagagcaccaagagccagaactttccttagcaagatgaagagaagaa

SEQ ID NO: 72930 - DNA, 201 bp, Homo sapiens
aaaaccttccagttagaaaactctattaattcctaggctctctcttcttgtgaaagaaatccagcgtgcccgctgtctcgtttttggtcactgctaagcawgctttttgaataagccaatttggaaaagagttattccacagatacagttgtgaagccctcccatcccctgagaccgccattaccccgtcacccctgccac

SEQ ID NO: 72931 - DNA, 201 bp, Homo sapiens
ggagtgcagtgacgcattcatggctccctgcagcctcgaaccctgggaccccagtgatcctcccacctcagcctcccaactagccaggatcacagatgcaygccatcatgctcggctcattttttattttttgtagagacgaggtctccctatgttccaaccagaaacagaaactaagaacccatgactgtattctgtccc

SEQ ID NO: 72932 - DNA, 201 bp, Homo sapiens
accacgcccggctattttttttgtatttttagtagagacagggtttcaccgtgttagcaaggatggtctcgatctcctgacctcgtgatccgcccgcctcrgcctcccaaaatgctgggattacagacgtgagccaccgcacctggccgaaactctgtctttaaaaaaaaaagtactttcaggtatttgaaggaaatacca

SEQ ID NO: 72933 - DNA, 201 bp, Homo sapiens
aaaaggcagattgcacaagcttgcatgggtagcatggacagttgacataaaacacagccttaaatcttattttagtcatttgtctgatctttaccacctcyaaattgttggcagaagctattagagcaaatttaactgagttcaaatttcacttcctatattctacttattttctgaaaggaggatgaaagaaatgcaaaa

SEQ ID NO: 72934 - DNA, 201 bp, Homo sapiens
ctccacgaattgcagcccaattatatttgaagagttagaatatcacgagcctgtctgcagacagcattgttccaataaggatttcaggtgtgccgttcgtyttcctttagaagtaattcttttctataagattgtggaacatgttaggatgaccttgtgaacatcttagacccctgcggaatgtcagcttccaattgtgtt

SEQ ID NO: 72935 - DNA, 201 bp, Homo sapiens
tcctttttaatactgaaagtaacatatgtgtcttggaattcttttggtaagattgtcttacattcttctgatgtgaaacgtgtttctttcctaagaaacgrgggaagcaattttgaatatagtccagcctttcctttcttctcagtgggtgtcaatagagttgtctgtctttgtcaagtgtttctaatgtttggggatggg

SEQ ID NO: 72936 - DNA, 201 bp, Homo sapiens
ccccaggttaccactaaaaatgccagtaagtgggtttgcgttatttttgccattttccaatattacattgtggaggctgaaagacagcccataataagggrgttgccaggcccagatggggctgttctttgtaagaggtgggttagattttgaagtaaggcttagaaaccttcggttcttctcacaaatatacagataatt

SEQ ID NO: 72937 - DNA, 201 bp, Homo sapiens
tataatttaataactgagagttacagaagtacgttagacatgatctcatgcaaagtcttcatttaagggagaaagaaatcagctcttagaaaaagtaaacrtgtcattggtgattgcagcagttaagagagtgggccccgggtatcctgattccggcacttgcctgctagtcacctgtgtccccgatacccaacaagcccc

SEQ ID NO: 72938 - DNA, 201 bp, Homo sapiens
cattggtgattgcagcagttaagagagtgggccccgggtatcctgattccggcacttgcctgctagtcacctgtgtccccgatacccaacaagccccctgyggtctggcttaagttgaaactcatgctatggacagttgagagttgtggataccagaggcttacccagggagtaagcatatacaggccttaccttaatctt

SEQ ID NO: 72939 - DNA, 201 bp, Homo sapiens
gtggaggctgaaagacagcccataataagggggttgccaggcccagatggggctgttctttgtaagaggtgggttagattttgaagtaaggcttagaaacyttcggttcttctcacaaatatacagataattggtatgtatgaagtttgcttttatttatttcaaaatatcatatgaaattgacttgtagatttaccttcc

SEQ ID NO: 72940 - DNA, 201 bp, Homo sapiens
tttgtttaaagggctcactttactgcgaagactgtctaaacaaggttcgtatctttttatttcttaagttgggtgcagctgaggattgaggaatgacttttgaagtggatttatcttgaaaagtattatacatggggttgaagattctcccatggtataggggaatctccccatcagcataatttttgctggttctgaaag

SEQ ID NO: 72941 - DNA, 201 bp, Homo sapiens; identical to SEQ ID NO: 28661

SEQ ID NO: 72942 - DNA, 201 bp, Homo sapiens
cccaataattttacttctaggagtttatcttaaggaaaaaataaaaaattcagatgaaaccttatccccctagatgtttatcaagacactatttttttttyccagggggtgcgatcttgctctgttgcccaggctggaatacagtggtgtgatcatggctcactgcagctggaacctcccaggctccagcaatcctcccac

SEQ ID NO: 72943 - DNA, 201 bp, Homo sapiens
gatctcattcagtttgaggagcgccctcaagagccttctggtgggtgactccatgttgtcatggggattttcttcggggtttaaaacaaaaccacgatgaratactgatatagtaaatgacggaggtgggaagggactaccccttttcaggtggaaaacactgtgctgattattcgaccttctttccccacctgggttcct

SEQ ID NO: 72944 - DNA, 201 bp, Homo sapiens
cccttctctttggaagctgactgcaggacccttttctctggttgggtcttttgaggggccagtgttcctaagaacacggatcttcagaagaactagcttawtaaggcgttccattaccaggatcttcctgttagtgggttttgggtttttgtttttttttttttttttttttaataccttaaatacttcttgactctctta

SEQ ID NO: 72945 - DNA, 201 bp, Homo sapiens
ggattgagaatcaagggatggatccaagtcgcaccagaggagcaggctctggtttggtttctttcctaagcagctgtagtgatggtgggggtctgggtggmtaagatgactgggatcccctggacttgtatcggttggttgattaaacccgcttctgaggaggaaatctatacagtcccataatcatgataagtagggtgg

SEQ ID NO: 72946 - DNA, 201 bp, Homo sapiens
aggcattttgaattgatcctttcaaaacatactgttggtctaaagtaaatgattttagcatttctccttgattctttctgtaaacctttattaaatccctrtatgccaggtgagtaagtttcaggctgtaactctagaaaggtgttggttaatgggagagtcaagacccccaagcaggcaactagtcagggcggtcagggc

SEQ ID NO: 72947 - DNA, 201 bp, Homo sapiens
tccatccgcctcaggcagctcatgtgatggcctccaaaggcttcccaggtgcagggcctgggcatgagggaacccccgctcctaccacccacctgcccccmctgcagtttctggtatcagcaagtgcagacaaatccacactggggctgcagggtcgccgcccttggtatttcagcagccagagtctgatgcatcaagggc

SEQ ID NO: 72948 - DNA, 201 bp, Homo sapiens
atactgtatcctaagcacccagcccatagtagatgcttagcagggactagtgagtacaagaccaaggcactgcagagaaggcagaactgggcaagacttargtcttgtccttgaggagcttatgtctagcgggaagagaaaatgctcgtgaatccttatggacagtgaagaaaactgattggaaaggaggagaaaaagctt

SEQ ID NO: 72949 - DNA, 201 bp, Homo sapiens
gtgttatagttgctcacagtgtgtagtacagtaacaggctgtccagatgtgtagctcgggaaccatgggctgcaccagcctaggtgtgcagtgggccgcascatctaggtttgcataagtgcacctgatgatgttctcaggtgacagaatcacccagcaacacattattgagtacatatccccatcatgaagcagcacgtg

SEQ ID NO: 72950 - DNA, 201 bp, Homo sapiens
tgaagagaagaatacacacgttccgggaaggaacgccttggaagtgggggagctgaggtgcagaggaagaaggcattgcagggtggaaggggccgttcttrgagggaaatcctgctcagtggctgggctgctcagctcctcactccgcacgaggtggtgaaccaaccaggagcatccgcaggggagcagtaccagggccag

SEQ ID NO: 72951 - DNA, 201 bp, Homo sapiens
catctttgtctccttcttcatcttcatcttctcatcttcgttgccttctttttcttctttgtcttcgtcttcaactctgggccttttccctcagtgggagrccttcactttccacggggcagggccagtcactaatatttctaatgctgcgttttctttttaaccaggttttcactaatgataagatggaagaatgtgtga

SEQ ID NO: 72952 - DNA, 201 bp, Homo sapiens
ggattagaggagtgagccacaatgcctggcaatttttaaaaatttttaatagagatggggtctcactgtgttgctcaggctggttttgaactcctgggctsaagtgatccccccgcctcggcctcccaaagtgctgggattacaggcatgagccaccatgcctggccagttcgttcgttcgttcgtttgttcgttctttct

SEQ ID NO: 72953 - DNA, 201 bp, Homo sapiens
ctagcgggaagagaaaatgctcgtgaatccttatggacagtgaagaaaactgattggaaaggaggagaaaaagctttgagaacacagaggaagggaagaamaaggaacttggccattatcccacaggtaatagggagccactgaagtgctggaggaaggaggggaggggaaaggtgtggtgatgggaatcatgctgcagga

SEQ ID NO: 72954 - DNA, 201 bp, Homo sapiens
agcacgtgacaaggaggggagagagcattctgggcaaaggggatgatgacatgagcagatgcagggttgtgacaagtggcatggagtgtcgagaggctaasagggagctgagagctcggttagggagggcgtggctcctccaggtaaggagggaggactgtgttggagagagctggagcccaggtttgcatttgaaaagca

SEQ ID NO: 72955 - DNA, 201 bp, Homo sapiens
ttacattcagcttacacatgggcccattcatgtaaggtagataactgcatgttgtctttttgcaataatgtgggaaacctgaagcttggcctcagtcacaytggtgttcaagtgagactttgctaccctttatgtaaaatatgtgtgaggtcttcgttgcagcagactcatgccccagaatgtaaagatctgaccacgtga

SEQ ID NO: 72956 - DNA, 201 bp, Homo sapiens
aaagttgctgtggaactaaaggatgtaccatcaccccttcatgctggctctaagctttttccagcagtcccacttcctgatattcgttctcttcagcagcytaaaatacagctttcttctgtccccaaagtaagctgctgtgctcattgccctaatgaaccctccacttcgccaatgcgttttggtggtggtggtggcggt

SEQ ID NO: 72957 - DNA, 201 bp, Homo sapiens
cctgccaccacgcccggctattttttttgtatttttagtagagacagggtttcaccgtgttagcaaggatggtctcgatctcctgacctcgtgatccgccygcctcagcctcccaaaatgctgggattacagacgtgagccaccgcacctggccgaaactctgtctttaaaaaaaaaagtactttcaggtatttgaaggaa

SEQ ID NO: 72958 - DNA, 201 bp, Homo sapiens; identical to SEQ ID NO: 28104

SEQ ID NO: 72959 - DNA, 201 bp, Homo sapiens
tatttttagtagagatggggtttcaccatgttggtcaggctggtcgccaactcttgacctcaggtgatccacctgccttggcctcccagagtgttgcgatkacaggcgtgagccactgtgccaggccaagttctacttcttaatacataaatttcaacttatctggaagaattatgactacccactgccaaataaaacttc

SEQ ID NO: 72960 - DNA, 201 bp, Homo sapiens
gccactgtgccaggccaagttctacttcttaatacataaatttcaacttatctggaagaattatgactacccactgccaaataaaacttccagcctaactrctggcaatctgctgttgaagctgaacaggctctaaattgttgggttttaaaaaaatttttgtttacttaagcctatagctcctagtattcccaggcattc

SEQ ID NO: 72961 - DNA, 201 bp, Homo sapiens
ctatgcaaaaaccaaccaggactgaccctgctcaccttctggctctataagttattattcagcagacctgcagaataaatagacttttaaaaaacaacttygttgagatatgatttacatattacaaaattcagctcttttaagtgtacaataatttttagtaaattgagttgtacaattttagaatatttttgtcacctc

SEQ ID NO: 72962 - DNA, 201 bp, Homo sapiens
ttatcaactcaaggctgttgtgcaaatggaaaacttacaagatgcgatcggtgcagtgaatagcctccacagatacaaaattggcagcaaaaagatcctgstctcacttgccaccggggctgccagcaaatcactctctttactgaggtaagaaacaagcaagctgtttatttcaggaaataacatttgacccagaaacaa

SEQ ID NO: 72963 - DNA, 201 bp, Homo sapiens
atcatgctgcaggaagactcttctcgtagcagtggtgtctgagagggcaggaacaggggagagaaggaggcagagagggaaagtagctacatcagtccaawttcagagcagatactgttgggacagaactcgatgttacagaaatgtcaaaatgtcaaatgtcattgaaactagagtgggtaactaattttttttattaaa

SEQ ID NO: 72964 - DNA, 201 bp, Homo sapiens
tgggaccacaggcatccgccatcctgcccagttaatattttttaatttttgtaatgagggggttttgctatgttgcccagggtggtcttgaactcctggcytcaagtgattctccctcctaggcctcccaaagtgctggaattacaggcacgggccaccacgtccagccagagtaactagttttatgtagcaagcaaggta

SEQ ID NO: 72965 - DNA, 201 bp, Homo sapiens
ggatccaaggccatgaggaaatgcatgaggtgtggggatgaggcagaggccgctgataacttttgagtcatcactacagagtcctgtggctaaaatccagkagggaaggggctgagagactcgggggtaacacagcagaagcagctcctgagcagctggatgtttccattacagggacagggtagagtacgagactgagaa

SEQ ID NO: 72966 - DNA, 201 bp, Homo sapiens
tcgcgatctcttgacctcgtgatccgtccacctcggcctcccaaagtgctgggattacaggcgtgagccccagcgcccggccggaaaacttgtagttcttytaccgatgatactactcattccgtatccacttccgttgttaaaacctaggtgtttctcaaaggactgggatgtcactgaatatggtgtttgtgagttgat

SEQ ID NO: 72967 - DNA, 201 bp, Homo sapiens
gttacttgggaggctgaggcaggagaatggcatgaacctgggaggtggaggttgcagtgagctcagatcgcatgactgcactccagcctgggtgacagagygagactccgtctcaaaaaaaaaaaaaaaaaaagagaaagtgactatggatctataaaattacatctaaaaagccacataaaagttttccttatgtgcaga

SEQ ID NO: 72968 - DNA, 201 bp, Homo sapiens
tttatttttgttcaacttttgaagcctgattctctcttctgctagcaagttttaactgaagatcagatgaataaacaaaaaaagtggggatattcagaagygtgatttcatgggaataatttctagagtacttgcttaagtacagggacctgggtgtgtgtcatgttaatagatatggggcaggggctagaaaattgtttc

SEQ ID NO: 72969 - DNA, 201 bp, Homo sapiens
gatatgggttaggttaaggaaaaggagatggtctcgatgtcatggatttaaagtcagcatttggattacaacacacattattgtgtgtcgagaggcagcaytggaaagagcctgattttctaaaatatgcatcaagtgcataaattacaaatcagagctgagtggggaggtgcttcagcagcagcgggatcaatacgattt

SEQ ID NO: 72970 - DNA, 201 bp, Homo sapiens; identical to SEQ ID NO: 28117

SEQ ID NO: 72971 - DNA, 201 bp, Homo sapiens; identical to SEQ ID NO: 28050

SEQ ID NO: 72972 - DNA, 201 bp, Homo sapiens; identical to SEQ ID NO: 28120

SEQ ID NO: 72973 - DNA, 201 bp, Homo sapiens; identical to SEQ ID NO: 28123

SEQ ID NO: 72974 - DNA, 201 bp, Homo sapiens; identical to SEQ ID NO: 28126

SEQ ID NO: 72975 - DNA, 201 bp, Homo sapiens
ctgaccacgtgaatatctttcttgatcatgtcaagtcacttctggaaatgaatttatgaactgatagctaatggttcttggaaagattatttgaaagtccyttttattagaggctagcaagtggaaaggtaaaacacttagagtgtattttcagttgttgtatataactccagcttctgaaatgatgtatctgacacctcc

SEQ ID NO: 72976 - DNA, 201 bp, Homo sapiens
atttcgctactgttttatctttctgaatgagatggtttatgtggtggcttgaagagagagatgagtaaggtgagggcagaaaggaaggttggccagccagtcccccaggcagcctttcaagaatggcgctccaagattgagagaatcttaagagaatactgcatgcaattctcgggcgacagatataaaaacctagagtaa

SEQ ID NO: 72977 - DNA, 201 bp, Homo sapiens
tagctgtgattccattttgttcagttatgatttagtgatgtaacagaattgaacactatttctgtttgtgcatgcagtaagatatgagtaaccaaaaaacyacggacctcataaaattaatttatgttctgattttcttttctcagaaagagtacatggagaacaagaaagttgctgtggaactaaaggatgtaccatcac

SEQ ID NO: 72978 - DNA, 201 bp, Homo sapiens
gtttatgaaatgtcatcagcaacacggatgggccatctgggtagatggctgatctcatctgtgtttgaaactttactcttttcctttgggggatcttactraaaccccttatggcctgaccacagaactattaagtattgtcctcaaaccactgtgtgtgttagccatctttattgaatgctgtttgtgaggggttgtttt

SEQ ID NO: 72979 - DNA, 201 bp, Homo sapiens
agtcacacaattcagaattacacggtcaactttacagatcttgaaactcaattttgtcagtggcatgcagaatggagtaggttcaggggatcaactcatartaagcctgcctgtatgagcctgatctgtataaatcagaataccagtgtgttaatttcagtctgaactataattaccaagagggcagttcattggctggtc

SEQ ID NO: 72980 - DNA, 201 bp, Homo sapiens
taaaatgctgccagaataatggaacggcaggcattttgaattgatcctttcaaaacatactgttggtctaaagtaaatgattttagcatttctccttgatyctttctgtaaacctttattaaatccctatatgccaggtgagtaagtttcaggctgtaactctagaaaggtgttggttaatgggagagtcaagacccccaa

SEQ ID NO: 72981 - DNA, 201 bp, Homo sapiens
gggattacaggcgtgagccaccgcgtccagccaattttgacatttcctgacttcatgcactcatgttaccacctttctatttcttattttctattgtatgygggattcaagtgagactgtaatataattttatataagggtattaacaacttttatttgattttattttttgagacagagtctcggctcagccccctaggc

SEQ ID NO: 72982 - DNA, 201 bp, Homo sapiens
gctggggtgtgagcagcaagaatggggagagctgagagaggctccgtggtgcctccctggctgcccactgggtctcctgggagcttctccaaccttacctytcagattcttatagaattagtcccagcacactctgagcattggtgtttttaaaagctccccaggcaattctaatgcatagccgggattgagaatcaaggg

SEQ ID NO: 72983 - DNA, 201 bp, Homo sapiens
tctactaaaaatataaaaattagccaggcatagtgacaggctcctgtagtcccagctactctggaggctgaggcagaaaaatcgcttgaacccgggagacrgaggttgcagtgagctgagatcgtaccactgcatgccagcctgggcgacagagcgagacttcctcttgaaacaaagatttgaattgttgagagccatagg

SEQ ID NO: 72984 - DNA, 201 bp, Homo sapiens
attctacataaagggagtcatgctctgaggctagtaacgagagggtgagccagcagcaaggaagtcgctgtctgctgaggtcttatgtgtataaataaacyatttgctttgcagattcttggaatgggctccaaacgtctgctgacccttacccacagggcccaggtgaagcgctttactcaggatttactaaaacttctc

SEQ ID NO: 72985 - DNA, 201 bp, Homo sapiens
cacgcccggctaatttttttgtatttatttttgtatttttagtagagacggggtttcaccttgttagccaggatggtctcgatctcctgacctcgtgatcygcccgcctcagcctcccaaagtgctgggattacaggcatgagccgccgcgaccagcaagcctctccacctttctataaagatttccgtttgattacttat

SEQ ID NO: 72986 - DNA, 201 bp, Homo sapiens
cacctcctgggttcatgccattctccttcctcagcctcctgagtagctgggactacaggtgcctgccaccacgcccggctaatttttttgtatttattttkgtatttttagtagagacggggtttcaccttgttagccaggatggtctcgatctcctgacctcgtgatccgcccgcctcagcctcccaaagtgctgggatt

SEQ ID NO: 72987 - DNA, 201 bp, Homo sapiens
agtagagagggcagctcgtgctgtttgctgtcctggactgcacttgacccttcctgtcctaggcagagcagctgccagttttcggcctcctcccccacagraccagaagaagtcactgccaggaggaaggaatggaaagggaagcatgaaggacggcaccctcagttacaggcccattactagctgcacacatttctgtgt

SEQ ID NO: 72988 - DNA, 201 bp, Homo sapiens
atcttccagtgccaaagccacgcctggaaaagggtcacaggcaaattctggatctgctacaaaaaatacaaatgttaaaagtttacaggtaattttgatayctcttgctttctgaagtttatggtaggtttggtttgtttctgtgttttacgtgcccgcttgcttttggcgtgtccctttttgatttcagtgtttgatgat

SEQ ID NO: 72989 - DNA, 201 bp, Homo sapiens
gctgggattacaggcatgagccactgcacccagcccccactgttttttaatgtattggactgcagctaagaagacgttcttaccttggcagaggtaggaasgctcagagctctccttaggtactgattggttggaggaggaggtgagagagcaggaagcacaaccaggagagccgaacatccctgagccaaggcagaggaa

SEQ ID NO: 72990 - DNA, 201 bp, Homo sapiens
atgacaggtttgcactgtgaccctggagatgggtgtctgcagtgaaattgaacacaggaggatgtcgtcggagatgacagaggcaaggcattgaaaggctrtacggctgtggtgtgggacaggtccctgggtgttcagttgcccaggatgatgaaaggggtggactcaggtggataggaagaccccacgccatgacctagg

SEQ ID NO: 72991 - DNA, 201 bp, Homo sapiens
gttctaaagctactgtgtatgtgagtctccaattccatatcttggtagaaatctttttattattatggaccaggaagtcatttgccctttatgttgggccraggctatacacagaagctgtgtatagaaaaattggtagtatatcaggagaaataaaagtgctggaaaagacttggtgtcaccttaggttggaaatcacac

SEQ ID NO: 72992 - DNA, 201 bp, Homo sapiens
tgggtgagtgtgatgggtgggcagctggggtgtgagcagcaagaatggggagagctgagagaggctccgtggtgcctccctggctgcccactgggtctccygggagcttctccaaccttacctctcagattcttatagaattagtcccagcacactctgagcattggtgtttttaaaagctccccaggcaattctaatgca

SEQ ID NO: 72993 - DNA, 201 bp, Homo sapiens
tcacacgtgtaatcccagcactttgagaggccaaggagggaggattgcttgagctcagtaatctgagaccagcctgggtaacagtgagaccccatctctaygaacaaaacaaaacaaaaacaaaaaaccaaggggtctgatatttcccccacttcccagagtgctgttgctcttctgtatatatgatgatcctttatcttt

SEQ ID NO: 72994 - DNA, 201 bp, Homo sapiens
cccccccagggacagggcgaggcacagaaccaggaaccacatggtgacagaggtgtccaggggccagcaggtggaggaactggggaacctccctggggagscttttaaaagcccttatcccctcagagccccacccctgccctgctggcacccagatgttggccaaggcccttcccctgttgcctgggggctggacaattg

SEQ ID NO: 72995 - DNA, 201 bp, Homo sapiens
tttccttgacagcttcctaataaaaagtcttggggcagagcttgattggttgggctttggtcatgtgtccatctttgggccaattgcagggtctgcagctrgggtactgtgattggctcagccagaatcacatgattacctctgtggcccagaggccagcatatgccaggagaatccctcatccagggttatgtgagttgg

SEQ ID NO: 72996 - DNA, 201 bp, Homo sapiens
tcatcccaggcagggaggatcatctcaggcagggaggaccatcccaggcagggaggatcatctcaggcagggaggaccatcccaggcagggaggaccatcycaggcagggaggactatctcaggcagggagggccgtcccaggcagggagggccgtcccaggcagtgaggaccatctcaggcagggaggaccatcccaggc

SEQ ID NO: 72997 - DNA, 201 bp, Homo sapiens
gctggctggtggaggctgttggatactgaccccgtgactgttcctggctggtggagggtcttggatactgacccgggaattgtaggtaattggcaccaccrtgcctggctaatttttttgtaattttagcacagatggggtttcaccatgttggtcaggcgggtctcgaactcttaacctcaggtgatccacctgcctcag

SEQ ID NO: 72998 - DNA, 201 bp, Homo sapiens
ccttagaatttttaggtagtttaatttcttcacctttgtctctgtgactttattaattgcttcttggcttcgggaggttctccctccagatttttgatgarcattcagttctgtttttttaaattctcattacttatttttaggttttgattgtgattttggagttggtatgcagggaacattgaattctgtgctccctgc

SEQ ID NO: 72999 - DNA, 201 bp, Homo sapiens
acatgagttgttatgagacaccttttaggagttcaagtagggtgaccaggggtgtctgtgggggtggttctagaaatgatcgaggctgggctcagtggctsacgcttgtaatcccagcactttgggaagccgatcacctgaggtcaggagtttgagaccagcctggccaacatggtgaaaccatgtctctactaaaaatac

SEQ ID NO: 73000 - DNA, 201 bp, Homo sapiens
atctgcccctttggtaaagcggtgggacagggcgttggctagggaagaggagaaagtactgaggcttcctgggaggagcaggaatctggtgtgggagtgarcactatgacaacatggaggagcgggggtggaagtttagggtggggccgcgcaagatagataagagccggggcaccccggactaggatagactgtgggcca

SEQ ID NO: 73001 - DNA, 201 bp, Homo sapiens
agcccttatcccctcagagccccacccctgccctgctggcacccagatgttggccaaggcccttcccctgttgcctgggggctggacaattgccccccccsctccgatccccagagctgtagacggggagggagaaccagcacctgttctgcaggccctggatcacgctggacgcattcctggggttgaagccaggtgggg

SEQ ID NO: 73002 - DNA, 201 bp, Homo sapiens
cagaaggaagtaaatacagggaatttgttcgtgagtaacagaggagctgagaagccaataggaaatagtgaggcaaaccaggagttaggaactacaggatrctgctacttggccagaaggacaaagggaggaggtggtattactacagtccagaaactgcagccctctggaacgcataggttcatggttggattgctcaga

SEQ ID NO: 73003 - DNA, 201 bp, Homo sapiens
ctagaggactttggttgagttcagagctgagcacacttgccttcagactctcctgggactcccaggtaactgattcaatgcttttgatactgggctcgggrccgtaggtaagtgatgggagcacattgacaatggcccaggcttggaagttgggggttggaacacttaaatgggcagtctcggttgttgacaggtagtttt

SEQ ID NO: 73004 - DNA, 201 bp, Homo sapiens
gggtgggccgtgcagcagggcgcagcgaggcggacatccaaacagcggaactcagacgctgactccgagcgcaccccgggccttcccatttcatacacccwcgaggatgagacccaagcacctccaaggaatagcacccgaggtcttcaggacaccgaccggtagccatggccagatgcccggccaaccccttcagcgtgg

SEQ ID NO: 73005 - DNA, 201 bp, Homo sapiens
ccaaggaaaggagcatgtggtgggagggtgtggtgtttttcctgggagagctgggggtgctgggtgggaagggacatttgcagacccccccccataccagrtgggggatcccacatgccagtttgggaagcagggttttctggtgaaatttgggggaccctggaaggactggggagaccagatgtcagggtctggaggaca

SEQ ID NO: 73006 - DNA, 201 bp, Homo sapiens
cagaaaaccagagctgtgtaggaacaattcaggcagagaagggctggggcctggggcgggatggaacttccccaaggaaaggagcatgtggtgggagggtktggtgtttttcctgggagagctgggggtgctgggtgggaagggacatttgcagacccccccccataccagatgggggatcccacatgccagtttgggaag

SEQ ID NO: 73007 - DNA, 201 bp, Homo sapiens
gcaatgcaggacccacttgatgtgaggttgtagaatcacatactgacttgggggaggccagggcagaagcgctggctgagaaggcattcaggatccttggsgtggggttccagaaaaccagagctgtgtaggaacaattcaggcagagaagggctggggcctggggcgggatggaacttccccaaggaaaggagcatgtgg

SEQ ID NO: 73008 - DNA, 201 bp, Homo sapiens
gccttcagactctcctgggactcccaggtaactgattcaatgcttttgatactgggctcggggccgtaggtaagtgatgggagcacattgacaatggcccrggcttggaagttgggggttggaacacttaaatgggcagtctcggttgttgacaggtagttttggtcatgatctttgttgctggggataattgatgattag

SEQ ID NO: 73009 - DNA, 201 bp, Homo sapiens
cccagaaccagtcttctgccagtgcctcccattagtcaaacacagtgataagatggtgagcaaaggaggctgggaaatgtggtccttgcagtgcagaacargacagggcgggaaatggatctgagagcagacagacaaaaaactggcagagttgttagcaacttggcagagttggtaataactgccgagtccggtagaaaa

SEQ ID NO: 73010 - DNA, 201 bp, Homo sapiens
gatatggggtcctcttggaggcaatcctaggaagaggattggagaagtggtgagaacaggcgccaagcagctgtgggaatgcaatgcaggacccacttgaygtgaggttgtagaatcacatactgacttgggggaggccagggcagaagcgctggctgagaaggcattcaggatccttggcgtggggttccagaaaaccag

SEQ ID NO: 73011 - DNA, 201 bp, Homo sapiens
cagtcttctgccagtgcctcccattagtcaaacacagtgataagatggtgagcaaaggaggctgggaaatgtggtccttgcagtgcagaacaggacagggygggaaatggatctgagagcagacagacaaaaaactggcagagttgttagcaacttggcagagttggtaataactgccgagtccggtagaaaaaagttatc

SEQ ID NO: 73012 - DNA, 201 bp, Homo sapiens
agaggagaaagtactgaggcttcctgggaggagcaggaatctggtgtgggagtgagcactatgacaacatggaggagcgggggtggaagtttagggtgggsccgcgcaagatagataagagccggggcaccccggactaggatagactgtgggccagagggatgagggtggggtgttggaggggaaggtcttatcgggggg

SEQ ID NO: 73013 - DNA, 201 bp, Homo sapiens
ggggttggaaggggccagcttggctgggacagttagatttcagggcttcctggttaaagggtaaaagaaagggctatggttaaggctagaggtgggcttcygagaggttttggggtccttcctgtgaaccaggaatggcaatctgaggggaggttggggccctgagaacacagttgcggtcaggactgggacggggctcag

SEQ ID NO: 73014 - DNA, 201 bp, Homo sapiens
ccagggcagtgaggactatcccggagcagtgaggaccattctagagctgtgaggactatcccagggcagtgaggattatcctggggcagtagggactatcytatgacaatgaggaccatcccagtgctgtgaggaccatcctggggcagtaaggaccatctcagtcagtgaggatcatttcagtcagtgaggatcatcctg

SEQ ID NO: 73015 - DNA, 201 bp, Homo sapiens
gtccatcctagtgtgagtgaactgttctggcgtccctgactcgccctttgggatctgagcctttccctgcctgtttgtctgcacctgtcacagccccttcytttccccacctgctggtgacctcagacttccaggcatgagattgacacagctggggtggccccagcctcagccgagtgggtccaggtgcaccacatctgg

SEQ ID NO: 73016 - DNA, 201 bp, Homo sapiens
agacaggagacagtgtctggagcagacactgcatctgggcgtcaggtcatttggggtctggggctgggggatgggaggtggtgggttaggggagtggaaarggattctggaaaccagggatcaaggcgccaagggtgggacaggatcagaggctcactgaggaagaatctggagggctaaggggctcctaggctagggaaa

SEQ ID NO: 73017 - DNA, 201 bp, Homo sapiens
atgaacaaactgggctgtgttttcgtcgtcaaacaagttgtggcgacccagccagagctggtaattgctggggaaagatgggaatggagggatgagaagaygggaaggggaaaaggggatggggcaggggagcatgggggagggtccccaaagagagaaagggaaagagaaaaatgtgggtgggcggagacagaggaagaa

SEQ ID NO: 73018 - DNA, 201 bp, Homo sapiens
gagaaatacagacagcgaatgggaagatgaaagagtttgagagtgcaaaaggcaaatgaagagacagagcaaaaaagagctcaaaaggacagaggggtgaraaaggcggaggggagggcagtgagaaacagggtgagcaaaaaagaggcagatgagaaggataaaagacagggacagcgagaaacaggcccagggaagagg

SEQ ID NO: 73019 - DNA, 201 bp, Homo sapiens
caaagagagaaagggaaagagaaaaatgtgggtgggcggagacagaggaagaaagatatagttatggagaaatacagacagcgaatgggaagatgaaagaktttgagagtgcaaaaggcaaatgaagagacagagcaaaaaagagctcaaaaggacagaggggtgagaaaggcggaggggagggcagtgagaaacagggtg

SEQ ID NO: 73020 - DNA, 201 bp, Homo sapiens
cccacatacaattctctggttcgatgctgccccagccggaagccaaacaggtgctccccacttcgggttcctcggtgggcaactccacgaccttcacagcrtctgtgatggtatcagcaggctctgtcaggcggagcagcatgaggtcgtggctgtagtcctcgtctgcttggcgggtgtggttctccaggaggctcatgt

SEQ ID NO: 73021 - DNA, 201 bp, Homo sapiens
ccctgggggcagggctgcctcaccacacaggtgtctttgccaccttccaggtgtccgacacacagcatgaagtctgtcaccttctggacgtgggctttttygcactcatcattaggcaggattttgaggtccacacactggagatcatctggaaatgagactacgaacccgggagaaaaagggctgcagcccgacctcacc

SEQ ID NO: 73022 - DNA, 201 bp, Homo sapiens
gccctttgggatctgagcctttccctgcctgtttgtctgcacctgtcacagccccttcctttccccacctgctggtgacctcagacttccaggcatgagaytgacacagctggggtggccccagcctcagccgagtgggtccaggtgcaccacatctggaaagataggtgatggcagaacgtgacacacattggatgcaca

SEQ ID NO: 73023 - DNA, 201 bp, Homo sapiens
atctggaaatgagactacgaacccgggagaaaaagggctgcagcccgacctcacctgcttccctggccctttctcccttggacgcaggagtccccatcccygccttgggctacacagtctgcccccacatacaattctctggttcgatgctgccccagccggaagccaaacaggtgctccccacttcgggttcctcggtgg

SEQ ID NO: 73024 - DNA, 201 bp, Homo sapiens
cagaaccagtcttctgccagtgcctcccattagtcaaacacagtgataagatggtgagcaaaggaggctgggaaatgtggtccttgcagtgcagaacaggrcagggcgggaaatggatctgagagcagacagacaaaaaactggcagagttgttagcaacttggcagagttggtaataactgccgagtccggtagaaaaaa

SEQ ID NO: 73025 - DNA, 201 bp, Homo sapiens
tgggcggagacagaggaagaaagatatagttatggagaaatacagacagcgaatgggaagatgaaagagtttgagagtgcaaaaggcaaatgaagagacasagcaaaaaagagctcaaaaggacagaggggtgagaaaggcggaggggagggcagtgagaaacagggtgagcaaaaaagaggcagatgagaaggataaaag

SEQ ID NO: 73026 - DNA, 201 bp, Homo sapiens
gcctccagtgcccactcccagaggaaggtgggcagggattcccacagaggggacagggtctccagtcctggccaagggggaagggacctcagggtccagckcctgcacatggggcagggtccaggtggacagtgcctgcagacaggttagggggaggaggggcaggaccatctgcaggacgctgcccctgcgggcacatcg

SEQ ID NO: 73027 - DNA, 201 bp, Homo sapiens
catggccctctcctcctggccagtggtcctccgcctgaacatggccgactttgtcttcagtttcctctgcctcggcattggtaggtgttggcttggggggygggggccctccctaaccccagccctgctctctggctttctggaggtgtatctagacttccgtgctgctcccctcggggcctctgtcttagcatgtctctg

SEQ ID NO: 73028 - DNA, 201 bp, Homo sapiens
gggcttcctggttaaagggtaaaagaaagggctatggttaaggctagaggtgggcttccgagaggttttggggtccttcctgtgaaccaggaatggcaatmtgaggggaggttggggccctgagaacacagttgcggtcaggactgggacggggctcaggaggagggaggcgtgagtggcagtccttctcggacagggtga

SEQ ID NO: 73029 - DNA, 201 bp, Homo sapiens
tgagaaacagggtgagcaaaaaagaggcagatgagaaggataaaagacagggacagcgagaaacaggcccagggaagagggaggaagagggaacagaacayggaagggagcgagaagcagacaaatgaaaaaggacgcgggacgtcagagtgagaactagaaacagaggcagagaggaagcaggagtgaccgagtgtggga

SEQ ID NO: 73030 - DNA, 201 bp, Homo sapiens
ggctcctaggctagggaaacaggacctgggttgggcttttgaggttcaggaaaggatgcagctttagggaaccaggtctgagaggtaaagaagagcatctsgactgaagagtttgggggtgacttggggtccctacattggggttggaaggggccagcttggctgggacagttagatttcagggcttcctggttaaagggt

SEQ ID NO: 73031 - DNA, 201 bp, Homo sapiens
atccccgccttgggctacacagtctgcccccacatacaattctctggttcgatgctgccccagccggaagccaaacaggtgctccccacttcgggttcctsggtgggcaactccacgaccttcacagcgtctgtgatggtatcagcaggctctgtcaggcggagcagcatgaggtcgtggctgtagtcctcgtctgcttgg

SEQ ID NO: 73032 - DNA, 201 bp, Homo sapiens
cagttgccccacccagctcccgctgaaaccagcccttccctgtgtctctccagagtggagggatatcctgtggggcggggagctggacagagggagaggcrccccctcccaggcacacaagttggggataaagcccttcctttactctggggcctcccttaggtccatctgggtgtgtgtttagtagggatgagggagcgg

SEQ ID NO: 73033 - DNA, 201 bp, Homo sapiens
ggagcagacactgcatctgggcgtcaggtcatttggggtctggggctgggggatgggaggtggtgggttaggggagtggaaagggattctggaaaccaggsatcaaggcgccaagggtgggacaggatcagaggctcactgaggaagaatctggagggctaaggggctcctaggctagggaaacaggacctgggttgggct

SEQ ID NO: 73034 - DNA, 201 bp, Homo sapiens
gtgggttaggggagtggaaagggattctggaaaccagggatcaaggcgccaagggtgggacaggatcagaggctcactgaggaagaatctggagggctaasgggctcctaggctagggaaacaggacctgggttgggcttttgaggttcaggaaaggatgcagctttagggaaccaggtctgagaggtaaagaagagcatc

SEQ ID NO: 73035 - DNA, 201 bp, Homo sapiens
gctcactgaggaagaatctggagggctaaggggctcctaggctagggaaacaggacctgggttgggcttttgaggttcaggaaaggatgcagctttagggraccaggtctgagaggtaaagaagagcatctggactgaagagtttgggggtgacttggggtccctacattggggttggaaggggccagcttggctgggaca

SEQ ID NO: 73036 - DNA, 201 bp, Homo sapiens
ggacacagttgagagcggacagctggatggaaaaagtcactggagtgtggtgggatttgtagactcaggagccaaataggtggccgcagggaactaggggrcaggaggggatgatcagagtcctgtggggtgggggaagcccatgggagggttggggtcctccagagagagacagagatggcccagaatctgcccctttgg

SEQ ID NO: 73037 - DNA, 201 bp, Homo sapiens
gtgagcactatgacaacatggaggagcgggggtggaagtttagggtggggccgcgcaagatagataagagccggggcaccccggactaggatagactgtgrgccagagggatgagggtggggtgttggaggggaaggtcttatcggggggggatgtgaggccagcaagagaatcagggcccgttccccctcccacatcccc

SEQ ID NO: 73038 - DNA, 201 bp, Homo sapiens
ggggttgactctggggcccctgtccccctctccccagttctcatccatatgagcaagggcttcatgttactggccgtggccctgtgctgagtcctcctccygcccatggccctctcctcctggccagtggtcctccgcctgaacatggccgactttgtcttcagtttcctctgcctcggcattggtaggtgttggcttggg

SEQ ID NO: 73039 - DNA, 201 bp, Homo sapiens
gataagatggtgagcaaaggaggctgggaaatgtggtccttgcagtgcagaacaggacagggcgggaaatggatctgagagcagacagacaaaaaactggyagagttgttagcaacttggcagagttggtaataactgccgagtccggtagaaaaaagttatcaacagttcttgcaagaatcctgtgtggcttggggcaca

SEQ ID NO: 73040 - DNA, 201 bp, Homo sapiens
tccacacactggagatcatctggaaatgagactacgaacccgggagaaaaagggctgcagcccgacctcacctgcttccctggccctttctcccttggacrcaggagtccccatccccgccttgggctacacagtctgcccccacatacaattctctggttcgatgctgccccagccggaagccaaacaggtgctccccac

SEQ ID NO: 73041 - DNA, 201 bp, Homo sapiens
cttttaaaagcccttatcccctcagagccccacccctgccctgctggcacccagatgttggccaaggcccttcccctgttgcctgggggctggacaattgcccccccccctccgatccccagagctgtagacggggagggagaaccagcacctgttctgcaggccctggatcacgctggacgcattcctggggttgaagcc

SEQ ID NO: 73042 - DNA, 201 bp, Homo sapiens
aagcccttatcccctcagagccccacccctgccctgctggcacccagatgttggccaaggcccttcccctgttgcctgggggctggacaattgcccccccscctccgatccccagagctgtagacggggagggagaaccagcacctgttctgcaggccctggatcacgctggacgcattcctggggttgaagccaggtggg

SEQ ID NO: 73043 - DNA, 201 bp, Homo sapiens
cattggtaggtgttggcttggggggcgggggccctccctaaccccagccctgctctctggctttctggaggtgtatctagacttccgtgctgctcccctcrgggcctctgtcttagcatgtctctggggagctctgactcagttctactctatctgtgggatgtctctctcccccactctctgtttccctttctttttttg

SEQ ID NO: 73044 - DNA, 201 bp, Homo sapiens
gagaccagcctggccaacatggtgaaaccatgtctctactaaaaatacaaaaattaggctggcgtggcagcagctgcgtgtagtatcagctaatcgggagkctgaggcaggagaattgcttgagcccaaaggcagaggttggagtgagccgagatcacaccactgcactccagcctgggcaacagagcaagactccatctt

SEQ ID NO: 73045 - DNA, 201 bp, Homo sapiens
tagcatgtctctggggagctctgactcagttctactctatctgtgggatgtctctctcccccactctctgtttccctttctttttttgtcccctctctccrggtatctttctgtctgttgtgagggcgtgtgtgtgtgtgtgtgtgtgtgtgtgtgtgtgtgtctgcttgtcacggagggtgggagaggatgtctcagtcc

SEQ ID NO: 73046 - DNA, 201 bp, Homo sapiens
atcctagtgtgagtgaactgttctggcgtccctgactcgccctttgggatctgagcctttccctgcctgtttgtctgcacctgtcacagccccttcctttycccacctgctggtgacctcagacttccaggcatgagattgacacagctggggtggccccagcctcagccgagtgggtccaggtgcaccacatctggaaag

SEQ ID NO: 73047 - DNA, 201 bp, Homo sapiens
attgcagggctcctgatttctcttcagcctgacgctcttttcagttaacggcaaggcggtgcacccaagtccggtggtgtcctacctggtgacctcctacytgtgctgggacgccagcgacttgatgctgcactccggtgagggcggggcctcgggaggagggcggggcctcgggaagcgggtggggcctagggtgggact

SEQ ID NO: 73048 - DNA, 201 bp, Homo sapiens
gtgattttgaggatgtgccagactttggggttgtctgttgggctgcttgtgggtatcagcagagatgactttggagggtgaccaagaggggtatctggggktgactctggggcccctgtccccctctccccagttctcatccatatgagcaagggcttcatgttactggccgtggccctgtgctgagtcctcctcccgccc

SEQ ID NO: 73049 - DNA, 201 bp, Homo sapiens
aagcagagggcagcccttgaatgcgcggcggctgagctaccgcgggtgggccgtgcagcagggcgcagcgaggcggacatccaaacagcggaactcagacrctgactccgagcgcaccccgggccttcccatttcatacaccctcgaggatgagacccaagcacctccaaggaatagcacccgaggtcttcaggacaccga

SEQ ID NO: 73050 - DNA, 201 bp, Homo sapiens
caagcagaaccagatcccaagagacccaggcagccttggagaggggtgtccagcccagctctgccctgccaggcgacctgcgccagagccttcctctctgsctcagccccccagtcttgcctgaggttatccaaggggaatgccactggcctgtcaatcctgtggcagcatagatgccctcctcccagaccccaggcccct

SEQ ID NO: 73051 - DNA, 201 bp, Homo sapiens
gaggtgactttggggaggtgagtaggggtgattttgaggatgtgccagactttggggttgtctgttgggctgcttgtgggtatcagcagagatgactttgragggtgaccaagaggggtatctggggttgactctggggcccctgtccccctctccccagttctcatccatatgagcaagggcttcatgttactggccgtg

SEQ ID NO: 73052 - DNA, 201 bp, Homo sapiens
tcaggacaccgaccggtagccatggccagatgcccggccaaccccttcagcgtggccacgccctggatattcgacctcccctgaggccccaccccctgatrtcaggccacgccctccgaggggaccggtggcaaactccagccctcgctctagggcccgccctttgcggctttgtccctgcccactgggtcctcacagtgc

SEQ ID NO: 73053 - DNA, 201 bp, Homo sapiens
gctaatcgggaggctgaggcaggagaattgcttgagcccaaaggcagaggttggagtgagccgagatcacaccactgcactccagcctgggcaacagagcragactccatcttaaaaaaaaaaaaaaaaaaagaagaagaaagaaagaaatgattgaggtgattctgtggggtaaccttgaggatgagtgggatgaccttt

SEQ ID NO: 73054 - DNA, 201 bp, Homo sapiens
tatcaggccacgccctccgaggggaccggtggcaaactccagccctcgctctagggcccgccctttgcggctttgtccctgcccactgggtcctcacagtrcctccaccccagaggcccagcatcccctcccgttctgcagacacttgtccagcgtcccgctgagctcggcagtgtggctagtttgtgtggccctgcccct

SEQ ID NO: 73055 - DNA, 201 bp, Homo sapiens
tggatgggcgggggaaggagggggagctggggcactgatggggcgagtggctacagctagctgggaagcagtgaagcagatgcctggttagctctcagaarccagttcagaggctgagtcccctccctcagcccttccagaccctgggggcagggctgcctcaccacacaggtgtctttgccaccttccaggtgtccgaca

SEQ ID NO: 73056 - DNA, 201 bp, Homo sapiens
ggtcttggcctatttggctaaaacaattttgcactgttgaaaagtagacaaagtagaaaaagggctaaaaggaggagatgtagcatctcggaaacaggtawacctctcttctgctggaagtctaagttggataaatatccactgtaaactggaactaagcttttgggcacattggttttagagtatttgacttgaaagttt

SEQ ID NO: 73057 - DNA, 201 bp, Homo sapiens
agttatcaacagttcttgcaagaatcctgtgtggcttggggcacatgagcaccccgagccaattatatggccagtggagtacagttggctgattggcttawgactggggctgagaatggggaatgggcaggaggtgaaatgcatggtggggaggtaagctgcaaatatccactcattctgaccaaatcacagagtgggctg

SEQ ID NO: 73058 - DNA, 201 bp, Homo sapiens
gggggaaggagggggagctggggcactgatggggcgagtggctacagctagctgggaagcagtgaagcagatgcctggttagctctcagaagccagttcasaggctgagtcccctccctcagcccttccagaccctgggggcagggctgcctcaccacacaggtgtctttgccaccttccaggtgtccgacacacagcatg

SEQ ID NO: 73059 - DNA, 201 bp, Homo sapiens
gcaaaccaggagttaggaactacaggatgctgctacttggccagaaggacaaagggaggaggtggtattactacagtccagaaactgcagccctctggaasgcataggttcatggttggattgctcagaagtggctagaatcagagaatagatacaactactacggaagacccaccacatgcagagatagagaggctaata

SEQ ID NO: 73060 - DNA, 201 bp, Homo sapiens
gtattactacagtccagaaactgcagccctctggaacgcataggttcatggttggattgctcagaagtggctagaatcagagaatagatacaactactackgaagacccaccacatgcagagatagagaggctaataaataccctggcttgccctctcctcccagaaccagtcttctgccagtgcctcccattagtcaaac

SEQ ID NO: 73061 - DNA, 201 bp, Homo sapiens
gtcagtgaggatcatttcagtcagtgaggatcatcctgtggctgggaggaccaccctggggccgtgagactcataaaatacctgtgaagatcattgcaggraaggaagaaaccattctgtgacaggtggaggggtccctgggataaagtggagcgatgggtcccaggagtggtgagggcagggcaggccttccaagcatcc

SEQ ID NO: 73062 - DNA, 201 bp, Homo sapiens
ttgcagtgcagaacaggacagggcgggaaatggatctgagagcagacagacaaaaaactggcagagttgttagcaacttggcagagttggtaataactgcygagtccggtagaaaaaagttatcaacagttcttgcaagaatcctgtgtggcttggggcacatgagcaccccgagccaattatatggccagtggagtacag

SEQ ID NO: 73063 - DNA, 201 bp, Homo sapiens
cccttatcccctcagagccccacccctgccctgctggcacccagatgttggccaaggcccttcccctgttgcctgggggctggacaattgccccccccccyccgatccccagagctgtagacggggagggagaaccagcacctgttctgcaggccctggatcacgctggacgcattcctggggttgaagccaggtggggca

SEQ ID NO: 73064 - DNA, 201 bp, Homo sapiens
attttggggtacacatcaccacattcctagtgcctccagatccaggaatgtgaagtttcaggggtctcccagggtaagttctttagcattacaaaatccartgtccctcccaaacaatgctggggtctcaatgagcctcccacttcttgctcccagttatgggtgctcaacgtcctgtcctccaaagtcccagagatctgg

SEQ ID NO: 73065 - DNA, 201 bp, Homo sapiens
aggggtctcccagggtaagttctttagcattacaaaatccagtgtccctcccaaacaatgctggggtctcaatgagcctcccacttcttgctcccagttakgggtgctcaacgtcctgtcctccaaagtcccagagatctggacaaccttccctcccaggtcaagatcaggctaaccacagattccaatgacccttccccc

SEQ ID NO: 73066 - DNA, 201 bp, Homo sapiens
agtgatgggagcacattgacaatggcccaggcttggaagttgggggttggaacacttaaatgggcagtctcggttgttgacaggtagttttggtcatgatmtttgttgctggggataattgatgattagtcagggggtgagagccttggatactgaagcagcgagtttggaaaattggtgaagcacctcgcatactgaaat

SEQ ID NO: 73067 - DNA, 201 bp, Homo sapiens
aggtgggcagggattcccacagaggggacagggtctccagtcctggccaagggggaagggacctcagggtccagctcctgcacatggggcagggtccaggwggacagtgcctgcagacaggttagggggaggaggggcaggaccatctgcaggacgctgcccctgcgggcacatcgcagaggccacctctccaggactact

SEQ ID NO: 73068 - DNA, 201 bp, Homo sapiens
agggtccagctcctgcacatggggcagggtccaggtggacagtgcctgcagacaggttagggggaggaggggcaggaccatctgcaggacgctgcccctgygggcacatcgcagaggccacctctccaggactactctctgactcgacggtaacaacacattaccacgaggaacggtgaactctggtgtggggggtgagat

SEQ ID NO: 73069 - DNA, 201 bp, Homo sapiens
acaataaaacctctcagcctcagaccttccattgccccccacctccccaccagggcagggtccatcctagtgtgagtgaactgttctggcgtccctgactygccctttgggatctgagcctttccctgcctgtttgtctgcacctgtcacagccccttcctttccccacctgctggtgacctcagacttccaggcatgaga

SEQ ID NO: 73070 - DNA, 201 bp, Homo sapiens
aggggacagggtctccagtcctggccaagggggaagggacctcagggtccagctcctgcacatggggcagggtccaggtggacagtgcctgcagacaggtyagggggaggaggggcaggaccatctgcaggacgctgcccctgcgggcacatcgcagaggccacctctccaggactactctctgactcgacggtaacaaca

SEQ ID NO: 73071 - DNA, 201 bp, Homo sapiens
  misc_feature (1)...(201): n = A,T,C or G, or insertion/deletion polymorphism (see Tables 1-2)
tccagtgcccactcccagaggaaggtgggcagggattcccacagaggggacagggtctccagtcctggccaagggggaagggacctcagggtccagctccngcacatggggcagggtccaggtggacagtgcctgcagacaggttagggggaggaggggcaggaccatctgcaggacgctgcccctgcgggcacatcgcag

SEQ ID NO: 73072 - DNA, 201 bp, Homo sapiens
gaacgcataggttcatggttggattgctcagaagtggctagaatcagagaatagatacaactactacggaagacccaccacatgcagagatagagaggctrataaataccctggcttgccctctcctcccagaaccagtcttctgccagtgcctcccattagtcaaacacagtgataagatggtgagcaaaggaggctggg

SEQ ID NO: 73073 - DNA, 201 bp, Homo sapiens
cctccagtgcccactcccagaggaaggtgggcagggattcccacagaggggacagggtctccagtcctggccaagggggaagggacctcagggtccagctmctgcacatggggcagggtccaggtggacagtgcctgcagacaggttagggggaggaggggcaggaccatctgcaggacgctgcccctgcgggcacatcgc

SEQ ID NO: 73074 - DNA, 201 bp, Homo sapiens
cccctccctcagcccttccagaccctgggggcagggctgcctcaccacacaggtgtctttgccaccttccaggtgtccgacacacagcatgaagtctgtcwccttctggacgtgggcttttttgcactcatcattaggcaggattttgaggtccacacactggagatcatctggaaatgagactacgaacccgggagaaaa

SEQ ID NO: 73075 - DNA, 201 bp, Homo sapiens
gcctgggtaacagtgagaccccatctctatgaacaaaacaaaacaaaaacaaaaaaccaaggggtctgatatttcccccacttcccagagtgctgttgctsttctgtatatatgatgatcctttatctttcttgttgggtattagagatgtgcagtttgccagaaacaaagcagatgaggtcttggcctatttggctaaaa

SEQ ID NO: 73076 - DNA, 201 bp, Homo sapiens
ggtgtggttctccaggaggctcatgttgaagccagggtgtgggaagctctcactgacatgaacaaactgggctgtgttttcgtcgtcaaacaagttgtggygacccagccagagctggtaattgctggggaaagatgggaatggagggatgagaagacgggaaggggaaaaggggatggggcaggggagcatgggggaggg

SEQ ID NO: 73077 - DNA, 201 bp, Homo sapiens
gccctcaaacaccagcagttagggctctgattccctgcaccactcggagccaagatactagcatctcagctgccagttccccctgaaatataagccttggmcttcagaatgccctggttcttgcactcccagacccaggacctaggtccccaaagctactgttcctttcataataaaattttggggtacacatcaccacat

SEQ ID NO: 73078 - DNA, 201 bp, Homo sapiens
gcccttccagaccctgggggcagggctgcctcaccacacaggtgtctttgccaccttccaggtgtccgacacacagcatgaagtctgtcaccttctggacrtgggcttttttgcactcatcattaggcaggattttgaggtccacacactggagatcatctggaaatgagactacgaacccgggagaaaaagggctgcagc

SEQ ID NO: 73079 - DNA, 201 bp, Homo sapiens
ggaacttccccaaggaaaggagcatgtggtgggagggtgtggtgtttttcctgggagagctgggggtgctgggtgggaagggacatttgcagacccccccmcataccagatgggggatcccacatgccagtttgggaagcagggttttctggtgaaatttgggggaccctggaaggactggggagaccagatgtcagggtc

SEQ ID NO: 73080 - DNA, 201 bp, Homo sapiens
gtagggtcttggatactgacctggtgattgtgaataattggcaaggggtcttggatactgaccaggcgattgctgctggctggtggaggctgttggatacygaccccgtgactgttcctggctggtggagggtcttggatactgacccgggaattgtaggtaattggcaccaccgtgcctggctaatttttttgtaatttt

SEQ ID NO: 73081 - DNA, 201 bp, Homo sapiens
agtgcagtggcatgagatctcggctcactgcaacctccgcctcccaggttcaagccatcctctcacctctgcctcccacgtagttgggactacaggggagygctactattcctagctataattttgtattttttggtagaggtagagttttgccatgtttcccaggctggtctcgaacttgtaagctcaagcaatctgccc

SEQ ID NO: 73082 - DNA, 201 bp, Homo sapiens
cagggaacattgaattctgtgctccctgctgtcctaaggaagggacttgaattagtcaggagtttttgggtcacaagtgacacaaactctttttttttaawttttttttattttttacttttttaaatttgagatggagtttcactctttcacccaggctggagtgcagtggcgtgatcttggttcactgcaaccttcacc

SEQ ID NO: 73083 - DNA, 201 bp, Homo sapiens
cacaaactctttttttttaaattttttttattttttacttttttaaatttgagatggagtttcactctttcacccaggctggagtgcagtggcgtgatctyggttcactgcaaccttcaccccccgggtttgagcgattctcctgcctcagcctccggagtagctgggattacaggcgcccgctgccatgcccggctaact

SEQ ID NO: 73084 - DNA, 201 bp, Homo sapiens
ttttttacttttttaaatttgagatggagtttcactctttcacccaggctggagtgcagtggcgtgatcttggttcactgcaaccttcaccccccgggttygagcgattctcctgcctcagcctccggagtagctgggattacaggcgcccgctgccatgcccggctaacttttatctttttagtagagacggagtttcac

SEQ ID NO: 73085 - DNA, 201 bp, Homo sapiens
ttacttttttaaatttgagatggagtttcactctttcacccaggctggagtgcagtggcgtgatcttggttcactgcaaccttcaccccccgggtttgagygattctcctgcctcagcctccggagtagctgggattacaggcgcccgctgccatgcccggctaacttttatctttttagtagagacggagtttcaccatg

SEQ ID NO: 73086 - DNA, 201 bp, Homo sapiens
tcactgcaaccttcaccccccgggtttgagcgattctcctgcctcagcctccggagtagctgggattacaggcgcccgctgccatgcccggctaacttttrtctttttagtagagacggagtttcaccatgttggccaggctggtctcaaactcctgacctcaggtgatccacctgcctcggcctcccaaagtgctgggat

SEQ ID NO: 73087 - DNA, 201 bp, Homo sapiens
agtgggctgctctctgggatgacgagagccagggacttcagtgtcagctcaatgctctttcgcttgtctgttttccttcttagttttactctccccatgargctaggtccaaggcttaggcagcttcaggcttgtaatccttgaggagagactgcttttccttgacagcttcctaataaaaagtcttggggcagagcttga

SEQ ID NO: 73088 - DNA, 201 bp, Homo sapiens
ctttcgcttgtctgttttccttcttagttttactctccccatgaagctaggtccaaggcttaggcagcttcaggcttgtaatccttgaggagagactgctyttccttgacagcttcctaataaaaagtcttggggcagagcttgattggttgggctttggtcatgtgtccatctttgggccaattgcagggtctgcagctg

SEQ ID NO: 73089 - DNA, 201 bp, Homo sapiens
tcccctctctccaggtatctttctgtctgttgtgagggcgtgtgtgtgtgtgtgtgtgtgtgtgtgtgtgtgtgtctgcttgtcacggagggtgggagagratgtctcagtccctcttttcttactgggggtcatagggctcactgtccagccttctgtctctggccccaccccattgcagggctcctgatttctcttcag

SEQ ID NO: 73090 - DNA, 201 bp, Homo sapiens; identical to SEQ ID NO: 32145

SEQ ID NO: 73091 - DNA, 201 bp, Homo sapiens; identical to SEQ ID NO: 32146

SEQ ID NO: 73092 - DNA, 201 bp, Homo sapiens; identical to SEQ ID NO: 32272

SEQ ID NO: 73093 - DNA, 201 bp, Homo sapiens; identical to SEQ ID NO: 32147

SEQ ID NO: 73094 - DNA, 201 bp, Homo sapiens; identical to SEQ ID NO: 32110

SEQ ID NO: 73095 - DNA, 201 bp, Homo sapiens; identical to SEQ ID NO: 32273

SEQ ID NO: 73096 - DNA, 201 bp, Homo sapiens; identical to SEQ ID NO: 32111

SEQ ID NO: 73097 - DNA, 201 bp, Homo sapiens; identical to SEQ ID NO: 32381

SEQ ID NO: 73098 - DNA, 201 bp, Homo sapiens; identical to SEQ ID NO: 32383

SEQ ID NO: 73099 - DNA, 201 bp, Homo sapiens; identical to SEQ ID NO: 32338

SEQ ID NO: 73100 - DNA, 201 bp, Homo sapiens; identical to SEQ ID NO: 32340

SEQ ID NO: 73101 - DNA, 201 bp, Homo sapiens; identical to SEQ ID NO: 32342

SEQ ID NO: 73102 - DNA, 201 bp, Homo sapiens; identical to SEQ ID NO: 32343

SEQ ID NO: 73103 - DNA, 201 bp, Homo sapiens; identical to SEQ ID NO: 32185

SEQ ID NO: 73104 - DNA, 201 bp, Homo sapiens; identical to SEQ ID NO: 32345

SEQ ID NO: 73105 - DNA, 201 bp, Homo sapiens; identical to SEQ ID NO: 32347

SEQ ID NO: 73106 - DNA, 201 bp, Homo sapiens; identical to SEQ ID NO: 32349

SEQ ID NO: 73107 - DNA, 201 bp, Homo sapiens; identical to SEQ ID NO: 32057

SEQ ID NO: 73108 - DNA, 201 bp, Homo sapiens; identical to SEQ ID NO: 32117

SEQ ID NO: 73109 - DNA, 201 bp, Homo sapiens; identical to SEQ ID NO: 32118

SEQ ID NO: 73110 - DNA, 201 bp, Homo sapiens; identical to SEQ ID NO: 32120

SEQ ID NO: 73111 - DNA, 201 bp, Homo sapiens; identical to SEQ ID NO: 32122

SEQ ID NO: 73112 - DNA, 201 bp, Homo sapiens; identical to SEQ ID NO: 32123

SEQ ID NO: 73113 - DNA, 201 bp, Homo sapiens; identical to SEQ ID NO: 32126

SEQ ID NO: 73114 - DNA, 201 bp, Homo sapiens; identical to SEQ ID NO: 32687

SEQ ID NO: 73115 - DNA, 201 bp, Homo sapiens; identical to SEQ ID NO: 32162

SEQ ID NO: 73116 - DNA, 201 bp, Homo sapiens; identical to SEQ ID NO: 32465

SEQ ID NO: 73117 - DNA, 201 bp, Homo sapiens; identical to SEQ ID NO: 32469

SEQ ID NO: 73118 - DNA, 201 bp, Homo sapiens; identical to SEQ ID NO: 32471

SEQ ID NO: 73119 - DNA, 201 bp, Homo sapiens; identical to SEQ ID NO: 32473

SEQ ID NO: 73120 - DNA, 201 bp, Homo sapiens; identical to SEQ ID NO: 32023

SEQ ID NO: 73121 - DNA, 201 bp, Homo sapiens; identical to SEQ ID NO: 32092

SEQ ID NO: 73122 - DNA, 201 bp, Homo sapiens; identical to SEQ ID NO: 32093

SEQ ID NO: 73123 - DNA, 201 bp, Homo sapiens; identical to SEQ ID NO: 32094

SEQ ID NO: 73124 - DNA, 201 bp, Homo sapiens; identical to SEQ ID NO: 32175

SEQ ID NO: 73125 - DNA, 201 bp, Homo sapiens; identical to SEQ ID NO: 32143

SEQ ID NO: 73126 - DNA, 201 bp, Homo sapiens
aaccagcctggccgacatggtgaaaccagcctggccaacatggtgaaaccctgtctctactaaaaatacaaaaaaattagccgagtgtggtggtgggtgcyggtattctcagctacttgggaggctgaggcaggagaatcgcctgaacctggaggtggaggttgcagtgagccgggattgcgccactgcactccagcctgg

SEQ ID NO: 73127 - DNA, 201 bp, Homo sapiens
actaagccccgcatatgtgagtgaaagtacttcaggcacgctgcctcctggtaacagctatgcagggagggaggacccacactgctacacttctgatcccmtttggttttactacccaaatctaaatagatacttttgataatagataactgctcttttactaagacatagtctctacctatagaaatgtattttgaaaac

SEQ ID NO: 73128 - DNA, 201 bp, Homo sapiens
tctttagctgttgctttttttattgattggtaaaaagtctttatgtaataactcctgtcatattttgggaaggtgtagaagttgaaattttaggaatcacrgaacacccagaaataatgttcaaagacagcaaaccttgaaaacctataatgtgtgtgtgtgttcacagctccgccgcatgcaagagatgattgcaaggat

SEQ ID NO: 73129 - DNA, 201 bp, Homo sapiens
aaaacaagtttgctagtgactaagccccgcatatgtgagtgaaagtacttcaggcacgctgcctcctggtaacagctatgcagggagggaggacccacacygctacacttctgatcccctttggttttactacccaaatctaaatagatacttttgataatagataactgctcttttactaagacatagtctctacctata

SEQ ID NO: 73130 - DNA, 201 bp, Homo sapiens
ttgtgaacagccaaaagctatatgttatggcttattgtgtgaaggtaactaagaagtggtgttccatgacttcagagtacatccatgcggagtccattatwtgagtttgacatttaataactttgctggaaaatctgtaaaaaagaaaaacaagtttgctagtgactaagccccgcatatgtgagtgaaagtacttcaggc

SEQ ID NO: 73131 - DNA, 201 bp, Homo sapiens
ataataatagttaatgaaggtgtgctacagaaaataatctggtgttcttgctaactttgcccttcactgttgcttaattgtgaacagccaaaagctatatkttatggcttattgtgtgaaggtaactaagaagtggtgttccatgacttcagagtacatccatgcggagtccattatttgagtttgacatttaataacttt

SEQ ID NO: 73132 - DNA, 201 bp, Homo sapiens
tcccatgtagaaagtatctgacacttttcaagaaaatgttacatacccccagctttccaattcagttttgtagtcaatagcaatgtgttaagtctgtgctratgttctcgtgttgccagtgaactctggggttccctgtgtggagcctgtctactctgtgtgtctctttctaggctagcatcccattctctgtggttggat

SEQ ID NO: 73133 - DNA, 201 bp, Homo sapiens
ttgccttttttatcatttctactgaagttgggaaattcaaccccagaaattgacagatgaaaggagacaatggttgtgtagggagatggagaaaatgcttratctgaggatgagacagggttttttcatttttgtgggggctagaaaaaacataaaatgaggcagttaaataataatagttaatgaaggtgtgctacagaa

SEQ ID NO: 73134 - DNA, 201 bp, Homo sapiens
acgagggatgcaatgcgttggaggaaggaggaggctggcagccagggactgagccaaagggtgcaaggacagccggcaaggcccgggccaagacctatccscgcccagcgagccaggcctcgcccagcacctatccgcgcccagcaagcctaggcctcgcccagcacctatccgcgcccagcaagcctaggcctcgcccag

SEQ ID NO: 73135 - DNA, 201 bp, Homo sapiens
agctcatttgaagcaggaagcagtgacaggtgtttgcttattttctctgagcttcattttcaacctttatggaatgaaaattttacttttagatcgataamattttatttctgtatactttctagttttgcagcatttccagtttccaggagcctcatgaatggctttttggtttagttaactttgtggtcatgtaagccc

SEQ ID NO: 73136 - DNA, 201 bp, Homo sapiens
atattggccgggcgcggtggctcacgcttgtaatcccagcactttgggaggcggaggcgggtggatcacgaggtcaggagtttgagaccagcctgaccaaygtggtgaaaccccgtctctactgaaaatacaaaaatcagctgggcgtggtggtgtgtgcctgtaatcccagctactcaggaggctgaggcaggagaatcg

SEQ ID NO: 73137 - DNA, 201 bp, Homo sapiens
aattagacaggaggaatgtggttttcttttatgagatatattgtacagcacggtgaatatagtaaataataatgtcgatttcaaaagtgctgacagtaatytcatatgctttcaccacaaaaaacttaaagtatttgaagtgatgaattatgttaacttgattttattatttattgtatccataaatcgtaacatcacttt

SEQ ID NO: 73138 - DNA, 201 bp, Homo sapiens
gccactacactccagcccgtgcgacagagtgagacaccatctcaatataaaaagagaaatgataaatacatgtcattttaaattttaaagtagaatttttkgggggggtagcaaataactatttgttgcagtgttatgattctgatttctttcgattcttaggaaagtggagaatgaggacatgaataaagaccagatctt

SEQ ID NO: 73139 - DNA, 201 bp, Homo sapiens
aacatcaattagacaggaggaatgtggttttcttttatgagatatattgtacagcacggtgaatatagtaaataataatgtcgatttcaaaagtgctgacrgtaatctcatatgctttcaccacaaaaaacttaaagtatttgaagtgatgaattatgttaacttgattttattatttattgtatccataaatcgtaacat

SEQ ID NO: 73140 - DNA, 201 bp, Homo sapiens
ctgtgtcaaacacaatttaatggttgtgtaagaagttaagcgcactcagcccctccagggctgcatccttgtggctatcctgatccccattattgaggggrgtgtagaggctgaagacagggtttggggactttactttagtgtcagttgtgtgtttctcacaatgaggtagagtgagccactccttggctatctcaatcc

SEQ ID NO: 73141 - DNA, 201 bp, Homo sapiens
tgagccgagatcgcgcctctgcactctagcctggcgacagagcaagactctgtctcaaaaaaaaaaaaaatttgatacagctatcacctaaagcttagaawttttattgtaggtttaatttgttttcgtacaatttgtcccatgtagaaagtatctgacacttttcaagaaaatgttacatacccccagctttccaattca

SEQ ID NO: 73142 - DNA, 201 bp, Homo sapiens
ctatgtctgctaaatcagatgtatttgttgtattactcagttcttctctgtccttgcacatactgtgtttactgaatctgtccggttctcagagaactctrttaaagtttctcacttgaatttttttttttaagtttgtatttttcctagtccttgctttatgtgtttatctacagtgattatttgaatatacaggcttat

SEQ ID NO: 73143 - DNA, 201 bp, Homo sapiens
cgcaatccgcctgcgcgctgggcggggcggggcgggctggggcgggctgtgagcggaccgcgagcgctgggcgggtccgcggcgcggtcggtcggcgcctrttctcgggctgtttggcgggtgagtgtctcgccggtgtaccccgcacaagttgtgggccggccctcccgaggagctgcgggggacgcgccgctcgtccca

SEQ ID NO: 73144 - DNA, 201 bp, Homo sapiens
aagaattaagataatttgagagagaagagttttgtatgtattttttttaaataagtgacaattctaaaattaattttagacttaagcccttagatgtggcrtttatgaaggcaatacacaacaaggtgaatattgtgcctgtcattgcaaaagctgacactctcaccctgaaggaacgggagcggctgaagaaaagggtga

SEQ ID NO: 73145 - DNA, 201 bp, Homo sapiens
cttagggtataggtagctatgaatctgaggacataaaacgcaaaactgaggggcaaatcgtcatgttccttaagattacgactcatccacattccttcagmcgtttaatttcaccataataggcactgtttaataagcaaagcccaagtcgacttccttcgattttacatggcgtccaaacaccatgtcaagtctgaccct

SEQ ID NO: 73146 - DNA, 201 bp, Homo sapiens
tcactgaaaaccatgtgcttcagaggttcataattcctctttcaccttccatttcacattagttaataaattatgagagaaaacattgtggatccaagttwtgtttcagaaaaaaaaaaacaggaaaaaaaaaagatggcaggagaaacttggtaaagtcaaagcaaagttgaaatgtcagtttaagacaaatagtttctc

SEQ ID NO: 73147 - DNA, 201 bp, Homo sapiens
atttaaaagataaaaacaaaaacaaaaattttagaggggggaaaaagaaaccttaagaaaattatgagtgccaatccagaaagtccaagagtagaattctagagagagagagagaaagcaaataggaagaaatcaaagcaataaatcaaaaaaatgcccagcgttgaagaacatgagttgcaaataaacaggaccaaagag

SEQ ID NO: 73148 - DNA, 201 bp, Homo sapiens
ggtcgggaggtttggtgcttggagggaggatacaggtttaggcccgacaaacacttagagcttgtgtggccatcttgtctttctaacggtgccatttcctycctgaggcgtggaggactggccagcccccaaacctccaagcccatcggctggatgccgtggataagcgaggggagagcgactaggccctgtctgcgggta

SEQ ID NO: 73149 - DNA, 201 bp, Homo sapiens
acggtgccatttcctccctgaggcgtggaggactggccagcccccaaacctccaagcccatcggctggatgccgtggataagcgaggggagagcgactagrccctgtctgcgggtaccttcggcgaggagaggcgacgaaggtctgcaccagcgaggcacggacaggcagcagggggtagggtatagggttggaggccgcc

SEQ ID NO: 73150 - DNA, 201 bp, Homo sapiens
ttaatttgttttcgtacaatttgtcccatgtagaaagtatctgacacttttcaagaaaatgttacatacccccagctttccaattcagttttgtagtcaayagcaatgtgttaagtctgtgctgatgttctcgtgttgccagtgaactctggggttccctgtgtggagcctgtctactctgtgtgtctctttctaggctag

SEQ ID NO: 73151 - DNA, 201 bp, Homo sapiens
taatcccagcaccttgggaggctgaggcgggcgggtcatgaggtcaggagatcgagaccatcctggctaacacagtgaaaccccatctctactaaaaattwaaaaaaaattagccgggcatggtggcgggcgcctgtagtcccagctactcgggaggctgaggcaggagaagggcgtgaacccaggaggtggaggttgcag

SEQ ID NO: 73152 - DNA, 201 bp, Homo sapiens
gggaggctgaggcgggcgggtcatgaggtcaggagatcgagaccatcctggctaacacagtgaaaccccatctctactaaaaattaaaaaaaaattagccrggcatggtggcgggcgcctgtagtcccagctactcgggaggctgaggcaggagaagggcgtgaacccaggaggtggaggttgcagtgagctgagatcacc

SEQ ID NO: 73153 - DNA, 201 bp, Homo sapiens
caagattgcaccactgcactccagcctgggcgacagagcgagactctgtctcaaaaaaataataaattaaataaataaatttcacatattgtaacatgcayacattgcttttactcttgaaaaaagaggctgaggccgggtgcggtggctcatgcctgtactcctggcattttgggaggcccaggcgggcggatcacttga

SEQ ID NO: 73154 - DNA, 201 bp, Homo sapiens
ctttcttttctctacacacatcagtaacagtcctttggcccccttagttcattcccagcagaccagataatttagaattctgataatttattatgatgaamttgatggggctcttagacttgataaattggtttaaatcagcctttgcaagttagttcagagataaattagtgctaaagaacatattctgagaaaagcaga

SEQ ID NO: 73155 - DNA, 201 bp, Homo sapiens
gtaatcccagcaccttgggaggctgaggcgggcgggtcatgaggtcaggagatcgagaccatcctggctaacacagtgaaaccccatctctactaaaaatwaaaaaaaaattagccgggcatggtggcgggcgcctgtagtcccagctactcgggaggctgaggcaggagaagggcgtgaacccaggaggtggaggttgca

SEQ ID NO: 73156 - DNA, 201 bp, Homo sapiens
tccatttccctggatcctgaatcaataggaacgtgttacaatgtttgctcattcttgcctgcttttaagtattttgaataagctaggcaattaaaaaaaawtttttaagagtgcttcataagatgaatggaaggttaagttgctgactaatattcttggatccagaatattagtccttcactttatggtcttgtacatagc

SEQ ID NO: 73157 - DNA, 201 bp, Homo sapiens
ttcctgtccactcagcaccacctggaaaaactcttactcgtcttttaaaccgcagttcaaggaccacattctgtaggaagactttccaacaggtaaccacwgcctatttcctatgtccacaccttacacatatttctatcattgcacttatcacaccataatgtaattactcttctacaaataagtctctcacactagacc

SEQ ID NO: 73158 - DNA, 201 bp, Homo sapiens
tggtcttgaactcctgacctcaagtggtctgcctacctcggcctcccaaagtgctggaattacaggcgtgagcatcacgtctggcctaatttttttaatcraatttatttttgtaatgatagatgcttgtcttattcctagggaaatatttgaagtaattgagatgctgtcacctaaaataatcaaaaggctcctgattca

SEQ ID NO: 73159 - DNA, 201 bp, Homo sapiens
tgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcg

SEQ ID NO: 73160 - DNA, 201 bp, Homo sapiens
cctttggtacattgtgaacagtctaatatatggattatattcacagagaagacaggaaagcaaaaaaaaaaaacatgaaaaaataatgcctgggaattgtscaattttcagcaaagttgtaaatgcacagatccaagaagcttgacaaataccaggcaaaataaatataaagaaaactacaccaggacgcatcataacacg

SEQ ID NO: 73161 - DNA, 201 bp, Homo sapiens
attgaagataagaggagtgaccactgaattgtcattaggaataacataactggtcgggcgtgatggctcatgcctgtaatcccagcactctgggaggccaragcgggtggatcatttgaggtcaggagtttgagaccagcctggccaacatggcaaaaccccatctctactaaaaatacaaaaacctgggcgtggtggtgc

SEQ ID NO: 73162 - DNA, 201 bp, Homo sapiens
tgggtaagtaattgtttatcgtggagaaatgctttactacatgggtttgtaagttttacccaaactgtgtattttaatataagaattaagataatttgagrgagaagagttttgtatgtattttttttaaataagtgacaattctaaaattaattttagacttaagcccttagatgtggcgtttatgaaggcaatacacaa

SEQ ID NO: 73163 - DNA, 201 bp, Homo sapiens
ggtagggggatacagcagggggttcaggcaggaggatcacttgagcccagaagttggaggccaacctcagcaacatagcaatacgctgtctctaaaaaaawatatatatatattttatatatataatatataattaataaatatatataatatatattacatatatattatatctatattatttatattacatatgtaata

SEQ ID NO: 73164 - DNA, 201 bp, Homo sapiens
attatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcct

SEQ ID NO: 73165 - DNA, 201 bp, Homo sapiens
catgaggggagcatcccgcacagctgagcccagtcttggtgtgcctgggtctcagaccccatagttgtctcaggagaaatggaggttcccctgagccagcmtttctcctgtctgggcttctgggaaacgaagggtcaggtttcactctggaatccacagcaccataggaggagtctcttaagtgcccgggtgtttcctgaa

SEQ ID NO: 73166 - DNA, 201 bp, Homo sapiens
ttatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcctg

SEQ ID NO: 73167 - DNA, 201 bp, Homo sapiens
gatccgtttgcactgagaaggcagagggtgaaagaaagctaggaacttcctacctattctcagtgtcaagcgaagagacatcacatgaaacaggggtaggrgacacaaatacagacgtcaagcaaatatgctctttagagttggaggcaaagatcaaggaaatctactaaggctgaagtagatactctgcaggggaggaaa

SEQ ID NO: 73168 - DNA, 201 bp, Homo sapiens
ggactgagccaaagggtgcaaggacagccggcaaggcccgggccaagacctatccccgcccagcgagccaggcctcgcccagcacctatccgcgcccagcragcctaggcctcgcccagcacctatccgcgcccagcaagcctaggcctcgcccagcacctatccgcgcccagcgagcctagacctcgcccaagacctagc

SEQ ID NO: 73169 - DNA, 201 bp, Homo sapiens
tatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacgcctgt

SEQ ID NO: 73170 - DNA, 201 bp, Homo sapiens
ggtaagtgcctgctcttttctatcctcagcattggcatttaatctttccatgtgaacttaaagctcattttatccaatcctttaagaaaaaagccacaccrttagggattccagttagaaatggactaaataacatactcatttggggaaaataaaaatgatttgatttatgtaggacctgttttctagtttggtccctac

SEQ ID NO: 73171 - DNA, 201 bp, Homo sapiens
ccgttttaaagtagaggaaagggaggttgagagaggtggaatgaccagtttagggtcacacctagggtacttgcaaataccatctgtacttctcatgtgcyctatccttgttgcagattctcattaggtggttcactgttaacaaactaaatgctgatgatgcagtttcctggactgcagacgtttgctggcttatttacc

SEQ ID NO: 73172 - DNA, 201 bp, Homo sapiens
aaggacaccccagagtgggccatagggacccgcagggtatgggcctggaggtgcctggtggaggcattttgagccgtttgcctttttagcatttctttaamttgtatcttaaaggtgggaatcaagtgttaggtgttaatatttttactccactaagggctagaaatactcataagccagtgggtagcctttgggaaaccc

SEQ ID NO: 73173 - DNA, 201 bp, Homo sapiens
cacctcactagacatttccacggccatactcattatcctgaaatcccagcagctttatgtacaatttaccaagtaattttaattactgctatttcttctaygtacttgatgggtggttttttttctcatgagaatgtcatgtgcgtgatgccaccttggtgcattcctcttctctttcagcacccacatgcaggatctcca

SEQ ID NO: 73174 - DNA, 201 bp, Homo sapiens
gagtgtcccgcgtggactcgcgggttgagttgtgccccgtggaggccggcagggccgtgggccggggagtgtcccatcccggaaggacaccccagagtggsccatagggacccgcagggtatgggcctggaggtgcctggtggaggcattttgagccgtttgcctttttagcatttctttaaattgtatcttaaaggtggg

SEQ ID NO: 73175 - DNA, 201 bp, Homo sapiens
gggtgccgcgtggaggaggccggtggggctgtagaccggggagtgtcccgcgtggactcgcgggttgagttgtgccccgtggaggccggcagggccgtggsccggggagtgtcccatcccggaaggacaccccagagtgggccatagggacccgcagggtatgggcctggaggtgcctggtggaggcattttgagccgttt

SEQ ID NO: 73176 - DNA, 201 bp, Homo sapiens
tttaaaagataaaaacaaaaacaaaaattttagaggggggaaaaagaaaccttaagaaaattatgagtgccaatccagaaagtccaagagtagaattctagagagagagagagaaagcaaataggaagaaatcaaagcaataaatcaaaaaaatgcccagcgttgaagaacatgagttgcaaataaacaggaccaaagagt

SEQ ID NO: 73177 - DNA, 201 bp, Homo sapiens
aaaattttagaggggggaaaaagaaaccttaagaaaattatgagtgccaatccagaaagtccaagagtagaattctagagagagagagagaaagcaaatargaagaaatcaaagcaataaatcaaaaaaatgcccagcgttgaagaacatgagttgcaaataaacaggaccaaagagtaggcaagacgatggatgaaaaca

SEQ ID NO: 73178 - DNA, 201 bp, Homo sapiens
tttccttcacccactttcatatcagcttgccagcttcccctttactcagtgcgtcatgagcttcataaacacagcatagtgctagatatacaggcaaaacyccattgtagtgttggatactgagctgaggtaattccggtcatgttctctgagatcagaatatagagtcctttgaccatagcgtatttgtcaatgccacag

SEQ ID NO: 73179 - DNA, 201 bp, Homo sapiens
tttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaa

SEQ ID NO: 73180 - DNA, 201 bp, Homo sapiens
aaacctgttcttgacccatgttctctaccaccctgttcctctgccccttttcacagtcacgttcctgaaaagaattggcagccctggctgggtgcgatggytcatgcctgtaatcccagcactttgggaggctgaggtgggctgatcacaaggtcaggagttcgagaccagcctggccaacatggtgaaaccctgtctcta

SEQ ID NO: 73181 - DNA, 201 bp, Homo sapiens
taattttcagtcgcatacaactaaggagttatactagataagtttttctttttttaatgctcctagttgaatactactggttttctgatagaagtatgacyttctggaagtgtttatactttttaaaaaatttgtgaaaactgataacctatgtttgtttcatgtctaactgattatatcttaaaagcaactactaaggtg

SEQ ID NO: 73182 - DNA, 201 bp, Homo sapiens
aggctgaggtgggctgatcacaaggtcaggagttcgagaccagcctggccaacatggtgaaaccctgtctctactaaaaatacaaaaattagccgggcgtrgtggcgtgtgcctataatcccagctacttgggaggctgaggcaggagaatcgcttgaaccctggaagcagaggttgcagtgagccgagatcacgccactg

SEQ ID NO: 73183 - DNA, 201 bp, Homo sapiens
agtttttctttttttaatgctcctagttgaatactactggttttctgatagaagtatgaccttctggaagtgtttatactttttaaaaaatttgtgaaaamtgataacctatgtttgtttcatgtctaactgattatatcttaaaagcaactactaaggtgtttattagtttgtttgttttttaatcttatttagcaacag

SEQ ID NO: 73184 - DNA, 201 bp, Homo sapiens
tctactaaaaatacaaaaattagccgggcgtggtggcgtgtgcctataatcccagctacttgggaggctgaggcaggagaatcgcttgaaccctggaagcrgaggttgcagtgagccgagatcacgccactgcactccagcctgggcaacagtgcaagactcagtctcaaaaaaaaaaagaacgaattggcagccctgtct

SEQ ID NO: 73185 - DNA, 201 bp, Homo sapiens
actgcctaattaatattttatgtcttagctgtgtgttttgtttgttcttgttcagctttgaacacaaggaaaacacttttatggggtaggtgtgctgcacygaggtccttggatttgggttgtagactttctttgacacgtatccatggatccatcctctcttgagtttgtctgtaaaatgtaataagtagtttctgccta

SEQ ID NO: 73186 - DNA, 201 bp, Homo sapiens
acatattatatatacatttttatatattatatatatataaatataatatacatatattttttaaaataaaagagtttctaggccgagtgtggtggctcacrcctgtaatcccagcactttggaaggctgaggcaggcacatcaccagaggtcaggaggtcgagaccagcctggccaacatggcaaaactccgtctctaaaa

SEQ ID NO: 73187 - DNA, 201 bp, Homo sapiens
aaaaaactgggtgaatgaaaccttgtctcaaaaaaaaaaaaaaaaaaaaaaaaaatccaggcatttacagtgtaacattcacaatgtctaatgtctaataraaaattgtgtggcatcaaagaaacaaaaactgtacataatcaggagaaaaagcaggcaatagaaacagatccagaaatgatagaaatggatctcgatggc

SEQ ID NO: 73188 - DNA, 201 bp, Homo sapiens
tacatttttatatattatatatatataaatataatatacatatattttttaaaataaaagagtttctaggccgagtgtggtggctcacgcctgtaatcccwgcactttggaaggctgaggcaggcacatcaccagaggtcaggaggtcgagaccagcctggccaacatggcaaaactccgtctctaaaaaattacaaaagt

SEQ ID NO: 73189 - DNA, 201 bp, Homo sapiens
cccagcagctttatgtacaatttaccaagtaattttaattactgctatttcttctatgtacttgatgggtggttttttttctcatgagaatgtcatgtgcrtgatgccaccttggtgcattcctcttctctttcagcacccacatgcaggatctccaggaggtgacccaggaccttcattatgaaaacttccgttctgaga

SEQ ID NO: 73190 - DNA, 201 bp, Homo sapiens
tcttgaagaacacataggagttcaatgaacttctcaagagaagggaagtgtgccacagcaagtcagtcttccattctcgggtgggggtccctaggccagargaaggccgtcctggccgccaccacggagcagcctgtctcagccttagcacagcctcgcgcgatccttcgatgatccccttcggtccctgtagtcccacga

SEQ ID NO: 73191 - DNA, 201 bp, Homo sapiens
taccacatcacaccacttggagatctttgcttccttgcttttatgtttgtacacaacacctaaaaccagttttgctgctataattctatactgttgattcrtctgcgattttatctgttaaccaaataaaacataatagaatttcctaatgagatatatctttatacttaaacagcttttttagaggtgagttttaaagaa

SEQ ID NO: 73192 - DNA, 201 bp, Homo sapiens
tcatccagactgagaaatgtgtaaattattttttactcatcacttctgactcctctgctcacttttaaatagcttactaactgtttccgaactcttctctyctccaaagtgtaagctccatctttatgaggccagcataggacaaaagatgaggttagcatggatggatagtagaccaggaaaggggccgtaagatgagga

SEQ ID NO: 73193 - DNA, 201 bp, Homo sapiens
cgactaggccctgtctgcgggtaccttcggcgaggagaggcgacgaaggtctgcaccagcgaggcacggacaggcagcagggggtagggtatagggttggrggccgccgagttggcccggggatgaggagcaaacctgtggcttccgtggtctcagtggagtcccaactgtgacctggcctactggcccagacaaacctgg

SEQ ID NO: 73194 - DNA, 201 bp, Homo sapiens
cggtggctcacgcttgtaatcccagcactttgggaggcggaggcgggtggatcacgaggtcaggagtttgagaccagcctgaccaatgtggtgaaaccccrtctctactgaaaatacaaaaatcagctgggcgtggtggtgtgtgcctgtaatcccagctactcaggaggctgaggcaggagaatcgcttgaacccgggag

SEQ ID NO: 73195 - DNA, 201 bp, Homo sapiens
tcccagtcatttagtctagttttgaataaagaatagggggtctggttaatatatacatctaaacacaaaagtcagaaagaataaaagtagtgatgttacaygagccagctgtcagtgcttaacttttccctttggcctaatgcatttggaaggtcctgaaattgtattttctttttacattgcctatgtatgtgtaagtct

SEQ ID NO: 73196 - DNA, 201 bp, Homo sapiens
cctgagcccaggagttcaaggatgcagtgagctatgattgtgccactgcagtctagcctaggtgaaagagcaagatcccatccctttaaaaaaaaaaaaawatatatatatgtatatgtatgtatatatattatttttattgtgaggccttcattgccctccagaaaagctgattcattcccattcccctttactttgcat

SEQ ID NO: 73197 - DNA, 201 bp, Homo sapiens
ttttctctctgggtttttgtttttgttttgtttccgtgggatatttttgtctgggccactgtgtaaatgtttgataaccctgaggtggcagtgggttagcrtgttggtcttgtgtagactgccttataacaggcgacacagattttctcagtaccagagagatgggagaggacatttgaggtagggaagcatggagtaacc

SEQ ID NO: 73198 - DNA, 201 bp, Homo sapiens
cccctgagcccaggagttcaaggatgcagtgagctatgattgtgccactgcagtctagcctaggtgaaagagcaagatcccatccctttaaaaaaaaaaawatatatatatatgtatatgtatgtatatatattatttttattgtgaggccttcattgccctccagaaaagctgattcattcccattcccctttactttgc

SEQ ID NO: 73199 - DNA, 201 bp, Homo sapiens
gattgtttatataggcaaaatggaggtgccaaacagaattataacattttcggaactaaggctcatttaaagatacaaatttgattggctactattgattrcacttgaagggatttgtttaacttccttttgtaaagaagtaacagtcataaggatctctcatctcccagtcatttagtctagttttgaataaagaatagg

SEQ ID NO: 73200 - DNA, 201 bp, Homo sapiens
ttaaataataatagttaatgaaggtgtgctacagaaaataatctggtgttcttgctaactttgcccttcactgttgcttaattgtgaacagccaaaagctrtatgttatggcttattgtgtgaaggtaactaagaagtggtgttccatgacttcagagtacatccatgcggagtccattatttgagtttgacatttaataa

SEQ ID NO: 73201 - DNA, 201 bp, Homo sapiens
ggtttcatcatgttggccaggctggtctcgaactcctaacctcaggtgatctgcccaccttggcctcccaaagtgctgggattacaggtgtgagccaccgkgcccagccaaaaagtactattcttgtgactgaaggtgttttgtttacatccgtagatatcattggtaattaacttaaagtttatagttttttttttaatt

SEQ ID NO: 73202 - DNA, 201 bp, Homo sapiens
tggcgggcatctgtagtcccagccactcaggaggctgaagcaaaagaatcgcttcaacccaggaggcagaggttgtttgcagtccagcctgggtgacagagcaagactccgtctcaagaaaaaaaaaaaagaatttctgtaattacccacagaaagaacaactgttaagtatatatccttctagaacatagcttatgtttt

SEQ ID NO: 73203 - DNA, 201 bp, Homo sapiens
tgagaccctgtctcaacaacaaaagtttcctgtgttgtaattcattaaaattctcacattctaataatttgatggatttctagatacatatgttgtacacrttgaagtctaattatgagtttggaaatgagacattaagaaagattttagaggcagcaagaaaattccaccctctggaagctgagtaggcgctggccctga

SEQ ID NO: 73204 - DNA, 201 bp, Homo sapiens
caaacctttttatattttatactgcactttagtgtattttctgtcactgtaggtatagaagatctgcctcccctgtggaaattggggtctgttggtgggcktgcccctgaagcctggcttgggttgaaaagtgttcccgccctaaggccttggtgccctgaacctctgatgcctaccgggttctcctgatttgagtttcct

SEQ ID NO: 73205 - DNA, 201 bp, Homo sapiens
cagcctgaccaacatggtgaaaccccatctgtacttaaagtgcaaaaaataaattagccaagcgtggtggtgcgcacctgtaatcccagctactcaggagsctgaggcaggagaatcactgttgaaccaggaggcagaggttgcagtgagccaagattgcaccactgcactccagcctgggcgacagagcgagactctgtc

SEQ ID NO: 73206 - DNA, 201 bp, Homo sapiens
cccgcccagcgagccttggcttcgcctaggacattgcctcgctcagcaagccgacgccccgcccaacgagccgagcgctgcacagatttatatcctacgcmgctgcctgcctgctcccgccccttctccgtccgttcaccaatcagaactcgatcttgcgctttcaggccgcgggacgggaaggctccgccctggcgcccc

SEQ ID NO: 73207 - DNA, 201 bp, Homo sapiens
actaatttggtttttactcaaccaaattaaaaatttttttaaggaaaattagcagttggtctattcagaatcaaacctttttatattttatactgcacttyagtgtattttctgtcactgtaggtatagaagatctgcctcccctgtggaaattggggtctgttggtgggcgtgcccctgaagcctggcttgggttgaaaa

SEQ ID NO: 73208 - DNA, 201 bp, Homo sapiens
ccgtccgttcaccaatcagaactcgatcttgcgctttcaggccgcgggacgggaaggctccgccctggcgccccgcaggccaatcgactgcgcgtccgcgkcgcgggggcggggtcagggcggggcgcgctgcgcgggggctgccggcgggcagttgggagcaggcgacgccgacgcgagtctggcggctgctgcttgcga

SEQ ID NO: 73209 - DNA, 201 bp, Homo sapiens
attattttcttggtttccagatgttgaacgttgtggtgcttttacaattgaagagaaaaagcattctgacacattatactggttggggttctctgcttttstacttggtcaaaaacctttacacgcattttggactttgtgtcatcataacttggcaattgggaaagccgcatgatatgcttctttcagaacttggttact

SEQ ID NO: 73210 - DNA, 201 bp, Homo sapiens
ggcatgtatacttaatactgaatttctttgatttaactgacttaacaactgactaaccattgatgagcactcctgatttttatctagaacattcagatttrccataatgttccttagtggtagaggtgtgtgcctagtgatgtagaaagatacactgacttggtgcaaggccatctgcttaccacatcacaccacttggag

SEQ ID NO: 73211 - DNA, 201 bp, Homo sapiens
agatgctgaagactgcctaattaatattttatgtcttagctgtgtgttttgtttgttcttgttcagctttgaacacaaggaaaacacttttatggggtagrtgtgctgcaccgaggtccttggatttgggttgtagactttctttgacacgtatccatggatccatcctctcttgagtttgtctgtaaaatgtaataagta

SEQ ID NO: 73212 - DNA, 201 bp, Homo sapiens
tgggttgtagactttctttgacacgtatccatggatccatcctctcttgagtttgtctgtaaaatgtaataagtagtttctgcctatattaaatatttgakggaaggattaagtgagaatgttttacatcaaaaatgctgtgtaactagaagattactaggatagatgttcgaattcatctactgtcagaaagttccagca

SEQ ID NO: 73213 - DNA, 201 bp, Homo sapiens
tcatactgcaaacatagtagtactgtaggtactaaacacagaatgatgtttgtgaggtacttagcccagtaccaggccttatgtaaacacttaaccgattsaatggtgtcatatgaataaggtcatgacaaggtttttctttttatttaaaggtgaatcaggtctaggaaaatcgactctcataaacagcctattcctaac

SEQ ID NO: 73214 - DNA, 201 bp, Homo sapiens
gggggacgcgccgctcgtcccatactctcgggcggtggtcggctggctctggggtgccggcggggcggtgtgggggaggggcggccgagcccaggctcttyggcacttatcgtgggctcccccgtcccgggcggtcctagtgccggcgacagtggctccgacacgggcaggcccgggcgcgggagtggggattccggtgac

SEQ ID NO: 73215 - DNA, 201 bp, Homo sapiens
ggataagcgaggggagagcgactaggccctgtctgcgggtaccttcggcgaggagaggcgacgaaggtctgcaccagcgaggcacggacaggcagcagggkgtagggtatagggttggaggccgccgagttggcccggggatgaggagcaaacctgtggcttccgtggtctcagtggagtcccaactgtgacctggcctac

SEQ ID NO: 73216 - DNA, 201 bp, Homo sapiens
ttaacttttccctttggcctaatgcatttggaaggtcctgaaattgtattttctttttacattgcctatgtatgtgtaagtcttcttcaggtcagttcacrctgttaaatatacgtgcgtatacatacatactatgtatgtgcgtttatgtgtgtctgtgtgttttttttttaacagacgaagcttcacaaaagatgtcta

SEQ ID NO: 73217 - DNA, 201 bp, Homo sapiens
tttgaccatagcgtatttgtcaatgccacagggagttgaaaagttgaggatcctacaaagcaatatgataaagcccagtctttggtgattttctggggagygtttagttgacagtgattctataaattggtctaatctttttggaaagtagcagtatgtggcaaagattttgattttggaatcacacttttcaaaacaatc

SEQ ID NO: 73218 - DNA, 201 bp, Homo sapiens
accactgttaatatgttacatatattctttttcacctgtgtgtgcatttgactatacatttacaaaatgtaatcctaaaggaaatactattttgtatcttrcctttttcaattaataaattgatttttaaaatttcttctcattttcagtatgccactgtctagattctggttacttctgctattcttgccttctcatatc

SEQ ID NO: 73219 - DNA, 201 bp, Homo sapiens
attcttgaaatcatccagactgagaaatgtgtaaattattttttactcatcacttctgactcctctgctcacttttaaatagcttactaactgtttccgarctcttctctcctccaaagtgtaagctccatctttatgaggccagcataggacaaaagatgaggttagcatggatggatagtagaccaggaaaggggccgt

SEQ ID NO: 73220 - DNA, 201 bp, Homo sapiens
ctatattatttatattacatatgtaatatatattatatttatattatttatataatatattatatatattatattatttatatgtaatatatttatattgkttatatatattatatttatattatttatatataatacatattatatttatattatttatatataatatatataataaatatataatatatataaaaatat

SEQ ID NO: 73221 - DNA, 201 bp, Homo sapiens
gctacaccaaagaatggtgattagcgctcccagggtggggaaaaatgaggattgtttatataggcaaaatggaggtgccaaacagaattataacattttcrgaactaaggctcatttaaagatacaaatttgattggctactattgattacacttgaagggatttgtttaacttccttttgtaaagaagtaacagtcataa

SEQ ID NO: 73222 - DNA, 201 bp, Homo sapiens
aaataagctgtgggtcaagattaaagaactttaaacaacttctggcatgtggaataaacacgatctgaaggaacaaaattttcatttgactacatttttgrtccaatttgcacccagtgtttaagttaatcacagtgcttggcagtttgtgttgctggatcaaggctttctcactgaaaaccatgtgcttcagaggttcat

SEQ ID NO: 73223 - DNA, 201 bp, Homo sapiens
gttttgaataaagaatagggggtctggttaatatatacatctaaacacaaaagtcagaaagaataaaagtagtgatgttacacgagccagctgtcagtgcytaacttttccctttggcctaatgcatttggaaggtcctgaaattgtattttctttttacattgcctatgtatgtgtaagtcttcttcaggtcagttcacg

SEQ ID NO: 73224 - DNA, 201 bp, Homo sapiens
ggccgtgggccggggagtgtcccatcccggaaggacaccccagagtgggccatagggacccgcagggtatgggcctggaggtgcctggtggaggcattttsagccgtttgcctttttagcatttctttaaattgtatcttaaaggtgggaatcaagtgttaggtgttaatatttttactccactaagggctagaaatactc

SEQ ID NO: 73225 - DNA, 201 bp, Homo sapiens
gttcacgccattctcccacctcagcctccaagtagctaagattacaggcacccgccaccacacctggctaattttgtttctgtatttttagtagagacggkgtttcaccgtgttagccatgatggtctcgatctcctgacttcgtgatccgcccgcctcggcctctcaaagcgctaggattaatataaatcttacacagac

SEQ ID NO: 73226 - DNA, 201 bp, Homo sapiens
cctggctatggtgacgctatcaactgcagagattggtatgctcccccatgcccagggatctgcatttgtttacttaatatacttcataaatttatagatartgttaatgagtgattattaagtttgggattgctgtatataataaaacacctagacaatttaaagcgtgttaaatgttgactttttaaataaggaatttta

SEQ ID NO: 73227 - DNA, 201 bp, Homo sapiens
tggttttactacccaaatctaaatagatacttttgataatagataactgctcttttactaagacatagtctctacctatagaaatgtattttgaaaacacktattttacacagcaattttgtatccatttaaactaaccttttatcaataaagcactattgtttagatattaaatgagtatttctcttggttatttgcaag

SEQ ID NO: 73228 - DNA, 201 bp, Homo sapiens
caggcacgctgcctcctggtaacagctatgcagggagggaggacccacactgctacacttctgatcccctttggttttactacccaaatctaaatagatasttttgataatagataactgctcttttactaagacatagtctctacctatagaaatgtattttgaaaacacttattttacacagcaattttgtatccattt

SEQ ID NO: 73229 - DNA, 201 bp, Homo sapiens
gagtgcagtgctacaatctcggctcactgcaacctccgcctcctgggttcaagcgattctcatgcctcagcctcttgagcagctgggattacaggcgcgcrccaccatgccaggctaatttttgtatttttagtagagacagggtttcaccatgttggtcaggctggtctcgaactcctgacctcaagtgtccacccgcct

SEQ ID NO: 73230 - DNA, 201 bp, Homo sapiens
aagaacaggctgagagtattgcttaaactatacctctttaatcagaggacttcaaagaatgactgatgtggataaatcagtgttttgattagctgaaagtygctacatatttgccgcatgtctcacttagtttagcaatttgtagtgagttaaaataagtaagcatgttaccatccaagctgtgtcaaacacaatttaatg

SEQ ID NO: 73231 - DNA, 201 bp, Homo sapiens
tcctaaattgtctcaagtgcctgccagttttttagaaagtatttgaacctttgaagaacccctggaagcgtagacgtttttatgctaataaatactttagyaattcctacttaagggaacttcaccttttgtactctgctatattaaatttctttgaggtagaaatgggggtggtgtcagggttagaatgctgtaattcta

SEQ ID NO: 73232 - DNA, 201 bp, Homo sapiens
ccagccttggtctgctaaagtgctgggattataggtgtgagccactatgcccagccagaaataatttttcaaaagagatgtgtactccttcctcatgcttwgcagaacttaacagagggtggtttagggtacccagaggacagtccagcaccagtagtaccaagatcagaagcagttctccatgcagaattgagacctaga

SEQ ID NO: 73233 - DNA, 201 bp, Homo sapiens
agcccagtctttggtgattttctggggagcgtttagttgacagtgattctataaattggtctaatctttttggaaagtagcagtatgtggcaaagattttsattttggaatcacacttttcaaaacaatctgataaactttgttgtgtcagtagggtagagtactccatagcaagtaaacatgcttccacaagctgaatcc

SEQ ID NO: 73234 - DNA, 201 bp, Homo sapiens
tttatattatttatatataatatatataataaatatataatatatataaaaatatatatatttaatatatctataatatatattatatatattatatatawtatatataattgtacatatatttattatatatattatatatataatatatattataaatataatatataaatatatttataaatatatataaatattata

SEQ ID NO: 73235 - DNA, 201 bp, Homo sapiens
ttatattatttatatataatatatataataaatatataatatatataaaaatatatatatttaatatatctataatatatattatatatattatatataawatatataattgtacatatatttattatatatattatatatataatatatattataaatataatatataaatatatttataaatatatataaatattatat

SEQ ID NO: 73236 - DNA, 201 bp, Homo sapiens
actccactaagggctagaaatactcataagccagtgggtagcctttgggaaacccatgaaaactggggaccagaatatggcccagtacattacacacccgrattacgggcaccttttccgtttacgctatggcagcaacccctggcctatcatgtgccattaatggatgtgaaaagcagaaattagaacaaggcatcattg

SEQ ID NO: 73237 - DNA, 201 bp, Homo sapiens
gttttaattgattgactgatgaatgcattcgtatttcaacttcagcccagttctttctcccctcaagccccatcccccacactactgcctgcttgataggwccgattgtgggatttcactgctgactgctggctgcctgttgaatgaaatacagatccccaggtcgctagcctggtgttgatggaactctccactttgtaa

SEQ ID NO: 73238 - DNA, 201 bp, Homo sapiens
cctgattttttttcctcaacttccaccttgatttctctcaccagtgccacagccaggaataaagaacaagagcgttttaattagatcagatttacattctsactggctcttaaactagcaaggtgacctagggaaaggggccagggtttccctctatcattcataaatgtaattcagggcccctttttatccccaatacca

SEQ ID NO: 73239 - DNA, 201 bp, Homo sapiens
caagctacgcctgacagtggtagatacccctggctatggtgacgctatcaactgcagagattggtatgctcccccatgcccagggatctgcatttgtttasttaatatacttcataaatttatagatagtgttaatgagtgattattaagtttgggattgctgtatataataaaacacctagacaatttaaagcgtgttaa

SEQ ID NO: 73240 - DNA, 201 bp, Homo sapiens
agacccctggatactgaaacttgctctctctagttcctcagctgacagctgccacgcctgctgccttccctccagactgccagcctcaggtcaccagcacrcaccctgcatcctaccaggggtcagtaccaccctctggccaggctctcacctgcactatccccacccggccctgcccgtctgcaggcagggatcctctgt

SEQ ID NO: 73241 - DNA, 201 bp, Homo sapiens
ggctgaagtagatactctgcaggggaggaaacatgattaggggaaggatgttggcacttctttcttacaagcctttctaggattatctgactctacaaatkacatgaagctgtaaccttgatttgaaataagattaatatgaatgctaataaaaagtagtaagggagagtatgtagtcaatgtattcttaccaaattaaca

SEQ ID NO: 73242 - DNA, 201 bp, Homo sapiens; identical to SEQ ID NO: 26192

SEQ ID NO: 73243 - DNA, 201 bp, Homo sapiens; identical to SEQ ID NO: 26195

SEQ ID NO: 73244 - DNA, 201 bp, Homo sapiens; identical to SEQ ID NO: 26197

SEQ ID NO: 73245 - DNA, 201 bp, Homo sapiens; identical to SEQ ID NO: 25990

SEQ ID NO: 73246 - DNA, 201 bp, Homo sapiens; identical to SEQ ID NO: 25992

SEQ ID NO: 73247 - DNA, 201 bp, Homo sapiens; identical to SEQ ID NO: 26643

SEQ ID NO: 73248 - DNA, 201 bp, Homo sapiens; identical to SEQ ID NO: 25994

SEQ ID NO: 73249 - DNA, 201 bp, Homo sapiens; identical to SEQ ID NO: 25995

SEQ ID NO: 73250 - DNA, 201 bp, Homo sapiens; identical to SEQ ID NO: 25996

SEQ ID NO: 73251 - DNA, 201 bp, Homo sapiens; identical to SEQ ID NO: 26423

SEQ ID NO: 73252 - DNA, 201 bp, Homo sapiens; identical to SEQ ID NO: 26206

SEQ ID NO: 73253 - DNA, 201 bp, Homo sapiens; identical to SEQ ID NO: 26424

SEQ ID NO: 73254 - DNA, 201 bp, Homo sapiens; identical to SEQ ID NO: 26213

SEQ ID NO: 73255 - DNA, 201 bp, Homo sapiens; identical to SEQ ID NO: 26427

SEQ ID NO: 73256 - DNA, 201 bp, Homo sapiens; identical to SEQ ID NO: 26001

SEQ ID NO: 73257 - DNA, 201 bp, Homo sapiens; identical to SEQ ID NO: 26215

SEQ ID NO: 73258 - DNA, 201 bp, Homo sapiens; identical to SEQ ID NO: 26002

SEQ ID NO: 73259 - DNA, 201 bp, Homo sapiens; identical to SEQ ID NO: 26003

SEQ ID NO: 73260 - DNA, 201 bp, Homo sapiens; identical to SEQ ID NO: 26004

SEQ ID NO: 73261 - DNA, 201 bp, Homo sapiens; identical to SEQ ID NO: 26005

SEQ ID NO: 73262 - DNA, 201 bp, Homo sapiens; identical to SEQ ID NO: 26006

SEQ ID NO: 73263 - DNA, 201 bp, Homo sapiens; identical to SEQ ID NO: 26007

SEQ ID NO: 73264 - DNA, 201 bp, Homo sapiens; identical to SEQ ID NO: 26008

SEQ ID NO: 73265 - DNA, 201 bp, Homo sapiens; identical to SEQ ID NO: 26219

SEQ ID NO: 73266 - DNA, 201 bp, Homo sapiens; identical to SEQ ID NO: 26222

SEQ ID NO: 73267 - DNA, 201 bp, Homo sapiens; identical to SEQ ID NO: 26225

SEQ ID NO: 73268 - DNA, 201 bp, Homo sapiens; identical to SEQ ID NO: 26227

SEQ ID NO: 73269 - DNA, 201 bp, Homo sapiens; identical to SEQ ID NO: 26230

SEQ ID NO: 73270 - DNA, 201 bp, Homo sapiens; identical to SEQ ID NO: 26232

SEQ ID NO: 73271 - DNA, 201 bp, Homo sapiens; identical to SEQ ID NO: 26234

SEQ ID NO: 73272 - DNA, 201 bp, Homo sapiens; identical to SEQ ID NO: 26236

SEQ ID NO: 73273 - DNA, 201 bp, Homo sapiens; identical to SEQ ID NO: 26240

SEQ ID NO: 73274 - DNA, 201 bp, Homo sapiens; identical to SEQ ID NO: 26243

SEQ ID NO: 73275 - DNA, 201 bp, Homo sapiens; identical to SEQ ID NO: 26245

SEQ ID NO: 73276 - DNA, 201 bp, Homo sapiens; identical to SEQ ID NO: 26433

SEQ ID NO: 73277 - DNA, 201 bp, Homo sapiens; identical to SEQ ID NO: 26434

SEQ ID NO: 73278 - DNA, 201 bp, Homo sapiens; identical to SEQ ID NO: 26435

SEQ ID NO: 73279 - DNA, 201 bp, Homo sapiens; identical to SEQ ID NO: 26436

SEQ ID NO: 73280 - DNA, 201 bp, Homo sapiens; identical to SEQ ID NO: 26437

SEQ ID NO: 73281 - DNA, 201 bp, Homo sapiens; identical to SEQ ID NO: 26021

SEQ ID NO: 73282 - DNA, 201 bp, Homo sapiens; identical to SEQ ID NO: 26438

SEQ ID NO: 73283 - DNA, 201 bp, Homo sapiens; identical to SEQ ID NO: 26439

SEQ ID NO: 73284 - DNA, 201 bp, Homo sapiens; identical to SEQ ID NO: 26440

SEQ ID NO: 73285 - DNA, 201 bp, Homo sapiens; identical to SEQ ID NO: 26665

SEQ ID NO: 73286 - DNA, 201 bp, Homo sapiens; identical to SEQ ID NO: 26441

SEQ ID NO: 73287 - DNA, 201 bp, Homo sapiens; identical to SEQ ID NO: 26022

SEQ ID NO: 73288 - DNA, 201 bp, Homo sapiens; identical to SEQ ID NO: 26442

SEQ ID NO: 73289 - DNA, 201 bp, Homo sapiens; identical to SEQ ID NO: 26023

SEQ ID NO: 73290 - DNA, 201 bp, Homo sapiens; identical to SEQ ID NO: 26443

SEQ ID NO: 73291 - DNA, 201 bp, Homo sapiens; identical to SEQ ID NO: 26445

SEQ ID NO: 73292 - DNA, 201 bp, Homo sapiens; identical to SEQ ID NO: 26025

SEQ ID NO: 73293 - DNA, 201 bp, Homo sapiens; identical to SEQ ID NO: 26026

SEQ ID NO: 73294 - DNA, 201 bp, Homo sapiens; identical to SEQ ID NO: 26268

SEQ ID NO: 73295 - DNA, 201 bp, Homo sapiens; identical to SEQ ID NO: 26270

SEQ ID NO: 73296 - DNA, 201 bp, Homo sapiens; identical to SEQ ID NO: 26271

SEQ ID NO: 73297 - DNA, 201 bp, Homo sapiens; identical to SEQ ID NO: 26272

SEQ ID NO: 73298 - DNA, 201 bp, Homo sapiens; identical to SEQ ID NO: 26273

SEQ ID NO: 73299 - DNA, 201 bp, Homo sapiens; identical to SEQ ID NO: 26274

SEQ ID NO: 73300 - DNA, 201 bp, Homo sapiens; identical to SEQ ID NO: 26275

SEQ ID NO: 73301 - DNA, 201 bp, Homo sapiens; identical to SEQ ID NO: 26029

SEQ ID NO: 73302 - DNA, 201 bp, Homo sapiens; identical to SEQ ID NO: 26030

SEQ ID NO: 73303 - DNA, 201 bp, Homo sapiens; identical to SEQ ID NO: 26674

SEQ ID NO: 73304 - DNA, 201 bp, Homo sapiens; identical to SEQ ID NO: 26452

SEQ ID NO: 73305 - DNA, 201 bp, Homo sapiens; identical to SEQ ID NO: 26032

SEQ ID NO: 73306 - DNA, 201 bp, Homo sapiens; identical to SEQ ID NO: 26454

SEQ ID NO: 73307 - DNA, 201 bp, Homo sapiens; identical to SEQ ID NO: 26679

SEQ ID NO: 73308 - DNA, 201 bp, Homo sapiens; identical to SEQ ID NO: 26034

SEQ ID NO: 73309 - DNA, 201 bp, Homo sapiens; identical to SEQ ID NO: 26682

SEQ ID NO: 73310 - DNA, 201 bp, Homo sapiens; identical to SEQ ID NO: 26041

SEQ ID NO: 73311 - DNA, 201 bp, Homo sapiens; identical to SEQ ID NO: 26295

SEQ ID NO: 73312 - DNA, 201 bp, Homo sapiens; identical to SEQ ID NO: 26462

SEQ ID NO: 73313 - DNA, 201 bp, Homo sapiens; identical to SEQ ID NO: 26473

SEQ ID NO: 73314 - DNA, 201 bp, Homo sapiens; identical to SEQ ID NO: 26692

SEQ ID NO: 73315 - DNA, 201 bp, Homo sapiens; identical to SEQ ID NO: 26476

SEQ ID NO: 73316 - DNA, 201 bp, Homo sapiens; identical to SEQ ID NO: 26477

SEQ ID NO: 73317 - DNA, 201 bp, Homo sapiens; identical to SEQ ID NO: 26693

SEQ ID NO: 73318 - DNA, 201 bp, Homo sapiens; identical to SEQ ID NO: 26300

SEQ ID NO: 73319 - DNA, 201 bp, Homo sapiens; identical to SEQ ID NO: 26301

SEQ ID NO: 73320 - DNA, 201 bp, Homo sapiens; identical to SEQ ID NO: 26059

SEQ ID NO: 73321 - DNA, 201 bp, Homo sapiens; identical to SEQ ID NO: 26484

SEQ ID NO: 73322 - DNA, 201 bp, Homo sapiens; identical to SEQ ID NO: 26061

SEQ ID NO: 73323 - DNA, 201 bp, Homo sapiens; identical to SEQ ID NO: 26700

SEQ ID NO: 73324 - DNA, 201 bp, Homo sapiens; identical to SEQ ID NO: 26486

SEQ ID NO: 73325 - DNA, 201 bp, Homo sapiens; identical to SEQ ID NO: 26071

SEQ ID NO: 73326 - DNA, 201 bp, Homo sapiens; identical to SEQ ID NO: 26306

SEQ ID NO: 73327 - DNA, 201 bp, Homo sapiens; identical to SEQ ID NO: 26713

SEQ ID NO: 73328 - DNA, 201 bp, Homo sapiens; identical to SEQ ID NO: 26722

SEQ ID NO: 73329 - DNA, 201 bp, Homo sapiens; identical to SEQ ID NO: 26493

SEQ ID NO: 73330 - DNA, 201 bp, Homo sapiens; identical to SEQ ID NO: 26495

SEQ ID NO: 73331 - DNA, 201 bp, Homo sapiens; identical to SEQ ID NO: 26496

SEQ ID NO: 73332 - DNA, 201 bp, Homo sapiens; identical to SEQ ID NO: 26726

SEQ ID NO: 73333 - DNA, 201 bp, Homo sapiens; identical to SEQ ID NO: 26513

SEQ ID NO: 73334 - DNA, 201 bp, Homo sapiens; identical to SEQ ID NO: 26515

SEQ ID NO: 73335 - DNA, 201 bp, Homo sapiens; identical to SEQ ID NO: 26316

SEQ ID NO: 73336 - DNA, 201 bp, Homo sapiens; identical to SEQ ID NO: 26319

SEQ ID NO: 73337 - DNA, 201 bp, Homo sapiens; identical to SEQ ID NO: 26103

SEQ ID NO: 73338 - DNA, 201 bp, Homo sapiens; identical to SEQ ID NO: 26320

SEQ ID NO: 73339 - DNA, 201 bp, Homo sapiens; identical to SEQ ID NO: 26104

SEQ ID NO: 73340 - DNA, 201 bp, Homo sapiens; identical to SEQ ID NO: 26106

SEQ ID NO: 73341 - DNA, 201 bp, Homo sapiens; identical to SEQ ID NO: 26110

SEQ ID NO: 73342 - DNA, 201 bp, Homo sapiens; identical to SEQ ID NO: 26524

SEQ ID NO: 73343 - DNA, 201 bp, Homo sapiens; identical to SEQ ID NO: 26326

SEQ ID NO: 73344 - DNA, 201 bp, Homo sapiens; identical to SEQ ID NO: 26525

SEQ ID NO: 73345 - DNA, 201 bp, Homo sapiens; identical to SEQ ID NO: 26120

SEQ ID NO: 73346 - DNA, 201 bp, Homo sapiens; identical to SEQ ID NO: 26545

SEQ ID NO: 73347 - DNA, 201 bp, Homo sapiens; identical to SEQ ID NO: 26128

SEQ ID NO: 73348 - DNA, 201 bp, Homo sapiens; identical to SEQ ID NO: 26129

SEQ ID NO: 73349 - DNA, 201 bp, Homo sapiens; identical to SEQ ID NO: 26548

SEQ ID NO: 73350 - DNA, 201 bp, Homo sapiens; identical to SEQ ID NO: 26131

SEQ ID NO: 73351 - DNA, 201 bp, Homo sapiens; identical to SEQ ID NO: 26753

SEQ ID NO: 73352 - DNA, 201 bp, Homo sapiens; identical to SEQ ID NO: 26755

SEQ ID NO: 73353 - DNA, 201 bp, Homo sapiens; identical to SEQ ID NO: 26757

SEQ ID NO: 73354 - DNA, 201 bp, Homo sapiens; identical to SEQ ID NO: 26760

SEQ ID NO: 73355 - DNA, 201 bp, Homo sapiens; identical to SEQ ID NO: 26762

SEQ ID NO: 73356 - DNA, 201 bp, Homo sapiens; identical to SEQ ID NO: 26134

SEQ ID NO: 73357 - DNA, 201 bp, Homo sapiens; identical to SEQ ID NO: 26571

SEQ ID NO: 73358 - DNA, 201 bp, Homo sapiens; identical to SEQ ID NO: 26764

SEQ ID NO: 73359 - DNA, 201 bp, Homo sapiens; identical to SEQ ID NO: 26337

SEQ ID NO: 73360 - DNA, 201 bp, Homo sapiens; identical to SEQ ID NO: 26135

SEQ ID NO: 73361 - DNA, 201 bp, Homo sapiens; identical to SEQ ID NO: 26766

SEQ ID NO: 73362 - DNA, 201 bp, Homo sapiens; identical to SEQ ID NO: 26338

SEQ ID NO: 73363 - DNA, 201 bp, Homo sapiens; identical to SEQ ID NO: 26767

SEQ ID NO: 73364 - DNA, 201 bp, Homo sapiens; identical to SEQ ID NO: 26339

SEQ ID NO: 73365 - DNA, 201 bp, Homo sapiens; identical to SEQ ID NO: 26341

SEQ ID NO: 73366 - DNA, 201 bp, Homo sapiens; identical to SEQ ID NO: 26342

SEQ ID NO: 73367 - DNA, 201 bp, Homo sapiens; identical to SEQ ID NO: 26345

SEQ ID NO: 73368 - DNA, 201 bp, Homo sapiens; identical to SEQ ID NO: 26347

SEQ ID NO: 73369 - DNA, 201 bp, Homo sapiens; identical to SEQ ID NO: 26349

SEQ ID NO: 73370 - DNA, 201 bp, Homo sapiens; identical to SEQ ID NO: 26348

SEQ ID NO: 73371 - DNA, 201 bp, Homo sapiens; identical to SEQ ID NO: 26350

SEQ ID NO: 73372 - DNA, 201 bp, Homo sapiens; identical to SEQ ID NO: 26352

SEQ ID NO: 73373 - DNA, 201 bp, Homo sapiens; identical to SEQ ID NO: 26353

SEQ ID NO: 73374 - DNA, 201 bp, Homo sapiens; identical to SEQ ID NO: 26355

SEQ ID NO: 73375 - DNA, 201 bp, Homo sapiens; identical to SEQ ID NO: 26359

SEQ ID NO: 73376 - DNA, 201 bp, Homo sapiens; identical to SEQ ID NO: 26771

SEQ ID NO: 73377 - DNA, 201 bp, Homo sapiens; identical to SEQ ID NO: 26358

SEQ ID NO: 73378 - DNA, 201 bp, Homo sapiens; identical to SEQ ID NO: 26773

SEQ ID NO: 73379 - DNA, 201 bp, Homo sapiens; identical to SEQ ID NO: 26586

SEQ ID NO: 73380 - DNA, 201 bp, Homo sapiens; identical to SEQ ID NO: 26148

SEQ ID NO: 73381 - DNA, 201 bp, Homo sapiens; identical to SEQ ID NO: 26779

SEQ ID NO: 73382 - DNA, 201 bp, Homo sapiens; identical to SEQ ID NO: 26780

SEQ ID NO: 73383 - DNA, 201 bp, Homo sapiens; identical to SEQ ID NO: 26362

SEQ ID NO: 73384 - DNA, 201 bp, Homo sapiens; identical to SEQ ID NO: 26783

SEQ ID NO: 73385 - DNA, 201 bp, Homo sapiens; identical to SEQ ID NO: 26785

SEQ ID NO: 73386 - DNA, 201 bp, Homo sapiens; identical to SEQ ID NO: 26787

SEQ ID NO: 73387 - DNA, 201 bp, Homo sapiens; identical to SEQ ID NO: 26791

SEQ ID NO: 73388 - DNA, 201 bp, Homo sapiens; identical to SEQ ID NO: 26157

SEQ ID NO: 73389 - DNA, 201 bp, Homo sapiens; identical to SEQ ID NO: 26793

SEQ ID NO: 73390 - DNA, 201 bp, Homo sapiens; identical to SEQ ID NO: 26795

SEQ ID NO: 73391 - DNA, 201 bp, Homo sapiens; identical to SEQ ID NO: 26372

SEQ ID NO: 73392 - DNA, 201 bp, Homo sapiens; identical to SEQ ID NO: 26373

SEQ ID NO: 73393 - DNA, 201 bp, Homo sapiens; identical to SEQ ID NO: 26376

SEQ ID NO: 73394 - DNA, 201 bp, Homo sapiens; identical to SEQ ID NO: 26379

SEQ ID NO: 73395 - DNA, 201 bp, Homo sapiens; identical to SEQ ID NO: 26382

SEQ ID NO: 73396 - DNA, 201 bp, Homo sapiens; identical to SEQ ID NO: 26803

SEQ ID NO: 73397 - DNA, 201 bp, Homo sapiens; identical to SEQ ID NO: 26389

SEQ ID NO: 73398 - DNA, 201 bp, Homo sapiens; identical to SEQ ID NO: 26613

SEQ ID NO: 73399 - DNA, 201 bp, Homo sapiens; identical to SEQ ID NO: 26804

SEQ ID NO: 73400 - DNA, 201 bp, Homo sapiens; identical to SEQ ID NO: 26805

SEQ ID NO: 73401 - DNA, 201 bp, Homo sapiens; identical to SEQ ID NO: 26807

SEQ ID NO: 73402 - DNA, 201 bp, Homo sapiens; identical to SEQ ID NO: 26162

SEQ ID NO: 73403 - DNA, 201 bp, Homo sapiens; identical to SEQ ID NO: 26163

SEQ ID NO: 73404 - DNA, 201 bp, Homo sapiens; identical to SEQ ID NO: 26809

SEQ ID NO: 73405 - DNA, 201 bp, Homo sapiens; identical to SEQ ID NO: 26810

SEQ ID NO: 73406 - DNA, 201 bp, Homo sapiens; identical to SEQ ID NO: 26811

SEQ ID NO: 73407 - DNA, 201 bp, Homo sapiens; identical to SEQ ID NO: 26393

SEQ ID NO: 73408 - DNA, 201 bp, Homo sapiens; identical to SEQ ID NO: 26395

SEQ ID NO: 73409 - DNA, 201 bp, Homo sapiens; identical to SEQ ID NO: 26814

SEQ ID NO: 73410 - DNA, 201 bp, Homo sapiens; identical to SEQ ID NO: 26817

SEQ ID NO: 73411 - DNA, 201 bp, Homo sapiens; identical to SEQ ID NO: 26820

SEQ ID NO: 73412 - DNA, 201 bp, Homo sapiens; identical to SEQ ID NO: 26825

SEQ ID NO: 73413 - DNA, 201 bp, Homo sapiens; identical to SEQ ID NO: 26399

SEQ ID NO: 73414 - DNA, 201 bp, Homo sapiens; identical to SEQ ID NO: 26405

SEQ ID NO: 73415 - DNA, 201 bp, Homo sapiens; identical to SEQ ID NO: 26403

SEQ ID NO: 73416 - DNA, 201 bp, Homo sapiens; identical to SEQ ID NO: 26408

SEQ ID NO: 73417 - DNA, 201 bp, Homo sapiens; identical to SEQ ID NO: 26406

SEQ ID NO: 73418 - DNA, 201 bp, Homo sapiens; identical to SEQ ID NO: 26416

SEQ ID NO: 73419 - DNA, 201 bp, Homo sapiens; identical to SEQ ID NO: 26414

SEQ ID NO: 73420 - DNA, 201 bp, Homo sapiens; identical to SEQ ID NO: 26418

SEQ ID NO: 73421 - DNA, 201 bp, Homo sapiens; identical to SEQ ID NO: 26832

SEQ ID NO: 73422 - DNA, 201 bp, Homo sapiens; identical to SEQ ID NO: 26176

SEQ ID NO: 73423 - DNA, 201 bp, Homo sapiens; identical to SEQ ID NO: 26833

SEQ ID NO: 73424 - DNA, 201 bp, Homo sapiens; identical to SEQ ID NO: 26622

SEQ ID NO: 73425 - DNA, 201 bp, Homo sapiens; identical to SEQ ID NO: 26624

SEQ ID NO: 73426 - DNA, 201 bp, Homo sapiens; identical to SEQ ID NO: 26625

SEQ ID NO: 73427 - DNA, 201 bp, Homo sapiens; identical to SEQ ID NO: 26626

SEQ ID NO: 73428 - DNA, 201 bp, Homo sapiens; identical to SEQ ID NO: 26834

SEQ ID NO: 73429 - DNA, 201 bp, Homo sapiens; identical to SEQ ID NO: 26835

SEQ ID NO: 73430 - DNA, 201 bp, Homo sapiens
gtcaggagtttgagaccagcctggccaacatggtgaaaccctgtctctactaaaaaaaaaaaaaaaaaaaaaaaaaaaaaaaaaaaaaaaaaaattagccwtgcatggtggcatgtgcctgtaatcccagctacttgggaggttgaggcataagaatcgcttgaacccaggaggtggaggttgcagtgagccaagatggta

SEQ ID NO: 73431 - DNA, 201 bp, Homo sapiens
tggaaccatactctccttcccttattcactggccttaccacctctttttactgccctggccagaccccatcagcctcatccacctgggcaaaccttatggkccataacctaatgggcttaacaacctgtattacctacctagttttaacattagttttacccaccatatgttacccacatggccttcacacttggttctta

SEQ ID NO: 73432 - DNA, 201 bp, Homo sapiens
ttattagcctcctggccttgctcatccagtattacgccccaggctttatgcacctgcctacgcttctgaccttaccctactggcattaacctcatgttctyaccaacaggaattacccaactgatcttagctacccaacattaaccagttggtcttcataattagtcctaacttctggtcttactcagctctcccagccct

SEQ ID NO: 73433 - DNA, 201 bp, Homo sapiens
ctcaacagacatgattaacctcattgtgttaatcaccttatcctgatggtattcttaaacaagcttcatccatgtggccctacgaaactcttggccttacygacccaggcttcatttcctggcttaaatgtcctggccttacccacctggccataacttcccatgattattcacctgttcttatccacctggatttaattt

SEQ ID NO: 73434 - DNA, 201 bp, Homo sapiens
ctccttgccttccctgcactgtcttacccacctacattagcctcaggtcatcatttggctggttttacaacttgcccttaatcctactgggcagttccccygttgatatcctggcctggggttgctcagtcttttcttcagctggatttaaacacctggttttaacaacctggctgcactcagcagaacttataagctcat

SEQ ID NO: 73435 - DNA, 201 bp, Homo sapiens
ttaaatatttgtaaattgtgtttttaattaaactttggaacagtgaaaaaaaaaagaaaaaagacagattaagaaacttgcccatagttccttaattagtmaatgttggagcctatgtccaacctcatgtaggttcattgccaaagcctgctggcatcccgagaacaggttacctctaagttttggtaaattcttcaaaca

SEQ ID NO: 73436 - DNA, 201 bp, Homo sapiens
gttctttggaagacagtgggtgtggcacacacacgtggcatcagatcccagcctggagctgtctactacatacatggagtgtgtgtgtgcctgtgtcccarctggagtgcagtggcgcgatcttgagtcactgcaacctccacctcccgggttcaagcaattctcctgcgttagcctcccgcgtagctggattacaggcat

SEQ ID NO: 73437 - DNA, 201 bp, Homo sapiens
aacactctgactgatatggcaaaaccccatatctttaaaaatacaaaaaaaaaaaattagctggggtgtggtggtgcatgcctgtagtcccagctacttgraaggctgaggagggagaattgcttgaacttgggaggtggaggttgcagtgagtcaagattgtcccactgcactccagcctgggtgacagagcaagacccc

SEQ ID NO: 73438 - DNA, 201 bp, Homo sapiens
ccgctaaaattacctccataggtttacttccctggacttatgcttctgcccttattccctggatttaccacctcctcccacccacttccccctagactcawacaccttgtattacccatctagattcacccatttggccttaacctcatggcctttaccaacctagattaccaacttacattacctacctggcattcccac

SEQ ID NO: 73439 - DNA, 201 bp, Homo sapiens
ccctacgaaactcttggccttactgacccaggcttcatttcctggcttaaatgtcctggccttacccacctggccataacttcccatgattattcacctgytcttatccacctggatttaatttgctggcttcaatctgccatcaggacccacctgatcttacccatggaaccatactctccttcccttattcactggcct

SEQ ID NO: 73440 - DNA, 201 bp, Homo sapiens
gagtctgagtccagaacattccttataaattcttgaacatatttgtgtgcaatttgatttctgtttttatgtccaaaacactaaagttctacacaaaccaragaagatttctttcataaaaggtacagtctcctgtatttcaactccagccccaaatatcttcatcatgggcttgggagtcagaaaggttcatcttatatt

SEQ ID NO: 73441 - DNA, 201 bp, Homo sapiens
gtacatactttttcattcttaacttagaaatgcttttcagaagatattaaatatttgtaaattgtgtttttaattaaactttggaacagtgaaaaaaaaaagaaaaaagacagattaagaaacttgcccatagttccttaattagtcaatgttggagcctatgtccaacctcatgtaggttcattgccaaagcctgctggc

SEQ ID NO: 73442 - DNA, 201 bp, Homo sapiens
aatgatctgttcccatcccattcatcagaactgagttttacagattatcctggggaggcttgggaatgctgatttcaaactaggcagttatgtgctcagcsaaaatttacagattttactaataagtaaagggaagaatagatgttggataaccaggcaaccaggagtcttttcctccctgagttttggtactctgtgacc

SEQ ID NO: 73443 - DNA, 201 bp, Homo sapiens
agtggatctgtttggcaattaccatcaacagggtttctcctgttcccataagcaagtcatctttgtagccagtgggaagaggagaaaagaacgaaagcacrtgccccttttttataagagcgtgaatgatctgttcccatcccattcatcagaactgagttttacagattatcctggggaggcttgggaatgctgatttca

SEQ ID NO: 73444 - DNA, 201 bp, Homo sapiens
ttggaaggctctgcactatgaccaaataatgcaaaaattctaattgaagaagttgagaacaaataagctcagtggcttgattgcctactggttttctcacmgtgatggaagaattgaacaattccccaaagtctgggtgcattccaactcatgggcattggccagtggatggctggctacatggtcaggaaaatgggcaat

SEQ ID NO: 73445 - DNA, 201 bp, Homo sapiens
tggagatgccgaagcacacgccttcaagagtcccagcaaagaaaaagaaaaagatacgcttgaagataagtttaaaagcaataatttagagagagagcagragcatcttgaccgcattgtgaaggaatctggaggaaaactgaccaggcggcttgtgaacagtcagtgcgaatttgaaagaagaaaaccagatggaacaac

SEQ ID NO: 73446 - DNA, 201 bp, Homo sapiens
catgtttcacaaactatatatatttagtaaactacaaccatgagtataacagcttttctgagtcccatgagtccaagtcaaagtcacatcaataaaaggayttttaactttaacggacatatgaggaagcaggtaggacggcctcccttgcttgctcccacagacccttggagtgccccaggccatggatgacacagcagt

SEQ ID NO: 73447 - DNA, 201 bp, Homo sapiens
ataagctcattgccttcatcaccttatcttgtcctcatggtattatgaacctggcattatctatctggccttattaaactcctgaccttactcacccagtmttaatttcctggcctaaaagtcctggccttaaccacctggtcaaaacttcctgccattatccacctgtacttatccacctggctttaatttgctggcctc

SEQ ID NO: 73448 - DNA, 201 bp, Homo sapiens
attaacctcatgttctcaccaacaggaattacccaactgatcttagctacccaacattaaccagttggtcttcataattagtcctaacttctggtcttacycagctctcccagccctgctggccttaacctagtgtcattatcctctgatcatcctcccctgccttacttttctgagcttcttctattgccttatccacct

SEQ ID NO: 73449 - DNA, 201 bp, Homo sapiens
ctaaaacatgtttcacaaactatatatatttagtaaactacaaccatgagtataacagcttttctgagtcccatgagtccaagtcaaagtcacatcaatamaaggacttttaactttaacggacatatgaggaagcaggtaggacggcctcccttgcttgctcccacagacccttggagtgccccaggccatggatgacac

SEQ ID NO: 73450 - DNA, 201 bp, Homo sapiens
aagacagattaagaaacttgcccatagttccttaattagtcaatgttggagcctatgtccaacctcatgtaggttcattgccaaagcctgctggcatcccragaacaggttacctctaagttttggtaaattcttcaaacactcttacctttgaaagcctaatacagcataggctctagcacctgaccaacctggctccaa

SEQ ID NO: 73451 - DNA, 201 bp, Homo sapiens
ttagccatgcatggtggcatgtgcctgtaatcccagctacttgggaggttgaggcataagaatcgcttgaacccaggaggtggaggttgcagtgagccaaratggtaccactgcactccagcctgggtgacagagtgagagtccgtctcaaaaaaaaaaaaaaagtgcgtaagtggtgcctgatggtgaccactggaactg

SEQ ID NO: 73452 - DNA, 201 bp, Homo sapiens
agctgagattgcaccactgcactccagcctgggtgacagagcgagactttgtctcaaaaaaaaaaaaaagaatttaagggatgcattaaataagacacatmaatgctcatgagaagaacctcttttccagcctgaaagtgattgcaactttaagtcaaaatcttgttgcacttacttgaggtggccaactgggtccatgaa

SEQ ID NO: 73453 - DNA, 201 bp, Homo sapiens
aaaaaaaaaaaaaaaaaaaaaaaaaaaaaaaaaaaaaaaaattagccatgcatggtggcatgtgcctgtaatcccagctacttgggaggttgaggcataaraatcgcttgaacccaggaggtggaggttgcagtgagccaagatggtaccactgcactccagcctgggtgacagagtgagagtccgtctcaaaaaaaaaaa

SEQ ID NO: 73454 - DNA, 201 bp, Homo sapiens
gctactcgggagactgaggcaggagaatcgcttgaagccaggaggcggaggttgtggtgagctgagattgcaccactgcactccagcctgggtgacagagygagactttgtctcaaaaaaaaaaaaaagaatttaagggatgcattaaataagacacataaatgctcatgagaagaacctcttttccagcctgaaagtgat

SEQ ID NO: 73455 - DNA, 201 bp, Homo sapiens; identical to SEQ ID NO: 14991

SEQ ID NO: 73456 - DNA, 201 bp, Homo sapiens; identical to SEQ ID NO: 14992

SEQ ID NO: 73457 - DNA, 201 bp, Homo sapiens; identical to SEQ ID NO: 14564

SEQ ID NO: 73458 - DNA, 201 bp, Homo sapiens; identical to SEQ ID NO: 14703

SEQ ID NO: 73459 - DNA, 201 bp, Homo sapiens; identical to SEQ ID NO: 14827

SEQ ID NO: 73460 - DNA, 201 bp, Homo sapiens; identical to SEQ ID NO: 14705

SEQ ID NO: 73461 - DNA, 201 bp, Homo sapiens; identical to SEQ ID NO: 14998

SEQ ID NO: 73462 - DNA, 201 bp, Homo sapiens; identical to SEQ ID NO: 14999

SEQ ID NO: 73463 - DNA, 201 bp, Homo sapiens; identical to SEQ ID NO: 14577

SEQ ID NO: 73464 - DNA, 201 bp, Homo sapiens; identical to SEQ ID NO: 14828

SEQ ID NO: 73465 - DNA, 201 bp, Homo sapiens; identical to SEQ ID NO: 14758

SEQ ID NO: 73466 - DNA, 201 bp, Homo sapiens; identical to SEQ ID NO: 14622

SEQ ID NO: 73467 - DNA, 201 bp, Homo sapiens; identical to SEQ ID NO: 15003

SEQ ID NO: 73468 - DNA, 201 bp, Homo sapiens; identical to SEQ ID NO: 14760

SEQ ID NO: 73469 - DNA, 201 bp, Homo sapiens; identical to SEQ ID NO: 15006

SEQ ID NO: 73470 - DNA, 201 bp, Homo sapiens; identical to SEQ ID NO: 15008

SEQ ID NO: 73471 - DNA, 201 bp, Homo sapiens; identical to SEQ ID NO: 15010

SEQ ID NO: 73472 - DNA, 201 bp, Homo sapiens; identical to SEQ ID NO: 14882

SEQ ID NO: 73473 - DNA, 201 bp, Homo sapiens; identical to SEQ ID NO: 14913

SEQ ID NO: 73474 - DNA, 201 bp, Homo sapiens; identical to SEQ ID NO: 14914

SEQ ID NO: 73475 - DNA, 201 bp, Homo sapiens; identical to SEQ ID NO: 14915

SEQ ID NO: 73476 - DNA, 201 bp, Homo sapiens; identical to SEQ ID NO: 14683

SEQ ID NO: 73477 - DNA, 201 bp, Homo sapiens; identical to SEQ ID NO: 15014

SEQ ID NO: 73478 - DNA, 201 bp, Homo sapiens; identical to SEQ ID NO: 15015

SEQ ID NO: 73479 - DNA, 201 bp, Homo sapiens; identical to SEQ ID NO: 14957

SEQ ID NO: 73480 - DNA, 201 bp, Homo sapiens; identical to SEQ ID NO: 14733

SEQ ID NO: 73481 - DNA, 201 bp, Homo sapiens; identical to SEQ ID NO: 14867

SEQ ID NO: 73482 - DNA, 201 bp, Homo sapiens; identical to SEQ ID NO: 15018

SEQ ID NO: 73483 - DNA, 201 bp, Homo sapiens; identical to SEQ ID NO: 14693

SEQ ID NO: 73484 - DNA, 201 bp, Homo sapiens; identical to SEQ ID NO: 14814

SEQ ID NO: 73485 - DNA, 201 bp, Homo sapiens; identical to SEQ ID NO: 14922

SEQ ID NO: 73486 - DNA, 201 bp, Homo sapiens; identical to SEQ ID NO: 15020

SEQ ID NO: 73487 - DNA, 201 bp, Homo sapiens; identical to SEQ ID NO: 15021

SEQ ID NO: 73488 - DNA, 201 bp, Homo sapiens; identical to SEQ ID NO: 15023

SEQ ID NO: 73489 - DNA, 201 bp, Homo sapiens; identical to SEQ ID NO: 14633

SEQ ID NO: 73490 - DNA, 201 bp, Homo sapiens; identical to SEQ ID NO: 14895

SEQ ID NO: 73491 - DNA, 201 bp, Homo sapiens; identical to SEQ ID NO: 14635

SEQ ID NO: 73492 - DNA, 201 bp, Homo sapiens; identical to SEQ ID NO: 14636

SEQ ID NO: 73493 - DNA, 201 bp, Homo sapiens; identical to SEQ ID NO: 15123

SEQ ID NO: 73494 - DNA, 201 bp, Homo sapiens
ggcacaatcagctgactgtaaacttgaactccttggcttatgatcctcctgcctcagcctcccaagtagctaggactacagacatgtgctaccacacctgrctaatttttttattttttgcagagacagggtctcactaagtttcccaggctggtctcaaactcctgggctcaagcgattctcccacctcagcctctcaaa

SEQ ID NO: 73495 - DNA, 201 bp, Homo sapiens
cttcttttttttttttttttgagacagggtcttgctctgtcacctaggctggagtgcagtggcacaatcagctgactgtaaacttgaactccttggcttakgatcctcctgcctcagcctcccaagtagctaggactacagacatgtgctaccacacctggctaatttttttattttttgcagagacagggtctcactaag

SEQ ID NO: 73496 - DNA, 201 bp, Homo sapiens
cattaattgtaaataaacgtgaccagaacataaacagagatgctgcagcctgaggacttaccccgaaactcccaggttagttatcaggaaattcccagggrccgtcatgattcatgttgctcccctagcagctctcatgactccagattacttggctggaggctgtcatgctgattgctgagagcagatgacttcatttcc

SEQ ID NO: 73497 - DNA, 201 bp, Homo sapiens
caccatgttggccaggccggtctcaaactcctggcctcaagtgatccatccacctcggcctcccaaagtgctgggattacaggcatgagccactgtgcctsacgcagccccattttctaccacatcaagtttaaaatcccctgcttggctttaaaagccctgtcatctgccactattccatccacactcccagaccctagt

SEQ ID NO: 73498 - DNA, 201 bp, Homo sapiens
ggcaaacacataaggactggtttaaaccctcaaagacctgagctcctgattctggctacttagggctttggctagagagagacacccttaagctggctggracaagcccaggagctctggggagatatggaagaggtggagagagatgcttggaacactcacctggcaggaatctgttttccactgtgggtcagcagcaca

SEQ ID NO: 73499 - DNA, 201 bp, Homo sapiens
taaaattgtcctccagaaaaacagaccatgtgtaaatgactgcatccacccttcctgcctgaggataagcagacatttgtgtatacacacacacacacacacgcatctctgggcacacttggaggaacatagcagggattctgtgattctgtcacccccatctctttcccctagtgtcaggaaccagggcttggggtcatt

SEQ ID NO: 73500 - DNA, 201 bp, Homo sapiens
cctgcttcctaggcctacccaggccactcagctcagacttctgcatgtatgtcatgagtcttggccaaatttttctttgtccctccctgacccaaacccasttattacctaagtcaggaacttactgctttaaagtagtttgccaggtgtggtggctcacgcctgtaatcccagcactttgggatgctgaggcggctggat

SEQ ID NO: 73501 - DNA, 201 bp, Homo sapiens
gtacttgttggacacacatgttcctccatttagacagtcacagttcgctggagagaacaaaggtggggtaagcgagggggagtggaagtggtaaggggtggcgcagccctgcagcagagggcagggaggggatgtcccctgaagccttcccaacttgtctgtgcagccaactgttgtaggggtggatactcacatggaact

SEQ ID NO: 73502 - DNA, 201 bp, Homo sapiens
accaccatgccaggctgatttttgcatttttagtagaggcagggttacaccatgttgtccaggctggtcttgaactcctgacctcaaatgatccactcaamcttgacctctcaaaatgctgggattacaagcgtgagccaccatgcccggctgccaacggacattttaaagatgtcgtttcagacctgccagaagactgga

SEQ ID NO: 73503 - DNA, 201 bp, Homo sapiens
gagggccaggccattctcttccttggtgtgactgcggatccagggtaagaagtgtgagactctcgtgtagacgcctggcttgtccttcagggcacatccamggccccagctcacaattccagtcaaagtcatgcggccttggagggaacagacgaggggtccccctgagtctccctgtgacgccaaagatacaaaagatga

SEQ ID NO: 73504 - DNA, 201 bp, Homo sapiens
gttagcctttcagcttttgggaggcaggtgacccactgtcttctggagagacttctgtgcttgctgagctgccagccttccaggggacagactgagtcagmgatgctataggcttcagagccaaccttgctacttcctctagaagactgtggtcagttttgtttggatttgagaacccattaattgtaaataaacgtgacc

SEQ ID NO: 73505 - DNA, 201 bp, Homo sapiens
caccaccatgccaggctgatttttgcatttttagtagaggcagggttacaccatgttgtccaggctggtcttgaactcctgacctcaaatgatccactcamacttgacctctcaaaatgctgggattacaagcgtgagccaccatgcccggctgccaacggacattttaaagatgtcgtttcagacctgccagaagactgg

SEQ ID NO: 73506 - DNA, 201 bp, Homo sapiens
gtgcagtggtgtgatctcagctcactgagatctctgcctcccaggttcaagcaattctcctgcctcagcctcccaagtagctgggactacaggcatccacyaccatgccaggctgatttttgcatttttagtagaggcagggttacaccatgttgtccaggctggtcttgaactcctgacctcaaatgatccactcaaact

SEQ ID NO: 73507 - DNA, 201 bp, Homo sapiens
ttatctacaaggggacaggaggatgagagaatatgagaaagagaagaacattccaactaacttttattttttttttttgagatggagtcttgctctgtcgyccagttggagtgcagtggtgtgatctcagctcactgagatctctgcctcccaggttcaagcaattctcctgcctcagcctcccaagtagctgggactaca

SEQ ID NO: 73508 - DNA, 201 bp, Homo sapiens
aaggggacatgtaagtttgtccccttccaccccactgtcatcagcaggtcagtgatgctcaccatctgcgcagtcatgcaccatgcactcttggacaagcrgctttaggcccacctgcacatagcaccagggtcgcctccggttgtctgggttcctggcaacacagaaagataggggatgtcattccaacccagagggcct

SEQ ID NO: 73509 - DNA, 201 bp, Homo sapiens
atctgccacttcttccttccctccctagaggcctcaaagcacgacttgtccccaaggccatgggctgcatggacaggggcagatgagggagaaatgaggcrgaacactttgctgggaaggagaaagggatgtgcttggggtggggcagaagagtcgaagaggagaaacccagggccgtacatgaagcagtgtgtggcgctg

SEQ ID NO: 73510 - DNA, 201 bp, Homo sapiens
tccttgtgtaggatgaggttttccacctcaaacttcatctccccttgcgtgttggagttaagccttgagcgacccaggtagacgatgtagtcctccttctktgggtaatcactgtggaagaagatacccatcaaacagcttagtcccatgaaatctgccacttcttccttccctccctagaggcctcaaagcacgacttgt

SEQ ID NO: 73511 - DNA, 201 bp, Homo sapiens
caccgggcagcttcaacctcagctccagtctctccctgggtcccactctccccaagccattatggccacagtagtcgcggggttccccctcaccaatgtcrttgtggtgagcaagcgtgtcagcgctgtagtccttgtgtaggatgaggttttccacctcaaacttcatctccccttgcgtgttggagttaagccttgagc

SEQ ID NO: 73512 - DNA, 201 bp, Homo sapiens
ggttgtctgggttcctggcaacacagaaagataggggatgtcattccaacccagagggccttccctgcctcctcccctcagggaagactcaaccagaggcygcacttctcttgtgctatggccagccctctgggagaaggggatggtaacaaggtttctgggaagctgtagggagggcttttggtccttgttgcccccacc

SEQ ID NO: 73513 - DNA, 201 bp, Homo sapiens
ggctgccaacggacattttaaagatgtcgtttcagacctgccagaagactggacagggtctccttccaaccccacctcacatttgtgtggccactgtttcrtgagcgtgtgtgtgtgtttatgcttgtcacatagggatgaagatgtcacccaccctacctccagctcctaactcctgcctgctcttgcctcccacccatc

SEQ ID NO: 73514 - DNA, 201 bp, Homo sapiens
ccctgaggttacactgtcgtcagtagcaccatgaaaggggaactaaagctggtccctccagcatcaggctatgacccccctaaccttcctcactctttttstgccttaccagctctggcctgcttcctaggcctacccaggccactcagctcagacttctgcatgtatgtcatgagtcttggccaaatttttctttgtccc

SEQ ID NO: 73515 - DNA, 201 bp, Homo sapiens
gcctttactccacctatagcccctaccatctatttacctttgcagcccatcgctccctaaacaacactcttcatccatccctggacccatctgccaccgcytcagtgctcccacctctaactctgcagtcttcccttgatcacactgggctcattttcaggtcaaaacactcctcaggaccttctaagtcagtcgcaattg

SEQ ID NO: 73516 - DNA, 201 bp, Homo sapiens
tcagtcatccagggaggtctgctggtcgcttatcacctggaaacctcccctgccccatgccccaagggctttgttccaggtgttgaaaaaggcttggatgkccagagccactgcatacagctgtacaggtcgtttctgcaaaaactcccagctgaggtagttaggctggaatccatcccaaggctccattctccaagttct

SEQ ID NO: 73517 - DNA, 201 bp, Homo sapiens
ggaggggatgtcccctgaagccttcccaacttgtctgtgcagccaactgttgtaggggtggatactcacatggaacttgatgaagttcattgctgccctgraagagattcgggaggaggcttcatcaaaggtcccatgctccagggactccagggtgagggtaaactggccccaatcccaaaacccactcttccctctccc

SEQ ID NO: 73518 - DNA, 201 bp, Homo sapiens
gcgcgccagcagggctctcatggtggcgaggtcggggcgctagacggcggctctgcaaaggaaggagaagtcagggcaagaggcggaggaacgggaaggcmggccaggcgggcgactgcagcgcaggggagatgcccgcggtgaccaggctccccagctgtctctctcctctctgggctccggactccgggcagcctggat

SEQ ID NO: 73519 - DNA, 201 bp, Homo sapiens
tatcacctggaaacctcccctgccccatgccccaagggctttgttccaggtgttgaaaaaggcttggatggccagagccactgcatacagctgtacaggtygtttctgcaaaaactcccagctgaggtagttaggctggaatccatcccaaggctccattctccaagttctatatcctagcacagacagaggctgcatccc

SEQ ID NO: 73520 - DNA, 201 bp, Homo sapiens
ttagggaggcaggtaggagaaagcatccctctcgggcaccccccacctcctcagtcctcctgtgatggaataaggggacatgtaagtttgtccccttccaycccactgtcatcagcaggtcagtgatgctcaccatctgcgcagtcatgcaccatgcactcttggacaagcggctttaggcccacctgcacatagcaccag

SEQ ID NO: 73521 - DNA, 201 bp, Homo sapiens
ttttgtttggatttgagaacccattaattgtaaataaacgtgaccagaacataaacagagatgctgcagcctgaggacttaccccgaaactcccaggttarttatcaggaaattcccaggggccgtcatgattcatgttgctcccctagcagctctcatgactccagattacttggctggaggctgtcatgctgattgctg

SEQ ID NO: 73522 - DNA, 201 bp, Homo sapiens
tgattcagtctatctggggtggggcctgagaatttgcaactcctaacaagtgccaggtaatacagaattgctaatttggggaccctaattgctttagattratgttctaggccaggtgcggtggctcacacctataatcccagcactttgggaggccaaggtgggcagatcacttgaggtcaggagttcgagaccagcctg

SEQ ID NO: 73523 - DNA, 201 bp, Homo sapiens
aaaagtgaccattcccctcatagcaggtttttgacttatctacaaggggacaggaggatgagagaatatgagaaagagaagaacattccaactaacttttwttttttttttttgagatggagtcttgctctgtcgcccagttggagtgcagtggtgtgatctcagctcactgagatctctgcctcccaggttcaagcaatt

SEQ ID NO: 73524 - DNA, 201 bp, Homo sapiens
gtccacacagtttaaggaaatatttagacttaacaatcagacaccagctcttactcacacttacactcacagcccacacacaagtgtgcaaacatacacamacatatatatttcctgatacattcatggaatatcagagccctgccctgaagtcgttagtgtctctgctccccaaaccgctgctcccacattggctaagct

SEQ ID NO: 73525 - DNA, 201 bp, Homo sapiens
gcttcccaaagtgctggattacaggcgtgagccactgagcctggccagcaattttcacttacaggtcttcttcttcttcttcttcttttttttttttttttgagacagggtcttgctctgtcacctaggctggagtgcagtggcacaatcagctgactgtaaacttgaactccttggcttatgatcctcctgcctcagcct

SEQ ID NO: 73526 - DNA, 201 bp, Homo sapiens
aatccccaggatttggtgatggaggggatgaaggaaaccaggagagaagcatcaggatggccccaggtttctggctttcataattgaatggatgtggtgcyatcatctgagacagaaagtgatgggagatgtctccacactggggcatgaagactcggccagtttggggcaggttgactttgaggtcccctgtgagtgaca

SEQ ID NO: 73527 - DNA, 201 bp, Homo sapiens
acagagatgctgcagcctgaggacttaccccgaaactcccaggttagttatcaggaaattcccaggggccgtcatgattcatgttgctcccctagcagctytcatgactccagattacttggctggaggctgtcatgctgattgctgagagcagatgacttcatttcctcctggacaaagaggtttggagaccgttatgaa

SEQ ID NO: 73528 - DNA, 201 bp, Homo sapiens
tccacacacctcggcttcccaaagtgctggattacaggcgtgagccactgagcctggccagcaattttcacttacaggtcttcttcttcttcttcttcttytttttttttttttgagacagggtcttgctctgtcacctaggctggagtgcagtggcacaatcagctgactgtaaacttgaactccttggcttatgatcct

SEQ ID NO: 73529 - DNA, 201 bp, Homo sapiens
agaactcatgctgaccatatcttgaatttttctgggcacttcatatattctgaccaattgtccccaaaggctgtcaatcagtggtgcatgttagtaacacygagggagcttttctaaaaccacgagacctggagccagccctgacctgaatcacaatctctacaggtggagtgtaggtgtgcatattttaaaaggtcctca

SEQ ID NO: 73530 - DNA, 201 bp, Homo sapiens
cagcatcagtcccacacacagatgatgggaaattatgttttttgtttcctgaatgccacagagtcaagctggcattctggataagcaattttctttctttmtttatttttttatttatttgaggcgaagtcttccctctgtcgcccaggctggagtgcagtggtgcgatctcggctcactgcaacctctgcctcccgggtt

SEQ ID NO: 73531 - DNA, 201 bp, Homo sapiens
attccagcatcagtcccacacacagatgatgggaaattatgttttttgtttcctgaatgccacagagtcaagctggcattctggataagcaattttctttmtttctttatttttttatttatttgaggcgaagtcttccctctgtcgcccaggctggagtgcagtggtgcgatctcggctcactgcaacctctgcctcccg

SEQ ID NO: 73532 - DNA, 201 bp, Homo sapiens
ggagaaagggatgtgcttggggtggggcagaagagtcgaagaggagaaacccagggccgtacatgaagcagtgtgtggcgctgatcacccagcaagggctsatgaggctgcctccacacacgtaggtgacagagcccccccggtgcctcctgtagatggccgcaaaccagggctggttctcgatggtggtgaattctcccc

SEQ ID NO: 73533 - DNA, 201 bp, Homo sapiens
cagcctcgagctcctgggctcaagcaatcctcccgtctaggcctcccacagtattaggattacaggtgtgagccattgcacctagcccagaattgattttyaaaaaacacctcagcaactcctcttacttcatctaattcaaagggagggcttaaatgtttccttcttggaaggaaggtggacccaatgggagtgagtatg

SEQ ID NO: 73534 - DNA, 201 bp, Homo sapiens
agcccatcgctccctaaacaacactcttcatccatccctggacccatctgccaccgcctcagtgctcccacctctaactctgcagtcttcccttgatcacrctgggctcattttcaggtcaaaacactcctcaggaccttctaagtcagtcgcaattgtcacttactagaattctcttttccaaagccagtgatctcacag

SEQ ID NO: 73535 - DNA, 201 bp, Homo sapiens
gagtcaggaccacccctccatcctggccagaggggtctgggcagccagcacccaggcctatgcctgagggtaaagctattgtcgttcaccctggtgggtgscacaggcaaatccatctgtgcagagcctatcttcccagtctcttcttacagctgatggagatgactctactgcaaaaatgacaaccagcaagaaagcggg

SEQ ID NO: 73536 - DNA, 201 bp, Homo sapiens
gcggcctcttcctcccttgccagccagtgccaacccccgtggttctcaagcctccgctgccaccctgtcccatttcctggggagagtctggccctgctgtrgatggaatccggaggaccccagctccctgagcagcccctcctctcccctggtgctgatcagaggtccttgggcagcatcagtcaaagcaagagcgcactc

SEQ ID NO: 73537 - DNA, 201 bp, Homo sapiens
atcagtcccacacacagatgatgggaaattatgttttttgtttcctgaatgccacagagtcaagctggcattctggataagcaattttctttctttctttwtttttttatttatttgaggcgaagtcttccctctgtcgcccaggctggagtgcagtggtgcgatctcggctcactgcaacctctgcctcccgggttcaaa

SEQ ID NO: 73538 - DNA, 201 bp, Homo sapiens
gggtagtggtagtgcatgcttgtaatcccagctacttgggaggctgaggcaggagaatcgcttgaacctgggaggcagaagctgcagtgagctaagattgygccactgcactccagcctgggtgacagagtgagaccctgcctcaaaaaaaagaaaaagccaaatacttggagttcttgccctctagggaagcacggtcca

SEQ ID NO: 73539 - DNA, 201 bp, Homo sapiens
ctgaggggaaggcagaaactgaacagccactcggcttgggcagcttcctagcaggtttccactcccgcaaaatagtgcagttctgaggtgggagagggcaragggttcccatctgatctgatgctacaataatttacttagctttgtaataataaccaccgtttttatgcttttattaggtgccagtattatgctaaagga

SEQ ID NO: 73540 - DNA, 201 bp, Homo sapiens
aaaagtaaagacaatggaaacatgtagacagttctaactgtggaggttctggagggtgtggaagttctgttctcacctctgagtagaggaattgggagackggaggacaaaataagaggaagatttatttttcactgtttgtccttttacactcttaacattttaaaaagcacatctctgtatagcccattccaaaaagat

SEQ ID NO: 73541 - DNA, 201 bp, Homo sapiens
gtgttgaaaaaggcttggatggccagagccactgcatacagctgtacaggtcgtttctgcaaaaactcccagctgaggtagttaggctggaatccatcccraggctccattctccaagttctatatcctagcacagacagaggctgcatcccacaaaggaaggtgtgtctttttctaattcatataaacagggccttccca

SEQ ID NO: 73542 - DNA, 201 bp, Homo sapiens
cgcttgaacctgggaggcggaggttgcagtgagccgagatcacaccactgcactccagcctgggcgacagagcgatactccatctcaaaaaaaaaaaaaamaaaaaaaacaaaagcaaaaacagaaaaagcacagtgcttgatcatggaggcactaataggaggcagtctctggagtgagaatctggaactgtgaaactgg

SEQ ID NO: 73543 - DNA, 201 bp, Homo sapiens
gagaagcaggcgcgccagcagggctctcatggtggcgaggtcggggcgctagacggcggctctgcaaaggaaggagaagtcagggcaagaggcggaggaaygggaaggcaggccaggcgggcgactgcagcgcaggggagatgcccgcggtgaccaggctccccagctgtctctctcctctctgggctccggactccgggc

SEQ ID NO: 73544 - DNA, 201 bp, Homo sapiens
tcagtaacatgttgagtcaggaccacccctccatcctggccagaggggtctgggcagccagcacccaggcctatgcctgagggtaaagctattgtcgttcrccctggtgggtggcacaggcaaatccatctgtgcagagcctatcttcccagtctcttcttacagctgatggagatgactctactgcaaaaatgacaacca

SEQ ID NO: 73545 - DNA, 201 bp, Homo sapiens
gatctcacagcttgtgccaaactggggatcgttatacatcgagggcaggcagatggtctgtatagtccgggatggctgcgcacacctgccctccttggaayggatcttcagcaaggctgggggaggacagagggtcagaggagaaagatcactactggttaggcggtccccatctgtcccctccaagtgccgaggaagtag

SEQ ID NO: 73546 - DNA, 201 bp, Homo sapiens
gttttccacctcaaacttcatctccccttgcgtgttggagttaagccttgagcgacccaggtagacgatgtagtcctccttctttgggtaatcactgtggragaagatacccatcaaacagcttagtcccatgaaatctgccacttcttccttccctccctagaggcctcaaagcacgacttgtccccaaggccatgggct

SEQ ID NO: 73547 - DNA, 201 bp, Homo sapiens
agaacaaaggtggggtaagcgagggggagtggaagtggtaaggggtggcgcagccctgcagcagagggcagggaggggatgtcccctgaagccttcccaayttgtctgtgcagccaactgttgtaggggtggatactcacatggaacttgatgaagttcattgctgccctggaagagattcgggaggaggcttcatcaaag

SEQ ID NO: 73548 - DNA, 201 bp, Homo sapiens
gtctgggtccacctgagagtgacagaaggaaggcagggagagtgccaggaaggtaggaaggaggaaggctcctttgctctgccccagccgagggctcaggrtgccagctgcctgctggggaaagtacaagttagcctttcagcttttgggaggcaggtgacccactgtcttctggagagacttctgtgcttgctgagctgc

SEQ ID NO: 73549 - DNA, 201 bp, Homo sapiens
  misc_feature (1)...(201): n = A,T,C or G, or insertion/deletion polymorphism (see Tables 1-2)
aggagggaggatctcagaggcctttgctgtgccacaggcattaaccctgtggttgctggatcatgaagaagtggagagaggctgatggcaggggccacgcngagaggatctcaggacagcatctgtttagtcattgagcagaaccagtgcctgctgctgagaatcagtcctgcagcagggtcatcaccagctggatcccac

SEQ ID NO: 73550 - DNA, 201 bp, Homo sapiens
ccttagaacacctcaccttttcatgcctccatgaacttccctacgcctacaatgcctttcttctagtttggcaaatttctgtgtgtatttgaatgtccagrtaaaatatcacctcttctgtaaagtcgtcattgacttcaccaggcagaatcaattgcttcttcattatttttccatgcattttatgcagacttagtatag

SEQ ID NO: 73551 - DNA, 201 bp, Homo sapiens
ccactgcactccagcctgggcgacagagcgatactccatctcaaaaaaaaaaaaaacaaaaaaaacaaaagcaaaaacagaaaaagcacagtgcttgatcrtggaggcactaataggaggcagtctctggagtgagaatctggaactgtgaaactggttgctggagaagcggctgatgcctgctagcctggggtgagatct

SEQ ID NO: 73552 - DNA, 201 bp, Homo sapiens
cctggggagagtctggccctgctgtggatggaatccggaggaccccagctccctgagcagcccctcctctcccctggtgctgatcagaggtccttgggcakcatcagtcaaagcaagagcgcactcactttggagtcgctcacgaccaggacgcagagaagcaggcgcgccagcagggctctcatggtggcgaggtcgggg

SEQ ID NO: 73553 - DNA, 201 bp, Homo sapiens
aatacaaaaattgtctgggcgtggtggcgtgcgcctgtagtcccagctactcgggaggctgaggcagaagaatcgcttgaacccgggaggcggaggttgcrgtgagccgagatcatgccactgcactctagcctgggtgacacagcaagactccatctcaaaaaagaaaagaaaaggaaaaggggctgacacttgttacat

SEQ ID NO: 73554 - DNA, 201 bp, Homo sapiens
gccaacttgttgctcctcagtaatcacactttagtatgcgcaagaatcacctggagaactctgaatgtagatgccagggccccacgcccagaaagtctggrtcaatacctctgatgggggctcaagatcctgcttttctaacaagctctccagaggttcagatgcaggtagcatttggaatattaagagacacttccattg

SEQ ID NO: 73555 - DNA, 201 bp, Homo sapiens
cttggacaagcggctttaggcccacctgcacatagcaccagggtcgcctccggttgtctgggttcctggcaacacagaaagataggggatgtcattccaayccagagggccttccctgcctcctcccctcagggaagactcaaccagaggccgcacttctcttgtgctatggccagccctctgggagaaggggatggtaac

SEQ ID NO: 73556 - DNA, 201 bp, Homo sapiens
ccccagctccctgagcagcccctcctctcccctggtgctgatcagaggtccttgggcagcatcagtcaaagcaagagcgcactcactttggagtcgctcamgaccaggacgcagagaagcaggcgcgccagcagggctctcatggtggcgaggtcggggcgctagacggcggctctgcaaaggaaggagaagtcagggcaa

SEQ ID NO: 73557 - DNA, 201 bp, Homo sapiens
agggcaagaggcggaggaacgggaaggcaggccaggcgggcgactgcagcgcaggggagatgcccgcggtgaccaggctccccagctgtctctctcctctmtgggctccggactccgggcagcctggatcggcacccgcgggggacgcccgggacggggcgccttgactccgtgcagccgccggggagcccagggagcccg

SEQ ID NO: 73558 - DNA, 201 bp, Homo sapiens
cagccctctgggagaaggggatggtaacaaggtttctgggaagctgtagggagggcttttggtccttgttgcccccacctcacctgcagtaattatgtttycccaggcccagctgaagagcatcagatctgtgggcatggtacgtttgctgaaggacagtggcagagttccagggcaggcagggccggcccatggtgtcag

SEQ ID NO: 73559 - DNA, 201 bp, Homo sapiens
aaagcaagagcgcactcactttggagtcgctcacgaccaggacgcagagaagcaggcgcgccagcagggctctcatggtggcgaggtcggggcgctagacrgcggctctgcaaaggaaggagaagtcagggcaagaggcggaggaacgggaaggcaggccaggcgggcgactgcagcgcaggggagatgcccgcggtgacc

SEQ ID NO: 73560 - DNA, 201 bp, Homo sapiens
tttttgacagggcttgataaggattgggttaggtgtcgtgatatgatgttacaggattgtgggaacaaagtcctagggcataaactgttggtgcttcctaytgaagtgttaacgggtcttttgggaagtttccataatgagcaattcatttatttgtgcaggcaagaataaaagtaaagacaatggaaacatgtagacagt

SEQ ID NO: 73561 - DNA, 201 bp, Homo sapiens
gccccctaatcataggcatagcaatggctggtcacaagctctgttaacacactgagaaaattccagcatcagtcccacacacagatgatgggaaattatgktttttgtttcctgaatgccacagagtcaagctggcattctggataagcaattttctttctttctttatttttttatttatttgaggcgaagtcttccctc

SEQ ID NO: 73562 - DNA, 201 bp, Homo sapiens
atcagtcaaagcaagagcgcactcactttggagtcgctcacgaccaggacgcagagaagcaggcgcgccagcagggctctcatggtggcgaggtcggggckctagacggcggctctgcaaaggaaggagaagtcagggcaagaggcggaggaacgggaaggcaggccaggcgggcgactgcagcgcaggggagatgcccgc

SEQ ID NO: 73563 - DNA, 201 bp, Homo sapiens
tcgctggagagaacaaaggtggggtaagcgagggggagtggaagtggtaaggggtggcgcagccctgcagcagagggcagggaggggatgtcccctgaagycttcccaacttgtctgtgcagccaactgttgtaggggtggatactcacatggaacttgatgaagttcattgctgccctggaagagattcgggaggaggct

SEQ ID NO: 73564 - DNA, 201 bp, Homo sapiens
acaggcattaaccctgtggttgctggatcatgaagaagtggagagaggctgatggcaggggccacgcagagaggatctcaggacagcatctgtttagtcaytgagcagaaccagtgcctgctgctgagaatcagtcctgcagcagggtcatcaccagctggatcccaccagatccttccccaccatctccacctactcatt

SEQ ID NO: 73565 - DNA, 201 bp, Homo sapiens
cgcacttctcttgtgctatggccagccctctgggagaaggggatggtaacaaggtttctgggaagctgtagggagggcttttggtccttgttgcccccacytcacctgcagtaattatgtttccccaggcccagctgaagagcatcagatctgtgggcatggtacgtttgctgaaggacagtggcagagttccagggcagg

SEQ ID NO: 73566 - DNA, 201 bp, Homo sapiens
attctattgatatgaaatgcccagaattggcaaacccacagagaggacagaaagtagtaaattagtgattgcctagggctgagggggttggggagaaaaamggagtgattgtgagtgggtacaggatttctttgtgaggtgatgaagtgttctaaaattgattgtgatgtctcacaattctgtgaatctactaaaaaccat

SEQ ID NO: 73567 - DNA, 201 bp, Homo sapiens
acaagcccaggagctctggggagatatggaagaggtggagagagatgcttggaacactcacctggcaggaatctgttttccactgtgggtcagcagcacayagcattttggtggtgacttcagagccgtagtagtggggctgctgacactcccggtgggaaatcagcttcacaacagtcattttcagctgctccggataga

SEQ ID NO: 73568 - DNA, 201 bp, Homo sapiens
gaatttttctgggcacttcatatattctgaccaattgtccccaaaggctgtcaatcagtggtgcatgttagtaacactgagggagcttttctaaaaccacragacctggagccagccctgacctgaatcacaatctctacaggtggagtgtaggtgtgcatattttaaaaggtcctcagatgactcgattaagaaacactg

SEQ ID NO: 73569 - DNA, 201 bp, Homo sapiens
ctcaggtgatccacacacctcggcttcccaaagtgctggattacaggcgtgagccactgagcctggccagcaattttcacttacaggtcttcttcttcttyttcttcttttttttttttttttgagacagggtcttgctctgtcacctaggctggagtgcagtggcacaatcagctgactgtaaacttgaactccttggct

SEQ ID NO: 73570 - DNA, 201 bp, Homo sapiens
aaaattgtcctccagaaaaacagaccatgtgtaaatgactgcatccacccttcctgcctgaggataagcagacatttgtgtatacacacacacacacacacgcatctctgggcacacttggaggaacatagcagggattctgtgattctgtcacccccatctctttcccctagtgtcaggaaccagggcttggggtcattt

SEQ ID NO: 73571 - DNA, 201 bp, Homo sapiens
ggagttgaaaacttacatccacacgaaaatctgagcatgaatgtttattcataattgccaaaatttggaaacaaacaaattattcttcagtaggtagatgwataaacaaactgtgatacatccagacagtggaatattatgcagtgctaaaatgaaatgagctatcaggccatgaaaagacatgaagaaaccttaaataca

SEQ ID NO: 73572 - DNA, 201 bp, Homo sapiens
tatagactgtattagagttggacagaatggaaatgtctatggatgctgtaagtatactctctttaccttattgtgttggtccattttcatgctgctgaaamagacatacccaagactgggcaatttacaaaagaaagaggtttaattgaactcacagttccacgtggctggggaggcctcacaatcgtgacagaaggcaag

SEQ ID NO: 73573 - DNA, 201 bp, Homo sapiens
tcctctgtctttggccctctagggcctagaattgcctgtcccttcataagtgtcaattagtactcttggaatgaatacaggaatgaattttattttattawtatgcagtctaaatactgacttttcatcagtccaggttatggaatgatgaaaagtcagtatttagactgcatattaatattattacctattcacattact

SEQ ID NO: 73574 - DNA, 201 bp, Homo sapiens
tctatgcaaaatactgtagagcagtgatttccaacttttttttttttttttactatgaccttatcatgtaaggaatacatttcaaactgtgaccctacatrtacagacacgtttgtgtgcatgtgtattaatatagataactgaaactaaaatttaacaattattcttccatgtataatacaataaaacatatcaaagtta

SEQ ID NO: 73575 - DNA, 201 bp, Homo sapiens
cctctgtctttggccctctagggcctagaattgcctgtcccttcataagtgtcaattagtactcttggaatgaatacaggaatgaattttattttattaawatgcagtctaaatactgacttttcatcagtccaggttatggaatgatgaaaagtcagtatttagactgcatattaatattattacctattcacattactc

SEQ ID NO: 73576 - DNA, 201 bp, Homo sapiens
ccgagattgcaccattgcactctagcataggcaacaagagcaaaacactgtctcaaatgaaaaaaaaatgctagaaataaaaaagatgatatctgagatgwcgcatttcttcaatgggcttatcaggagtttgaacatgtctggtgaaagaatcagtgaacttgaaaatagaaactatccaaactgaaacatagagataga

SEQ ID NO: 73577 - DNA, 201 bp, Homo sapiens
cctggatcccttgatccctggatcccttgagtcctctgactttccttttggcaggcaaggtggaggcagggaatggctagtcttctgtagcagcttcccarcacctggtactactctgaggcatttttctgggccaagcccaggggtccctggagccttcctgaattctggctgcctatactgtggctgcttgctatgttt

SEQ ID NO: 73578 - DNA, 201 bp, Homo sapiens
tccattgtggttagagaaaattctgtattatttaaattttcaaaaatttgttgaggtttgttttgtggtctgtcttgatatatattcttcgggcacttgartggaatgtgtattctgctgttggatagagtgttctataaatgtctactaaatcttggttgatggtattcttgagttcttctatatctttgctgattccct

SEQ ID NO: 73579 - DNA, 201 bp, Homo sapiens
tggatcccttgatccctggatcccttgagtcctctgactttccttttggcaggcaaggtggaggcagggaatggctagtcttctgtagcagcttcccagcrcctggtactactctgaggcatttttctgggccaagcccaggggtccctggagccttcctgaattctggctgcctatactgtggctgcttgctatgtttgg

SEQ ID NO: 73580 - DNA, 201 bp, Homo sapiens
acagttgcttttttaacttgtgactgggtatacaagtttgtaactatatttccatctgatgtggcacttatatggatctctcttgagtgcacactgccacrtggctggatgggtgatgatatccacattggtctttcttctgtgaaatagtatccacaattcaaaacaggccatatccaagtgaaaatatgttcttttcat

SEQ ID NO: 73581 - DNA, 201 bp, Homo sapiens
gcttttggtagtgtttttaaaattttagccattctgataagtgtgtagtgatatctcattgtccttttactttgtgtttgcctgatggttaatgaattaarcatcttttagtgggcttatttgcaatctgtatatcatcctcagtaaaatgttccctcatgtcttttacccatttttgaattggattgtgtattttattac

SEQ ID NO: 73582 - DNA, 201 bp, Homo sapiens
tgtggtattggcaaaagaatagtcaaacagattgaaggaacagaataggaagcccagaaatagacccacgtaagtgtagtcacatgatcattaacaaaggmgcaaagccaatacaatggagaaaagatagtcttttcaaacaaatgcagctggaacaataggacacccacatgaaaaaacaaaattagatcttttacaccc

SEQ ID NO: 73583 - DNA, 201 bp, Homo sapiens
caattcctcctacttcattcctctttttcaaaattgtttcagctatgctcattcctttggtttttcatacaaatttagaaaaaatataatctatgtctccygaaatcttgttggtattttgataggaattgtgttaaagctgtataccactttggggagaatcgccatatttaccatgctgaatttcccagtgtgtgcctc

SEQ ID NO: 73584 - DNA, 201 bp, Homo sapiens
aatatcatcttttcagtggaaccttcaatgacaaccctctttggccacctgctttaaaactgattaatcccctgcccctggtactcccttgtctttattcytcactttatttttctccatagcatttaacactatctgacagattttacttgtttcttttctcttctctgctcccatactagaatgtaagttccaggagag

SEQ ID NO: 73585 - DNA, 201 bp, Homo sapiens
ttgttctaggttcttgaagtggaaagttagattattgatttgagatgttccatttttttctaatggttacatttccctctttgaatatgttacctgtatcycacaaatgttgattttttattttcattagttcagtgtattttttgatttcccgtgagacctttctctttgattcatgggaaaatacagaagtttgttgtt

SEQ ID NO: 73586 - DNA, 201 bp, Homo sapiens
cttttttcgagatagggtctgactctgtcacccaggctggagttaaagtagtttgatttatcgatcttttattttatggcttatgctttggttttaagaamattttccctattcagatgtcataaaatgactctcatattttcttccaaaagtttgaaagatttgcctttcatatttcagctttttattcacctaaaattg

SEQ ID NO: 73587 - DNA, 201 bp, Homo sapiens
caagtttagacaatgtcaagctggaaaaagactcttggtattcagagaagccttttccacagctgccagaaatgaaataatttatttggggggattgataytccttaattagagaaagcattactaggtttagctgtatccgtggtgagctgtgaatgagattgagaccattgttgctatttacaatgctggaaattctac

SEQ ID NO: 73588 - DNA, 201 bp, Homo sapiens
ggtttgctatttcttggtggattcatctcttttatcattttataatgtccctgtctgtctctggtgattttctcttctctgagatttactttacttgataytcatatagccactcctgctttcttttgattcacatttctatgatacattattttccattctttattttcaaccactgatactgttatatttgaagtgagt

SEQ ID NO: 73589 - DNA, 201 bp, Homo sapiens
ttattcacctaaaattgttttttgtgtatgatataattgtattagtttcctatggctgctataactaattaccaccaacctagcagcttaaaacaacataratttattatcttacagttatggaagctagaagtctgaaatagttttcactgggctaaaatcaagatgtcagcagagctgcattcctagaggagaattttt

SEQ ID NO: 73590 - DNA, 201 bp, Homo sapiens
ctggaatcaatcctactgaaactattcaaaaaattgaggaggaagtgttcctgtttaactcattctacaaagccaccatcaccctgataccaaaatctggmaaagacacaagaaaagaaaactgcaagtcagtattcctgacgaacatcaacataaaaatcctcaagaaaatactagcaaaccaaatccagtagcacatca

SEQ ID NO: 73591 - DNA, 201 bp, Homo sapiens
ctaaaatcaagatgtcagcagagctgcattcctagaggagaatttttaagttttttttttttttccaagttctatagggtgctggcttatggccccatttyatattgaaagccagcagtcagccaggtgtggtagctcatgcctgtaatcccagcactttgggaggctgaggttgtccttgagtctaggagttccagatca

SEQ ID NO: 73592 - DNA, 201 bp, Homo sapiens
gttttgccaaggcaccccttaagcttcctactataagtttggttacttttagagtgtggcaatggaacagagaaagcttatacaaatacatggatgccctrctattgataaccttataattagtgttaaaagaaaaagactcctccctcaaaacaaggtggcactcaagcctccccacaaagttaattgtctacttttttc

SEQ ID NO: 73593 - DNA, 201 bp, Homo sapiens
gggtcactgggaggttggggggcaagactgaaccaatatttgtggtgcataaatgtgtattttacccttgacagacaccggaagaaatagaaagattgacrgtcgatgaagacctcagtgatattgaaagggctgtttatctgctcaggtatttcctagtctttctgtgaaattgctcttcttttttccctgtgcagcaga

SEQ ID NO: 73594 - DNA, 201 bp, Homo sapiens
tctgtggaggagaacacttactggtaagtattgaactcttattgtattatgtttcagaaaaatatgtttagaaaatcagttgatttttagcagtgatgaamtctcttagtctgtgctggtttcttaacagtggacagtcccagatgttgaagtcagcacaacaagagaaaaacccaaatcctgataagacttgaggatttt

SEQ ID NO: 73595 - DNA, 201 bp, Homo sapiens
ttgattttcaggtttatttttgagcactttaccttttcctctgcattgaatattatataaatgtataatatataacatgttatatatatattttctctctrcttttatgtgtcaggtttgtttctttagttcttttattttgtgtattgaaactattttggagtattatgttaaattagaattcaaagtcagatgtgtaag

SEQ ID NO: 73596 - DNA, 201 bp, Homo sapiens
atgtaattttagtaataaatgaaatgataaaatgggcttaagctgtagcatggtatgagatgtgtgtaaaagagaataagaaaagtttcctttgcttactrtttatctatttatgttaatggtgttagaattcttttagttattcaggctcaaatcctcaatcatcttagctttttaattcataatcactctttatattct

SEQ ID NO: 73597 - DNA, 201 bp, Homo sapiens
gcatgtttataattcatgtgctacttcttgcctgcttattaaataccaaatgaaaagaatggaatgttttataattatgatacaagagtaaagctgaagartattttggttgatggttgctagactcagatattctactgctacagccttttatcttagctatagacatttcaactgccaatccaaaattaaccattattt

SEQ ID NO: 73598 - DNA, 201 bp, Homo sapiens
ctgctttctgtatctatggatttgcctattctggagattcctaaacacggaatcatacagtatatggccttttgtgactgacttctttcacttagcataakgtgttcaaggttcacccatgttgtagcagctatcagtagtttattcctttttattgcagtgtagtattctactgtatggatatagcgcttttgtttagcc

SEQ ID NO: 73599 - DNA, 201 bp, Homo sapiens
tgaaatcttagatgtttgttagacttcaatatttgctttgaacttctcattatctagaagtgaaagaatttgattgtcaagataaatatccaaaatattawaccatggtcttttataaaattcagaataatagcgatataattacaccacataacgaaggtgattccattacaatccaatgcaaaaaacactctctactta

SEQ ID NO: 73600 - DNA, 201 bp, Homo sapiens
gtatttttctgtgcaactttgatttctctttttttgatcctctctccatttggcatgggttctctatttcacaccctttgctattccttctgaattttgtytattaaaggattctcctagagagtgatgagaacagtggaatgattatgatgtcctgtatttcatagcttaccgtatagcaacagaaaaagcctttcttca

SEQ ID NO: 73601 - DNA, 201 bp, Homo sapiens
tttgcttaataaaatttcagttttggttttaattttatatctaaatgatgtatttctggcttaaaacttagaagtctgagtgcttaacattcaaagcagtyatttttccaattagtccatactttttataactgtgcagaggaattcagcttataattataaattttaaatttgtgttttctttgtaagtgctggtcaaga

SEQ ID NO: 73602 - DNA, 201 bp, Homo sapiens
tcaaagcagtcatttttccaattagtccatactttttataactgtgcagaggaattcagcttataattataaattttaaatttgtgttttctttgtaagtkctggtcaagatgtccaaggaacaagtgtgattgcaaatctcccatttttgatgcgacagaatcccactgagacgcttcggagagtgttgccaaaagtcag

SEQ ID NO: 73603 - DNA, 201 bp, Homo sapiens
agtcagataaagagctttgcttttttttttttttttttcttttttcttttttaaagacagggtctcactgtgtttcccaggctggagtgcagtggctattmacaggcacggtcacagtgctctaactcctgggctaaaatgatcctcccacctcagctttctgaatagctgggactacagaaggcacacaccacctccaca

SEQ ID NO: 73604 - DNA, 201 bp, Homo sapiens
cttaattatatacttgtttattgtttttttgtgtatggccatgatattatataaatactgttagcctgatgaggataactgagtaaggccatgctgcctakgagttgagcagtggaatgacttaaaatagctatggctgtcttataaaacccacaaaatttaatatccttgaaagctgaagatccattaattcatcttatg

SEQ ID NO: 73605 - DNA, 201 bp, Homo sapiens
accatgtgagaactctggcgtacttcttcttgggttcaagactaggatagggtagcaatgagacagtaaggaagaactccagtgattaaagctttgctacycacctagcttttggttgtttttcttttaaaatacctatcttatttgctatcccaaagtggaaagttgtgtgaaaaactcctttgaatgccctccttttta

SEQ ID NO: 73606 - DNA, 201 bp, Homo sapiens
cacaatccaaacaggaaaacagaaattaaaacctctctaaagtttctactctgttgcttaaaggtttatgtactgtttataatttttattcaataaagcgrtggcaagttactttatcttataaaatcctaagacacttaaattttatgtagtgtaatgagttaaatgatcaggagcagattaatatagttctctgaaata

SEQ ID NO: 73607 - DNA, 201 bp, Homo sapiens
agaatcccactgagacgcttcggagagtgttgccaaaagtcagagtaagttggtatgaaataagattggagtttcccattttttcccagtagcatgttgtyattgttgaaaggattttggagctttgatggctgatcttttgcacctaaaaattgagtggaggaagtgttattatatacattttgaattataatgaaaata

SEQ ID NO: 73608 - DNA, 201 bp, Homo sapiens
agagagtagcctattagcgacgagctttcagcttgcagttgcaagggagtagagagtattgcttaatcaggtcttttaacatcttgtcacatctcaaacayctttgtttgagagagatacataccatctcctttccaagtgtgctctgtgatgatcttgcttcattcttgatattcctctcctgtctctctgttgtatttg

SEQ ID NO: 73609 - DNA, 201 bp, Homo sapiens
aatgatttaaatcttcatgaagatgttgctataattcacattttatagattaggaaataatgcagaaggattaatattcctaagatcactgatatgaaactattttatgactaagttccaggttgttctactgactttattatattataaaataggcatataagggaaattttcattattgccataattgagcaagtaata

SEQ ID NO: 73610 - DNA, 201 bp, Homo sapiens
agttggtatgaaataagattggagtttcccattttttcccagtagcatgttgtcattgttgaaaggattttggagctttgatggctgatcttttgcacctwaaaattgagtggaggaagtgttattatatacattttgaattataatgaaaatatttagggaaattagctgatggaaatggagaaatccagatcttaagtt

SEQ ID NO: 73611 - DNA, 201 bp, Homo sapiens
aagtctccaactgtaattgcaggtttgtctagtcctcctttaaaatatataattttttactagtagtttagtattttgaaactgtgtggtgaaatgcacawaaaattaggattattatgttttcttgaattgacccctttatcattatgtaatgtttattctttgaaatatactttgttaggccgggcgtggtggctcaca

SEQ ID NO: 73612 - DNA, 201 bp, Homo sapiens
atatagaagtccctattatttaatttcaaaataatcaatgctatctctaaaaatacacagatattttgtaattttagagttcctttaccttttactagcaytattcatgataaatatatttttcagttttattcaataagattcttttcagaatttgtgaaacttaaacacttgctcttttggagtaagccaatgatttat

SEQ ID NO: 73613 - DNA, 201 bp, Homo sapiens
aataagattggagtttcccattttttcccagtagcatgttgtcattgttgaaaggattttggagctttgatggctgatcttttgcacctaaaaattgagtkgaggaagtgttattatatacattttgaattataatgaaaatatttagggaaattagctgatggaaatggagaaatccagatcttaagttgtaaaatttct

SEQ ID NO: 73614 - DNA, 201 bp, Homo sapiens
aactcacagttccacgtggctggggaggcctcacaatcgtgacagaaggcaaggaggagcaagtcacatcttacatggatggcggcaggcaaagagagagyttgtgcagggaaactcccccttacaataccatcagatctcgagagactcattcactatcatgagaagagcataggaaagacccacccccataattcagtc

SEQ ID NO: 73615 - DNA, 201 bp, Homo sapiens
atgtatgaagagaagtaattagatgaagggcaagataaggggagataggaaagcaaacattcccagcattgagaaggaaagagaagcatgcagattgaatktagattcaaagaactgagagaaaatcagtgtgcctagagcataaagcaaaaggagttgccgagacagtgaaaaagcccaaattatgcagatccttaggtg

SEQ ID NO: 73616 - DNA, 201 bp, Homo sapiens
caattggaaactgaagtttttcttaaactatcaaaatagcattaaaataagtgatacttagagataaatctggtaaatgttacataagatctataaactgmaaactatagaacatttctgagaggaaataatgagagaactaagtgaactgaaatatagatcatattcgtggatcagaagactcaatattgtgaagatgtc

SEQ ID NO: 73617 - DNA, 201 bp, Homo sapiens
cggaggccgaggcaggtggatcatgaagtcaggagttcgaggccagcctggccaacatggtgaaaccccatccctactaaaaatacaaaaattagccaggygtggtggcaggcatctgtaatcccagctactcaggaagctgaggcaggagaattgcttgaacctgggaggcagagttgcagtgagccgagattgtgccac

SEQ ID NO: 73618 - DNA, 201 bp, Homo sapiens
tatcttccaccagtgtcccctaatgctaacatgttattaatacataatcatggtacatctttcaaaaattcagaaattaacattgatacatcactccaaaytaaacttcagactttatttggatttcactagttttttcacttttttttttttctgtttcaagatcaactccaggaaactgcattgtatttagttgtcatg

SEQ ID NO: 73619 - DNA, 201 bp, Homo sapiens
acattgacttggcagagcataggaggaagaggtgcccaccacataaagtagttagcagtatcagctaagattttaacacatttttaaagggtgaatgtgcrctcgcacagtttatgtgtttaggataacttgtagcttagacacagaggagctttgcatccatttgcaagctcttttccatacgtttccactgtttgatct

SEQ ID NO: 73620 - DNA, 201 bp, Homo sapiens
gatacaaactgttctatggtttacagcttaaaaaataaaggtacatttaatgctatgcattttgagaataatgtcttttatgctttttctttttacatatrtatctatttgtatttaaggacaaaatagattgacattactaattacttcactattaataattaaagttctgtgaaacatttactgagtatatagtttttc

SEQ ID NO: 73621 - DNA, 201 bp, Homo sapiens
atactgtagagcagtgatttccaacttttttttttttttttactatgaccttatcatgtaaggaatacatttcaaactgtgaccctacatatacagacacrtttgtgtgcatgtgtattaatatagataactgaaactaaaatttaacaattattcttccatgtataatacaataaaacatatcaaagttaatatcaaatg

SEQ ID NO: 73622 - DNA, 201 bp, Homo sapiens
aatattttgccaaaacccttgtgatatatgtccttaatttacacttctagttcttaagcttccttattttgttggtatgacattacatgtatgaagagaartaattagatgaagggcaagataaggggagataggaaagcaaacattcccagcattgagaaggaaagagaagcatgcagattgaatgtagattcaaagaac

SEQ ID NO: 73623 - DNA, 201 bp, Homo sapiens
ctttgaacttctcattatctagaagtgaaagaatttgattgtcaagataaatatccaaaatattataccatggtcttttataaaattcagaataatagcgwtataattacaccacataacgaaggtgattccattacaatccaatgcaaaaaacactctctacttatcgaggtattaaatttatttagttgtttttacact

SEQ ID NO: 73624 - DNA, 201 bp, Homo sapiens
tctcgtttagttagttgtaaaattttaggaaaattgaccaacaaatttgatgcccacacgtgagtatttgtatgtaattttcggtctactttattacattsgtttaaaatgtataatgactgtgtaacaatatatttgtgttatttcatactgcatacaaatttagttatcttaactattttaactttatggaattctcat

SEQ ID NO: 73625 - DNA, 201 bp, Homo sapiens
ggagtttcccattttttcccagtagcatgttgtcattgttgaaaggattttggagctttgatggctgatcttttgcacctaaaaattgagtggaggaagtkttattatatacattttgaattataatgaaaatatttagggaaattagctgatggaaatggagaaatccagatcttaagttgtaaaatttctttagtcatt

SEQ ID NO: 73626 - DNA, 201 bp, Homo sapiens
ctgtcggctactattctgttttctgagtttgtcttactggctgggttggcagtatgttatcttagctagcccttttcccctgctatgtcttaacatatctrtatatttttaaaaagtattttaggctgggatggtggctcacgcctgtaatcctggcactctgggaggcagaggtgggtggatcacttgaggtcaggagtt

SEQ ID NO: 73627 - DNA, 201 bp, Homo sapiens
aaacaacacagattgagcattcctaatcctcaaatccaaaatcaaaatgctccaaaatttgaagctttttgagcataaatatgatgctacaagtagaaaaytccccatctgacctcatgcgatgaggtgcagttaaagtcaaaatgcagtcaaaacttagtttcatgcacaaaattatttaaaatattgtataaaattaca

SEQ ID NO: 73628 - DNA, 201 bp, Homo sapiens
ttgtgtcattgcacttaagcctgggcgatgcagggagactctgtctcaaaaacataaataaataaataaataaaatagaaagtattttaaaggaatttttwctgctatttgttaatgaggaaatagaaaggctggttaaaaaaattaacaggagggagcttacaatgttcccagaactcttccaagtttatgtagttattc

SEQ ID NO: 73629 - DNA, 201 bp, Homo sapiens
atgcccatagtctcagctgctcaggaggctggggcccaggagtttgaggctgcagtgaatagttactgactgcactccagctagggcggcatagcaagacyttgcctctaaaaaacaaaaaaaaaacagaaaaaaaaagaaagaaataataggaaaaaataataatttctcctaatatgattatttattatagaattttat

SEQ ID NO: 73630 - DNA, 201 bp, Homo sapiens
taggaacagaatttgtttggaaatttgacacgtacatgtagaatggtatataacgctgatttatgttcgagagagactttttgggggtttggagaggattygggaaatatataataaagaaaggataaaagggacataatcaatgtgaaatgtgatttccttttatttcggtgcatgcccatagtctcagctgctcaggag

SEQ ID NO: 73631 - DNA, 201 bp, Homo sapiens
accctcgttggtataaagagggaggggaaaaataagctcatctgtttttttcaggcaaattttgagcctttatttattttttcgtttaagttgacatgtartaattgtatgtatttatgggatacagagcatatttcaatacatgtatgcagtgtgtaatgatcaaatcagagtagttagcattcatcaccttgaacattt

SEQ ID NO: 73632 - DNA, 201 bp, Homo sapiens
gaagagccactcaaaaggcagtgttctctatatcattgatgataaaggtttaagctaaagaggagtttatctcttcgcaaggaacatgaaactttcgtatrctgttttgacatggcattgataataaaggatacatagtggactttattagtaaaataccttattgtaacataaatattaaatcatgaacataactcttac

SEQ ID NO: 73633 - DNA, 201 bp, Homo sapiens
ctgttgttttaagccactcagtttgtggtaatttgttacagcagccacaggaaactaatgaaagtaacttcccatttcagatataatacaaccccctaccrtgtccttaaatcacccccatctacctttgtgacctcatcatctgccagtcttttccctttctttcataagggcagaatatttgtcagtctagtttctcac

SEQ ID NO: 73634 - DNA, 201 bp, Homo sapiens
tattcattaaaacaaactgtttaataatttaatttgagtaaggaaataattaactatcaactatgtaaagtttagtttttattgtgaactcaaagcaaggytttgtggcatctgctttattgttataaattcaagcacagtatcagcagcttatgagttatattttggattttaagtgagagctgctaggagtaggatcac

SEQ ID NO: 73635 - DNA, 201 bp, Homo sapiens
catggtcttttataaaattcagaataatagcgatataattacaccacataacgaaggtgattccattacaatccaatgcaaaaaacactctctacttatcraggtattaaatttatttagttgtttttacacttacattttggcaaccataaatttgtcataaaattatataaaagaaatcgagcaattccaggcacagat

SEQ ID NO: 73636 - DNA, 201 bp, Homo sapiens
gatagcatctgctcatctcctctctcttgtctaagtggtttaggattaaacaaattatgagggtgtccaggctaggaaaagaggactttgtgctatgtagycaaaatttttagtgtgtgaatctatcttccttattagattttaagttcttagaggtaggagcaaggtacaagaatagatgaagataatattgttagtacc

SEQ ID NO: 73637 - DNA, 201 bp, Homo sapiens
aggaccaagtagttcaggtggagagaacggtaattagccctaaggtgaaagagctgggtgggactgagagagacaggtgtgttttggacccagtggatggkgtggggtgtgattgagaagaggttagagaaatggttgatgaaagagcatgcaaatgttggttttcattcttaggacagtgaaaagtcgttgaagtcttta

SEQ ID NO: 73638 - DNA, 201 bp, Homo sapiens
agtaacttgcttattttgcttggatgcccaaaggatttttctttttctttaagattcaacagtaaatctcagtattggttatattggattgattttctcargtttgtggtatgtgcttttgaatctttttttttttttttgacttaaaaaaaattccttcccttgctttggttttggttttcttcttcaggaactcctatt

SEQ ID NO: 73639 - DNA, 201 bp, Homo sapiens
atggcaaggaatgcctttctgaggagcagaaaactgaagggatggaaagaagcagccatttgagagtcaggaccaagtagttcaggtggagagaacggtarttagccctaaggtgaaagagctgggtgggactgagagagacaggtgtgttttggacccagtggatggggtggggtgtgattgagaagaggttagagaaat

SEQ ID NO: 73640 - DNA, 201 bp, Homo sapiens
cagtgatgtaataaaattaatggattattagtctatagtggattattctggagtacagctcttattttcagtatgctgcatatagtgaagccagtctgtcmcatggaaattctgtagtataatgagacattagtatggaaaactcccaggaagctacacaaaacttttggataaaaattgaatagtttcatcagttttata

SEQ ID NO: 73641 - DNA, 201 bp, Homo sapiens
gctgctcaggaggctggggcccaggagtttgaggctgcagtgaatagttactgactgcactccagctagggcggcatagcaagaccttgcctctaaaaaasaaaaaaaaaacagaaaaaaaaagaaagaaataataggaaaaaataataatttctcctaatatgattatttattatagaattttatgtctcctgtatatgg

SEQ ID NO: 73642 - DNA, 201 bp, Homo sapiens
agataatcctgatactggaattagtagacaaggacttcaagataactgtgattaatatgatcaagataatagaggcaaacatgtagaaaatagataactcygttaatccaacccaatgaaaattttcagttttatgctttatttctgttttagaatttccatttgatttttttatgtagtccacttctatgtggaaattct

SEQ ID NO: 73643 - DNA, 201 bp, Homo sapiens
tgctgaatgtaatatagacatgtgatttttatatttttttgaaaagcaatatgctgtataatgcaatttttactctagaataccatattatttaacatgtrgtttcaaagattttagatatgtaatttattctaaacttttcacttctaaattatcaatgcatattcagtaattccagctactttgagaggaaacaagcca

SEQ ID NO: 73644 - DNA, 201 bp, Homo sapiens
agctgtggtggcatgtgcctgtaatcccagctactcaagaggctgaggcaggagaatcgcttcaacccgggaggcggaggtttcagtgagctgagattgcrccactgcactccagcctgggcaacaagagtgaaactccgtctcaaaaaaaaagtcatgaaaacagaggcaggacatggtaatggtgtatagagagctttg

SEQ ID NO: 73645 - DNA, 201 bp, Homo sapiens
attctctgaatatagtcttttctgtttctgtgacagaaaataactgcctaaggaagatcagggatatttacgattttccttttcaccctgggacaaagttygtgcttatattctgtttaacccccatgggtagctgtagtgcatgctgtttacctggtccccatcagatgttttagatggaaggaagagtaaaaagggctt

SEQ ID NO: 73646 - DNA, 201 bp, Homo sapiens
attaatgttattctggcctcataaaacaagatggatggtattcccaccttctctattttctgaccaagtttgtataacttggttttatttttgccttaagwgttttatagaattcactagtgaagttatctaagcctggaattttcattttggaaagtattttgataattgattctatttccttagtagacattagataat

SEQ ID NO: 73647 - DNA, 201 bp, Homo sapiens
caatatatttgtgttatttcatactgcatacaaatttagttatcttaactattttaactttatggaattctcatgacgaatttacttattcagatgccttycttttcaatctcataacttttcagaattggtaaggttaacttttttcctacttcctatcttaatcttccctatctcataccaaatatagttttgaggata

SEQ ID NO: 73648 - DNA, 201 bp, Homo sapiens
ttactttctttcatttttgaaaagtcgtttttgaaaattggccacttaatgtggtacagatgttaagagtacatgaatgaaaggcaggaaccagggtggaygttcagatgcttcaaaagaaaagcttcaagtctgataacagctgtaagattgtgaaattgatcactgaataacaaagattgaaatatgtaaatattacca

SEQ ID NO: 73649 - DNA, 201 bp, Homo sapiens
ttcttatatgtatggtgtgctttcccaataagactgaaagcttctggagagcaggaacagtatctttatgatttttcatattttctgcagcaactagcccmgtcactggtttttagtaagttcctgctacacatttattgatttgatttattttcttctattgcttattgtgcaggacagaacttacaaaaagtgtggtgc

SEQ ID NO: 73650 - DNA, 201 bp, Homo sapiens
ctcattcactatcatgagaagagcataggaaagacccacccccataattcagtcatctcccacccggtccctcccacaacatgtgggaattaggggagctrcaagatgaaatttggatggggacacagagtcaaaccatatcatttatattgaaaggaatattttaaacttggcagaaactcatcactaatgtttcacaat

SEQ ID NO: 73651 - DNA, 201 bp, Homo sapiens
gagttgatagtatatttgaatattaatttgatgagcctagttggtttataatgtcttaagaaactaagtcagtttacaaatgcaaatttattttaatttgktaagagctaaaatcaaggcaaaaacatttggtttatagtattgattctagaaatagttgcacacacctatatatacttagtgagtttgttaattattgta

SEQ ID NO: 73652 - DNA, 201 bp, Homo sapiens
tcaatattgtcaagacgtcagttcttcccaacttgatctataaactaaatgcagtctcagtcaaaatcccaacaagttatttggtggatatcaacaaactrttgcgaagtttacctagagaagaaaagtcccggaatagccaacatgataatgaagaagaacaaagctagaagattgacaccacctgacttcaggacttag

SEQ ID NO: 73653 - DNA, 201 bp, Homo sapiens
gtggtgaaatgcacaaaaaattaggattattatgttttcttgaattgacccctttatcattatgtaatgtttattctttgaaatatactttgttaggccgrgcgtggtggctcacacctgcaatcccagcactttgggagtccgaggtgggcagatcacaaggcaggagtttgagaccagcctggccaacatggtgaaacc

SEQ ID NO: 73654 - DNA, 201 bp, Homo sapiens
catgactatgccaaattaactttgtaatataattattggttgatttgcctgagtgattaacattaaattatgaagatacttccagaaggatgtaagttcartgagttgagaggcagtgaacactttagttttgtcaataacttaaaattgatttggtggggtcaaattatctagactagaattagcctagtgtaactgtct

SEQ ID NO: 73655 - DNA, 201 bp, Homo sapiens
ttttcggtctactttattacattggtttaaaatgtataatgactgtgtaacaatatatttgtgttatttcatactgcatacaaatttagttatcttaactrttttaactttatggaattctcatgacgaatttacttattcagatgcctttcttttcaatctcataacttttcagaattggtaaggttaacttttttccta

SEQ ID NO: 73656 - DNA, 201 bp, Homo sapiens
gattaacattaaattatgaagatacttccagaaggatgtaagttcagtgagttgagaggcagtgaacactttagttttgtcaataacttaaaattgatttkgtggggtcaaattatctagactagaattagcctagtgtaactgtctgtcttacttacttcttcaagaatgttttacctgtccaaaaggcggcttcacgaa

SEQ ID NO: 73657 - DNA, 201 bp, Homo sapiens
agggcattgggtaggtatactttgaattccttatgccatttccatgaaaacatgccattgaaaggctgtatttgatctttaaaaatgatcataacaagtamctcctctatgtctggattaaaagagataaagaggaatgtgcttagcatggtggtaggcgtttgattaatgttaatttctttttttctcaccttagttgct

SEQ ID NO: 73658 - DNA, 201 bp, Homo sapiens
tcaaaactttttaataggaagagttggtgagataataagctaactgagattaatagtcttggtgttgagatatatatgaagatgaattgtcaaaagatacygaaaagttcaacttaagacttttatgagcattttttaatgggaacaaatctagaagtttttcttttgtattttaaatgtgagaaaatacagaaagcacaa

SEQ ID NO: 73659 - DNA, 201 bp, Homo sapiens
tcaaataattgattaattttttaaagaagagccatctaagaagtaaaagtgatgaaattcaatacatagaacatattataagctaatgtaattttagtaawaaatgaaatgataaaatgggcttaagctgtagcatggtatgagatgtgtgtaaaagagaataagaaaagtttcctttgcttactatttatctatttatgt

SEQ ID NO: 73660 - DNA, 201 bp, Homo sapiens
atgaagttggagagcttctcatgttcttcctttgtataaagtttgcatacgtacaaaacccaggactttaatgactttaagagggggcagaattgcatctyttggaagttaacagactcatgtgaactggaatgtacgttgtggccctcacaattgattttaatatttatttgcaaagtcctttctgtttctaaataaaag

SEQ ID NO: 73661 - DNA, 201 bp, Homo sapiens
ggattaatattcctaagatcactgatatgaaactattttatgactaagttccaggttgttctactgactttattatattataaaataggcatataagggarattttcattattgccataattgagcaagtaatacttcttgttgcctttacattacacacacaaacacacacactttctctctctatctctctctctcata

SEQ ID NO: 73662 - DNA, 201 bp, Homo sapiens
gagttcttcttttgtatccctaccatcttaccacctcctgggggaatgtgggatttcaccttagtccagctttgggagggatgatgccaagaatgcctgaragggtctttcttccctgggattcaggggaggggacaggattgtttcatagagatgttctgaactttgcctctgtttaggccttctcatcttctctcatgt

SEQ ID NO: 73663 - DNA, 201 bp, Homo sapiens
gtccactttgatgacaggaggcatggaataagcagtaatttctgacaagattcctgccactgcctcagtgcccctttcatcaacttcaatcactgttcttygtaaaacctggaaaaaggaaataatgtgaaaaaccatttgtgtggcagtgcaaaggaggaattaaatgagccccttgaaattcttcacagtggtcctacc

SEQ ID NO: 73664 - DNA, 201 bp, Homo sapiens
taccttaatttctctaagctctaatttccccatctacaacatgggataataataatatctacctaccttataaaattagtatgataattaaataagatgartgcaagtaaggtgcttatttattagcacaatgcctggcttatagtatattagatgctatttttattttgttgtgattagaaggaggttattaaagtaagg

SEQ ID NO: 73665 - DNA, 201 bp, Homo sapiens
gtggctcatgcctgtaatcccagcaatttgggaggcagagacgggtggatcacctgaggtcaggagttcaagacctgcctgaccaacatggcaaaaccctrtcaactaaaaatacaaaaatcagctgggtgtggtggtgtgcacctatggtcccagatactcgggaggctgagacaggagaatcgcttgaacctgggagga

SEQ ID NO: 73666 - DNA, 201 bp, Homo sapiens
gtttcacaatttcattttaaactttaaacagtttcagaaaaagttttatgagaaagatttgttggatcaagagaaagaaagagaagaactacttcttttgsaaatggtatgttgttttcacatgcacacacatatactcttttctgattaataactgtgtttttttattaaacttaatcatttctttccatttcaccattt

SEQ ID NO: 73667 - DNA, 201 bp, Homo sapiens
ggggttgcaccagggactgccacaggagtcttaaacaataccaggagacctcaggaacccaatgtgaagtattgtggaatatgtgaaacacattccgggcrtggactcaggatgcactcatgcatcaaatctttattgagcatgtaatttatgctactaattcttgagctgagctggtgctcctaaaaggttttcaagctg

SEQ ID NO: 73668 - DNA, 201 bp, Homo sapiens
tattgctttataaatttcttcagaattagtttttctgctatgaacaaaaatgtttgatctattacattctttcttctgactaatatttattgattattaawataaaattaaataatttcaactattaaatatttagtaattatttatttgtacttatgtgcaaagtgcttttctttataagaacttgaatgaataaaacag

SEQ ID NO: 73669 - DNA, 201 bp, Homo sapiens
cttaattattcttaaaaaaaagtatttagtattctgttgacttaaatctatattaatagtatttgtataacattgataatataattgagctgatattcctrataattgaccctatgatgacttctgaagaatcatcagataaagattgaattatagccatcacaattttagatgtgtatgtaatttattgctttataaatt

SEQ ID NO: 73670 - DNA, 201 bp, Homo sapiens
gagaggtgaaatactttgctgaagatagggagcagcagagtttgactcaaccccaagtacctgagcttcgaagtccatgtgcttagttagcaccatgctatttttttttttaattttattttttgacagggtctcattctgtcgctcaggcaagagtgtagtgatgcaatcttgacctcctgggctccagtgatcctcctg

SEQ ID NO: 73671 - DNA, 201 bp, Homo sapiens
gctgtgcaatgtgatgtcccaccagtccctcacttttaaaaatggctttactgagatataattcatagtccttgtagttcacccatttaaactgtacagttaagtgagttttagtatattcacagaattgtgcaaccatcactgcaatcaattttagaacattttcatcacccccaaaagaaaccttgtactattagcagt

SEQ ID NO: 73672 - DNA, 201 bp, Homo sapiens
ctgtgcaatgtgatgtcccaccagtccctcacttttaaaaatggctttactgagatataattcatagtccttgtagttcacccatttaaactgtacagttaagtgagttttagtatattcacagaattgtgcaaccatcactgcaatcaattttagaacattttcatcacccccaaaagaaaccttgtactattagcagtt

SEQ ID NO: 73673 - DNA, 201 bp, Homo sapiens
tgtgcaatgtgatgtcccaccagtccctcacttttaaaaatggctttactgagatataattcatagtccttgtagttcacccatttaaactgtacagttaagtgagttttagtatattcacagaattgtgcaaccatcactgcaatcaattttagaacattttcatcacccccaaaagaaaccttgtactattagcagttg

SEQ ID NO: 73674 - DNA, 201 bp, Homo sapiens
gtgcaatgtgatgtcccaccagtccctcacttttaaaaatggctttactgagatataattcatagtccttgtagttcacccatttaaactgtacagttaagtgagttttagtatattcacagaattgtgcaaccatcactgcaatcaattttagaacattttcatcacccccaaaagaaaccttgtactattagcagttgc

SEQ ID NO: 73675 - DNA, 201 bp, Homo sapiens
tgttgttgttctttcttgttcttcgctgtgatataaatatatgcctcttaatggaataaagagtatttaagatgaccatactgccagatgaattaaggaaytgatatttttgattttaggtattatgagtcatatcttgttccacaatttattatctatgtgacagtggtgaagttagttatggttttcgagccctgcttt

SEQ ID NO: 73676 - DNA, 201 bp, Homo sapiens
attgtcttgatttctgtttttgatgcttgcttcctttcagtattgttttagtgaggcatggtttgtgtgtgtgtgtatgtgtgtgtgtgagagagagaaaragagaggaagagagagagatcacatttgtgttgtgcatgcatgtgtatatgtgtatataggtggtcttgagtgaccagtattgcttgctcagttttcttt

SEQ ID NO: 73677 - DNA, 201 bp, Homo sapiens
aagaagactgggtatataggtccaaatcatggttatggagatgttagggtagaagacagcagtatggacatgatagaaagaggattgagaatacatttctrtgtgatccatttttgctttgccttctatctaattctgccaattcctaatctttaggactcacctcaaaatctcttgaagccactttttgggagatgtgca

SEQ ID NO: 73678 - DNA, 201 bp, Homo sapiens
tgtcttgatttctgtttttgatgcttgcttcctttcagtattgttttagtgaggcatggtttgtgtgtgtgtgtatgtgtgtgtgtgagagagagaaagaragaggaagagagagagatcacatttgtgttgtgcatgcatgtgtatatgtgtatataggtggtcttgagtgaccagtattgcttgctcagttttctttag

SEQ ID NO: 73679 - DNA, 201 bp, Homo sapiens
aggctggagtgcagtggtgcgatcacagctcacaataaccttgaacttctgggctcaagtgttcctcctgcctcaacctcctgagtagctgagactacagscactagccaccatgcctagctaattaagttttttttgtagagttaggggtcttgctctattgcccagtcttgtcttgaactcctggcctcaagtgatcca

SEQ ID NO: 73680 - DNA, 201 bp, Homo sapiens
ggctggagtgcagtggtgcgatcacagctcacaataaccttgaacttctgggctcaagtgttcctcctgcctcaacctcctgagtagctgagactacaggmactagccaccatgcctagctaattaagttttttttgtagagttaggggtcttgctctattgcccagtcttgtcttgaactcctggcctcaagtgatccac

SEQ ID NO: 73681 - DNA, 201 bp, Homo sapiens
ttacataaaactgtaaggaggccgggcgctgtggctcacgcctgcaatcccagcaccttgggaggctgaggtgggcagatcatgaggtcaggagatccggwtaatcctggctaacacagtgaaacactgtctctactaaaaataaaaaaaaaaaaatttagtcgggcgtggcgtcaggcgcctgtagttccagctactcag

SEQ ID NO: 73682 - DNA, 201 bp, Homo sapiens
acaggcagagatgtgtatagaataacattccattcacagtaccggtcataaacaaaagatgattgttggtgttttcagggagcagcagctgactagtttgrctggagtgtggagtgagtataatggagtagtgttacataaaactgtaaggaggccgggcgctgtggctcacgcctgcaatcccagcaccttgggaggctg

SEQ ID NO: 73683 - DNA, 201 bp, Homo sapiens
aaaatatttactatgtaatacatctataaagagaaaatggaagcagaacatcttttaacaaatttgtcagatgtttgcatagagaagagatcttatttgtyggactcaaaacaggcttcaagatgattatgtcatttgagatgaaccttaaggtatgctaggattttgacaggcagagatgtgtatagaataacattccat

SEQ ID NO: 73684 - DNA, 201 bp, Homo sapiens
gttatactgttttgaaatgtgctgtggggtgtgaggagaaagggaaggttgaaataattctaaactgtatcctaaggaatcagagggctgtttgtaccctygttggtataaagagggaggggaaaaataagctcatctgtttttttcaggcaaattttgagcctttatttattttttcgtttaagttgacatgtaataatt

SEQ ID NO: 73685 - DNA, 201 bp, Homo sapiens
ttgtatgattttgctgtagttgattttattgctgtccctgttgctatgactattaatgttttaccgtaataaaatgttaccatttatatatttttataaastatggcaaactggcaggtcacaggaaaaaatgaggtagaattaaaaaatatgtatttaataatagtctcgaaacttttagacttaagacatataaaacaa

SEQ ID NO: 73686 - DNA, 201 bp, Homo sapiens
ttaaaggattctcctagagagtgatgagaacagtggaatgattatgatgtcctgtatttcatagcttaccgtatagcaacagaaaaagcctttcttcatgrcagggcagcttcatttagaatcagaatatgtttctttctaatagaacttactctaaagcaaaaataatattattttaaaaactatgtaaaacatgtatta

SEQ ID NO: 73687 - DNA, 201 bp, Homo sapiens
tgatctttgttacttcttttcttctgctgggtttgggtttggtttgttgtttctctagttccttgaggtgcgacctcagctagtctatttgtgctctttcrgactttttgatgtagacatttaatgctatgaactctcctcttagcaccgcttttgctctatcccagtgattttggtaagttgtgtcactattattcagtt

SEQ ID NO: 73688 - DNA, 201 bp, Homo sapiens
ttgttatgttaatgtaaattagattacttttaaaattataatttatatttcttttctattatatggagaatataatatataaaagtagagatacttttatrtattgaccttgtattctgcatactgctagactcacttattctagccattttgtagattatttaggatattcaccatagacaactatgttgtttgtgaata

SEQ ID NO: 73689 - DNA, 201 bp, Homo sapiens
ttgggaaatggcagaatttggacgtgaaggcaggagttcctgtcctcacctaggtccgtgggcacaggcccaggggtggtaccctagtcagggaacagccyttcccttcccggcacttccctgcaccccctcccatatcaatattgttatgttaatgtaaattagattacttttaaaattataatttatatttcttttcta

SEQ ID NO: 73690 - DNA, 201 bp, Homo sapiens
tgtgctcttatgcggatgcgctcctcttgacggcctcttaacatctagctgcgtgtgttttcttccgctggagtgttcctttccacgtccagccacttgcrtctctgcctgctagggtcttggggtttttataggcacaggatgagggtgtggtgggccagggtggtcttgggaaatggcagaatttggacgtgaaggcag

SEQ ID NO: 73691 - DNA, 201 bp, Homo sapiens
tagtttaagacagacccagatttattcttggaggctgaggcttgctcatttacttactgagagaccttgggtaagttgcttatcttctgtgagcccaagtyccctaatgtaaaatgggaataaataggctgggcatagtggctttcacacttgtaatcccagcagtttgagaggtcaaggcaggaagatcagttgagccca

SEQ ID NO: 73692 - DNA, 201 bp, Homo sapiens
agatgtatttatttgccatttttatattttctttggtgaggtgttcaaatcttttgtctgctttttattggatgttcttactcttgtagttaagaattctstatatattctagatacaagttgtttgctaaatatttattttgcaaatattttatgccagtctatggcttacattttcatttttgtaacagtgcctttgaa

SEQ ID NO: 73693 - DNA, 201 bp, Homo sapiens
catttttggaaaataactttattgaagtataatttaaataaactaagtttatagtttgatgagttttgacaaatgggtacacctgtgtaactagcacaaamtatagaacattttcatcacccccacaaaagccactggtatctctttgcagttaatgccacaccctaaccctaagcaaccattaatctgctttttgtcact

SEQ ID NO: 73694 - DNA, 201 bp, Homo sapiens
caaatttaataacatgtaaaataccttgtaaactattattttttttctattaaagtacatttgttattattaaggtgagttaagattttaatgataattgyttgggaatattattctgaaacactcattcatttgcatgtttcttttctccccaccttcagcattaagcgagaaatacttcctctggtaaaatcactctgt

SEQ ID NO: 73695 - DNA, 201 bp, Homo sapiens
aaaaaaagaaaaaaaatatgttgttctgaaatctactttaatattcacatattcattccaactttcttttggctagcatttacaaagtatatctttttctstccttttaattaattttttaaatttcagaataattttaaattttcacaaacattgcaaagttagtatagaaagttcctatatatcttccaccagtgtccc

SEQ ID NO: 73696 - DNA, 201 bp, Homo sapiens
actttacctatttaggttagttaattgggtctcttctccttcctgtaatacttgtcaccccttcttcctgtaggtgccagggatttggcttgcttttatctttttttttttttttgagatagggtcttgctatattgcccagctggtctcaaactcctggcctcaagcaatcttcctgacttagcctctctagtagctggg

SEQ ID NO: 73697 - DNA, 201 bp, Homo sapiens
tcttcatatatatgagtttacattttataaaaatcagaattaattttgaggtttttttataggccagtattttgtgagtgttcttctgtagggattgttayatttaaaaataagagacctccaacaattttcacaaaaataggtattctggcattctaggaagaatactgacatgatactatttaataatatcatagaatc

SEQ ID NO: 73698 - DNA, 201 bp, Homo sapiens
tacctttcaatattcctgctatagctcatatatttaggacagactttgataatattcccttttactctatgcaaaatactgtagagcagtgatttccaacttttttttttttttttactatgaccttatcatgtaaggaatacatttcaaactgtgaccctacatatacagacacgtttgtgtgcatgtgtattaatatag

SEQ ID NO: 73699 - DNA, 201 bp, Homo sapiens
tgcctggcctcaaatcttttttatttaaaaatttttcttcttttcaccttttatttctcttgaagtattattgtgtttattcatctttttcttctttctartttagtcttttttgaaatattttcttctaattctttcctgagttctatcacttcatttctgagttttcataattacgattcatgtgttttttcatatctt

SEQ ID NO: 73700 - DNA, 201 bp, Homo sapiens
agctgccattcacacgtggcatgcatttttggtttgtgtgggaaatcttatcacgtagttatggtgtagatgttatgcatggtttattttatttattttgkttaattttattatttttgtcctagttgctctgtttttaatgagggattcaggaaattttaaaaaatgatgtgttcactgctgccatcttcataggggtac

SEQ ID NO: 73701 - DNA, 201 bp, Homo sapiens
caaaagttctgtttaaatgatttaaatcttcatgaagatgttgctataattcacattttatagattaggaaataatgcagaaggattaatattcctaagaycactgatatgaaactattttatgactaagttccaggttgttctactgactttattatattataaaataggcatataagggaaattttcattattgccata

SEQ ID NO: 73702 - DNA, 201 bp, Homo sapiens
agtaagaaataacttctttttatatctttttgtaatttttcttccttgtatacaaattgctgggaaagtcactctattagatgagatacagtaggataatrtatctcattctaaagcacttttcaccttctatcattaggtgttttggtagtttttaattggtagtaagggtaagagatacttcagtgagctcaaattaag

SEQ ID NO: 73703 - DNA, 201 bp, Homo sapiens
aaggaaaatattggaaattgtatttatttttatctactatagtgaacatatgcaaaatcttttccttagccaattaaaaacttaagtcaagaatttacacrtgctttgaaattcttagtattcataattgatgggcatcagtaagacttggaagcatactctttcaacactgtctcagatcttttgtctttactgggttga

SEQ ID NO: 73704 - DNA, 201 bp, Homo sapiens
tcatatagccactcctgctttcttttgattcacatttctatgatacattattttccattctttattttcaaccactgatactgttatatttgaagtgagtktcttgtagacagtatatagtcgaatcatttttaaaatccactctgccaattccggtcttaaattgatatatttagaccacttatatttaatgtaattgtt

SEQ ID NO: 73705 - DNA, 201 bp, Homo sapiens
ttatttggatcttctctcttcttggttaatctcgctagtggtctatcaatgttgtttatcttttcaaagaaccagctttttgtttcacttatcttttgtattttttttttgtttccctttcatttagtcctgttctgatctttgttacttcttttcttctgctgggtttgggtttggtttgttgtttctctagttccttga

SEQ ID NO: 73706 - DNA, 201 bp, Homo sapiens
tatttggatcttctctcttcttggttaatctcgctagtggtctatcaatgttgtttatcttttcaaagaaccagctttttgtttcacttatcttttgtattttttttttgtttccctttcatttagtcctgttctgatctttgttacttcttttcttctgctgggtttgggtttggtttgttgtttctctagttccttgag

SEQ ID NO: 73707 - DNA, 201 bp, Homo sapiens
ttccctcttaaaattgctttggccagtctagggcctttgcattttgatatgaagtctggaatttatttctacgtattttatgtttttggcattattataartggaagtatacatttttttatttcactttccagttttttgttgctggagtataagaatactgttgatttttatatattaaccttgtatcttataaacttt

SEQ ID NO: 73708 - DNA, 201 bp, Homo sapiens
tcttttcttctgctgggtttgggtttggtttgttgtttctctagttccttgaggtgcgacctcagctagtctatttgtgctctttcggactttttgatgtrgacatttaatgctatgaactctcctcttagcaccgcttttgctctatcccagtgattttggtaagttgtgtcactattattcagttgaaagaatttttta

SEQ ID NO: 73709 - DNA, 201 bp, Homo sapiens
agtgtgttcttcagttgttgggtagcatgttctgtagatcatctgttaagttcatttgttctagggtatagtttaagtccattgttgccttgttgactttmtgtcttgatgacctttctagtactgtcagtgaggtattgaagtcccccactattattgtgctgctgtcttaggtctagtagtaattgttttataaatttg

SEQ ID NO: 73710 - DNA, 201 bp, Homo sapiens
ctgaggcaggagaatagcttgaaccagggagtcagaggttgcagtgagccgagattgcaccactgcactccagcctggtgacagagccagactccatctcaaaaaaaaaaaaaaatctttttattttgagaaaactatagattcacatacagttgtaagaaataatacagaaatacccatgttctctttatccagttttcc

SEQ ID NO: 73711 - DNA, 201 bp, Homo sapiens
tttactgagtatatagtttttctgggtatatatagttatattagctggtatgcattatagacctaaaaatattgcctttcagtaaattcctagtggacacyagtgttttcacatatgcttcctagtcattcagtcatttgttatttttaccctatctgcaataaaaacgaacagaaacttctgaaattactttaaatgtgt

SEQ ID NO: 73712 - DNA, 201 bp, Homo sapiens
ttaaattggtgtcagttaagaacaggtggaatttccctctgaggtgatgccatgtttattagcatctttttgatatatatatctatatctatctatctatmtatatatatgtatatttcaagtactttcagaacttaggccactttggttatatttgaaaacagttttttgctgtttgtggaaatggtttttttgggaaga

SEQ ID NO: 73713 - DNA, 201 bp, Homo sapiens
aataggccgggcgtggtggctcacgcctgtaatcccagcactttgggaggctgaggtgggcggatcacctgaggtcaggagtttgagaccagtctgaccarcatggagaaaccccatctctagtaaaaatacaaaattagccaggcgtggtggcacatccccgtaatcccagctactcaggaggctgaggcaggagaatcg

SEQ ID NO: 73714 - DNA, 201 bp, Homo sapiens
aaaaatcagctgtgtttctacaaaccagcaaccaacaattggaaactgaagtttttcttaaactatcaaaatagcattaaaataagtgatacttagagatraatctggtaaatgttacataagatctataaactgaaaactatagaacatttctgagaggaaataatgagagaactaagtgaactgaaatatagatcatat

SEQ ID NO: 73715 - DNA, 201 bp, Homo sapiens
tttcaggtctcctagatattgttttatctaaccaatatctatttagatttacccacatagctatcattttttattacctgtagtatttccatttggaatcttttttttttttctgcctgaagaacaccttttagtattcagtacaagtctgctggtaacaaattatctttgtttttgtctgtttgaaaatgtcttccacat

SEQ ID NO: 73716 - DNA, 201 bp, Homo sapiens
ttgaaaaaaagagtcatcagccaatgaaatgtcctctactgacttcattaagtgtctttgtcctttctttgtcttcatacagtttatggtcctgtcacaaygcttaaatactggcttgaaaatgggaagattttctagttataaggatgtttgcatacttgatgccaaacatctagatgattatgcatatttaagtgctga

SEQ ID NO: 73717 - DNA, 201 bp, Homo sapiens
tgaggcaagagaatggcgtgaacccgggaggtggagcttgcagtgagccgagatcgcgccactgcactccagcctgggcgacagagcgagactccgtctcaaaaaaaaaaaaagagaaatagcgagattatttggacaaactagagaactgggactagaatcagagtctgatcttcatagtgttttatggtctgtcaggct

SEQ ID NO: 73718 - DNA, 201 bp, Homo sapiens
tttttaacgcgaactttgaatgtatgcagaaatgtgcacaaatcataatacagcttgttgaattttcacaagtgaacacacccatgtacccagtatccagrttaaagcatagaacattatcatgttagcttagtagcttcctttgtattcctgtcccagtgccctgtacttcctgcaaagggtagctactctactgacttc

SEQ ID NO: 73719 - DNA, 201 bp, Homo sapiens
ctgtgcaactttgatttctctttttttgatcctctctccatttggcatgggttctctatttcacaccctttgctattccttctgaattttgtctattaaargattctcctagagagtgatgagaacagtggaatgattatgatgtcctgtatttcatagcttaccgtatagcaacagaaaaagcctttcttcatggcaggg

SEQ ID NO: 73720 - DNA, 201 bp, Homo sapiens
taccatttatatatttttataaagtatggcaaactggcaggtcacaggaaaaaatgaggtagaattaaaaaatatgtatttaataatagtctcgaaacttytagacttaagacatataaaacaatagacaatcttgtttcagcacaagcataattaatatcttcatgtatttgttataagatttgcttaataaaatttcag

SEQ ID NO: 73721 - DNA, 201 bp, Homo sapiens
tttatatctgtttttcccagaatcatgccatgtttcaaaggaattaggcccacacagaccaggtttatttttacgttcaatttcagtgatactaactgacytacacttgtcagcatgacacctggaagtgccagttaaacaatagcagaaaggaacaggtatttaggtcctcttggctacagagttaatgtaagtaagcaa

SEQ ID NO: 73722 - DNA, 201 bp, Homo sapiens
gacattgttctaggtaggatgacaaactgtcacaatccaaacaggaaaacagaaattaaaacctctctaaagtttctactctgttgcttaaaggtttatgyactgtttataatttttattcaataaagcgatggcaagttactttatcttataaaatcctaagacacttaaattttatgtagtgtaatgagttaaatgatc

SEQ ID NO: 73723 - DNA, 201 bp, Homo sapiens
tccattttgcctcctagagcaaactcacccagagaaatcttttaaaaagcatcaatcatatcttgtctcccacttgcatgaaaattacttaagtggtgtgrtaggtagaatcatgctccttcccaaaagatattgggccctaatccctagaaattgtaaatgttaccttatttggaaaaggggtctttacagatacagtta

SEQ ID NO: 73724 - DNA, 201 bp, Homo sapiens
gtgttcagattctggatttgttttgaaggtagacccttcaggatttattggtcttttgactgtggggagtgagggaatgagaggagttaaggatgaccccrcagtttttgggctgagcagctggaatggcagagatgacatttactatttatcaggatgaggaagattacaggaggagcaggttttagggagagatcagtg

SEQ ID NO: 73725 - DNA, 201 bp, Homo sapiens
atttttgacaagtcaaaaacaaccctgttagagcaaagaattttaaaacactttctttatccagggaccattttttttttcaaataaaactttattcaagyccagtgtgttttagaaagaataaggtgaaatagaaactggtaaattcaccattgtgggctccgagtttataaggaggagacaaaaaaactactgtctaca

SEQ ID NO: 73726 - DNA, 201 bp, Homo sapiens
gaacaagacaaggatgcccactcataccactcctattaaacatagtactagaagtcctaggcagagcaatcaggcaaaagaaagaaattgaaggcatccarataggaaaagaggaagtcaaatgatctctctttgctgatgatatgattctatacctagaaaaccctaaggatcttgtcagaaggctcctagacctgataa

SEQ ID NO: 73727 - DNA, 201 bp, Homo sapiens
gaactctatgcatttttctgcgttataatcgtaaacaagaacagagacatgaggtcattcaaaaattaattgaacgtaagtaatcattgtctactattttraaaaaggaaagtaaacaaactagttggctttagttatgtctaacttatgtatcattttgctgtgaataattaggttactattgggttttataagatgatt

SEQ ID NO: 73728 - DNA, 201 bp, Homo sapiens
atttccaaatgtggctgtagccttggcctttccttctcaactttggatcatttctgtttgctgggcacctccaccagggtgtctccaccagaatgtcttgstggcttttcaaactcaatgtgctcgaaactgcatttatcactttttatctaaatatgcctctgcttgttattgaagcctgaccatctttctatatcatac

SEQ ID NO: 73729 - DNA, 201 bp, Homo sapiens
tatgtggaaattctttatcttattttctccatatttttccttagtttacatgtgcatttgaaaagaatatttattctccacttgttgactctagtattctrgcatgtcagttataccaagtttgttcagaacttgctgtgtttgttgattttcatgcctattctgttagcataagggcctcctgtgttttggtaacgtttt

SEQ ID NO: 73730 - DNA, 201 bp, Homo sapiens
ctcagcgtggctgtccagagcagggcttttcttcatcaaggacctaggtcctcttccttccacccacctcgccacgccctcggtgcccgagccccgagctstacttcgacggcacttttcaaacacaaccaaacacacccaggcttcaaccccggaccggcttgcttttattatttctcttgggaaagccttatcggtcgc

SEQ ID NO: 73731 - DNA, 201 bp, Homo sapiens
aaggacctaggtcctcttccttccacccacctcgccacgccctcggtgcccgagccccgagctctacttcgacggcacttttcaaacacaaccaaacacasccaggcttcaaccccggaccggcttgcttttattatttctcttgggaaagccttatcggtcgctaagattcagtttaagtgactcttctctgggaggcct

SEQ ID NO: 73732 - DNA, 201 bp, Homo sapiens
catttttcagaataataacactttggaaatatttttgacaagtcaaaaacaaccctgttagagcaaagaattttaaaacactttctttatccagggaccattttttttttcaaataaaactttattcaagcccagtgtgttttagaaagaataaggtgaaatagaaactggtaaattcaccattgtgggctccgagtttat

SEQ ID NO: 73733 - DNA, 201 bp, Homo sapiens
gtgactgacttctttcacttagcataatgtgttcaaggttcacccatgttgtagcagctatcagtagtttattcctttttattgcagtgtagtattctacwgtatggatatagcgcttttgtttagccattcatcagttgatggatattgggttgtttccacttaattcttcactttttgattcagtcatgctggcctttt

SEQ ID NO: 73734 - DNA, 201 bp, Homo sapiens
ttttgaaggttggccaaggcagttgatcatgtttctaagacttttcagcaagaagatggcagagtaagaaaatacaaatcctcaaaatgttatttgggggaaaaaaaaaaaccactactactatatagaaattgacatgtagaattaatctagcaaaaacatagtaatcactataacagtaatcaatatctctgttaaaag

SEQ ID NO: 73735 - DNA, 201 bp, Homo sapiens
tctcagatcttttgtctttactgggttgagagcagttagtcaaagccagattggtaagcttcttcggccatttggatatacacattgaaatgattagaagrttgagtagatgttattaatttatctaccattaaaactaaagaaaagacggtcagtagccttatcacttcaaagttgtttggtgagcatccgttagtttct

SEQ ID NO: 73736 - DNA, 201 bp, Homo sapiens
cacaatcgtgacagaaggcaaggaggagcaagtcacatcttacatggatggcggcaggcaaagagagagcttgtgcagggaaactcccccttacaataccwtcagatctcgagagactcattcactatcatgagaagagcataggaaagacccacccccataattcagtcatctcccacccggtccctcccacaacatgtg

SEQ ID NO: 73737 - DNA, 201 bp, Homo sapiens
atttcacattactcttttttcttcttaaatgatagtccagttttttgaaatctgttcttttatgaactagatagaaaactatatttgagagccttttaaaraaactactttgctgaagtataattgacaactacatatatttaaagtgtactatttaatgaattttgacatatcgatgaaaccatcaccacaatgaaaata

SEQ ID NO: 73738 - DNA, 201 bp, Homo sapiens
ttgtatcttataaactttctaaatttgtttattctaaaaattgttttttagattttctaaaactaaaattttatacgtaagtgatcatatcttctttaaawacagcaatattacttctttctattcaatatttatgccttttgtttctttcttttgtcttattgcaagatccaggacctccagtaaaattaaggtggtaca

SEQ ID NO: 73739 - DNA, 201 bp, Homo sapiens
ctagacaccgcacgcgcgcacacacacacccccctcacctctagacactgcgcgcgcgcacacacacacactcacccctagacactgcacgcgcgcgcgcrcacacaccctcacccctagacaccgcacgtgcgcgcgcgcacacacacacacacaccctcacccctagatacctcataaactgctgaaaataaaaaggat

SEQ ID NO: 73740 - DNA, 201 bp, Homo sapiens
ataatttgtgtactttctttatacatatttatgtatgtatatttgagatggagtctcactctgtcacccaggctggagtgcagtggcatggtccaggctcrctgcaacctccacctcccgggttgaagtgattctcctgcctcagcctcctgagtagctgggattacaggcgtgcatcaccatgcctggctaatttttttt

SEQ ID NO: 73741 - DNA, 201 bp, Homo sapiens
ttcaaagataaatcaatggtgatagaataatattttaaaaaatggtgctggatggaccaattcctggaaagacacaattcatccaggtgcagtggctcatgcctgtaatcccagcaatttgggaggcagagacgggtggatcacctgaggtcaggagttcaagacctgcctgaccaacatggcaaaaccctgtcaactaaa

SEQ ID NO: 73742 - DNA, 201 bp, Homo sapiens
ctgaaccttctggttggaacagacttttaacaagatttagattttcttttaaatgtattttagtgaatgcatgggcatttttgaataaagtttcttaaatrcattcttttgcaaaaactgtgctggagtcccttttaggatctgatttaggctgttttgcattgctataaagaaatacctgggcctgggtaatttatgaag

SEQ ID NO: 73743 - DNA, 201 bp, Homo sapiens
gtattttagtgaatgcatgggcatttttgaataaagtttcttaaatacattcttttgcaaaaactgtgctggagtcccttttaggatctgatttaggctgytttgcattgctataaagaaatacctgggcctgggtaatttatgaagcaaagaggtttaattggctcatagttctgcagactttacaggaagcatagcggc

SEQ ID NO: 73744 - DNA, 201 bp, Homo sapiens
gcatgggcatttttgaataaagtttcttaaatacattcttttgcaaaaactgtgctggagtcccttttaggatctgatttaggctgttttgcattgctatraagaaatacctgggcctgggtaatttatgaagcaaagaggtttaattggctcatagttctgcagactttacaggaagcatagcggcatctgcttctgggg

SEQ ID NO: 73745 - DNA, 201 bp, Homo sapiens
tgggaaattggactggatgctactttattcctctttctactatttttccacaaacaaatctgactaattgaacacaaacaaggtgacttaagaatgtcagwtagagttagtcctctgtctttggccctctagggcctagaattgcctgtcccttcataagtgtcaattagtactcttggaatgaatacaggaatgaatttt

SEQ ID NO: 73746 - DNA, 201 bp, Homo sapiens
aggcagaggtgggtggatcacttgaggtcaggagtttgagaccagcctggccaatatagtgaaaccctgtctttactaaaaaattagccaggtgtggtggygtgtgcctgtagccccagctactcaggaggctgaggcaggagaattgcttgaccccgggaggcagaggttgcagtgagccaagattgtgtcattgcactt

SEQ ID NO: 73747 - DNA, 201 bp, Homo sapiens
ttctctgaatatagtcttttctgtttctgtgacagaaaataactgcctaaggaagatcagggatatttacgattttccttttcaccctgggacaaagttcrtgcttatattctgtttaacccccatgggtagctgtagtgcatgctgtttacctggtccccatcagatgttttagatggaaggaagagtaaaaagggcttg

SEQ ID NO: 73748 - DNA, 201 bp, Homo sapiens
ccttgcccaatgtctccacactgtctatgctcctcgcccatgagtcacttagtagccttctctataatcagtttgactgttatggtattgcagtgcttgcrttcaagtaactcattttacttaatgttgttattattgttaatctcttactgtgcctaatttataaattaaactttatcataggtatgtatgtgtaggaaa

SEQ ID NO: 73749 - DNA, 201 bp, Homo sapiens
aataatacagaaatacccatgttctctttatccagttttcccctatagtaacatcttgacaggatgttgacattgataaaatcaggatacataagatttcyatcaccatgggatctctcacattacacttgtgtagtcacacctatttccctcctgctcctgtatctctccttagcccctggaattcactaacctgttctc

SEQ ID NO: 73750 - DNA, 201 bp, Homo sapiens
cttgcattatgtctagcatacatagtatgtgcagagtaaatatttgtgaaatttatatctctacgtataaatcagaataatagacacatatttggatcttycaaatatgatttttagttaaattacaattcagagaacatgatttcaatttaagtgaaacgattataatattaggtattgatgcatgtttttctttccttc

SEQ ID NO: 73751 - DNA, 201 bp, Homo sapiens
cacactgaaaggatgcaaatagccgtctgcgattttggcggccctccggattgtggtgacaatatgttgtacccggacattcccaaatttaaatttggcartgaaaattccacaaagatttctggtaactttgagctataaataccttaaaaataatagattgatgattttctttatttcctagagaatttattttataaa

SEQ ID NO: 73752 - DNA, 201 bp, Homo sapiens
cggatcatgaggtcaggagattgagaccgtcctggctaacacggtgaaaccccgtctctactaaaaatacaaaaaattagctgggcgtggtggcaggcgcstgtagtcccagctactcgggaggctgaggcaagagaatggcgtgaacccgggaggtggagcttgcagtgagccgagatcgcgccactgcactccagcctg

SEQ ID NO: 73753 - DNA, 201 bp, Homo sapiens
attgaaggaacatacctcaaaataataatagctgtctatgacaaacccactgccaacatcaaactgattgggcaaaagctggaagccatccccttgagaaytggaacaagacaaggatgcccactcataccactcctattaaacatagtactagaagtcctaggcagagcaatcaggcaaaagaaagaaattgaaggcatc

SEQ ID NO: 73754 - DNA, 201 bp, Homo sapiens
atgtcacgaggcagactagaaagctggttatttgtgccactaatttttatagaatctaattttatatttgtgttataacatggctttattttagaagaaawatataacaaggatgtatttttaaaaattattattgtaacctgtatctgtctagtactctcaaatctgagagactttattgctatattttaggtatctaag

SEQ ID NO: 73755 - DNA, 201 bp, Homo sapiens
aaaaaactctgtgctactcagtgtgaataatttctcttgatgtatcttcagtgttaccaacccttccctgtcatctccattcagctgctgagcctatccarttaatttttttatttccaatattatatttttcagttctaaaatttccatttggttcttttagtgttttctatttctatgccaagaatttgtgtgactaaa

SEQ ID NO: 73756 - DNA, 201 bp, Homo sapiens
tggtggctcacgcctgtaatcccagcactttgggaggctgaggtgggcggatcacctgaggtcaggagtttgagaccagtctgaccaacatggagaaaccycatctctagtaaaaatacaaaattagccaggcgtggtggcacatccccgtaatcccagctactcaggaggctgaggcaggagaatcgcttgaacccggga

SEQ ID NO: 73757 - DNA, 201 bp, Homo sapiens
tttaggtctttgcttaaatatcatcttttcagtggaaccttcaatgacaaccctctttggccacctgctttaaaactgattaatcccctgcccctggtackcccttgtctttattcttcactttatttttctccatagcatttaacactatctgacagattttacttgtttcttttctcttctctgctcccatactagaat

SEQ ID NO: 73758 - DNA, 201 bp, Homo sapiens
tataaatatctacctgaaagaccaagggaacattggcctgatccactgatggcattcttggatgagaagtaggaacagaatttgtttggaaatttgacacktacatgtagaatggtatataacgctgatttatgttcgagagagactttttgggggtttggagaggattcgggaaatatataataaagaaaggataaaagg

SEQ ID NO: 73759 - DNA, 201 bp, Homo sapiens
aaacagccatggaaaaagagtagacttttagcttagcaaaggagagtatttcctctgaaatgcctcctcctggaaaggcttttttttaggctctgggattwactcttaacttcctggcattcttcaacctccttgtttcttcctttccaacccagtctagactgtggtagtgccttagaccaccttagactaggtcctttt

SEQ ID NO: 73760 - DNA, 201 bp, Homo sapiens
gtggaggcagggaatggctagtcttctgtagcagcttcccagcacctggtactactctgaggcatttttctgggccaagcccaggggtccctggagccttmctgaattctggctgcctatactgtggctgcttgctatgtttgggaggcccttttttacagaaacaagatgtgatatgagtgatgtacctatataattact

SEQ ID NO: 73761 - DNA, 201 bp, Homo sapiens
tgaattgacccctttatcattatgtaatgtttattctttgaaatatactttgttaggccgggcgtggtggctcacacctgcaatcccagcactttgggagkccgaggtgggcagatcacaaggcaggagtttgagaccagcctggccaacatggtgaaaccctgtctctactaaaaatacaaaaattacctgggtgtgttg

SEQ ID NO: 73762 - DNA, 201 bp, Homo sapiens
attgacccctttatcattatgtaatgtttattctttgaaatatactttgttaggccgggcgtggtggctcacacctgcaatcccagcactttgggagtccraggtgggcagatcacaaggcaggagtttgagaccagcctggccaacatggtgaaaccctgtctctactaaaaatacaaaaattacctgggtgtgttggtg

SEQ ID NO: 73763 - DNA, 201 bp, Homo sapiens
cctttatcattatgtaatgtttattctttgaaatatactttgttaggccgggcgtggtggctcacacctgcaatcccagcactttgggagtccgaggtggrcagatcacaaggcaggagtttgagaccagcctggccaacatggtgaaaccctgtctctactaaaaatacaaaaattacctgggtgtgttggtgggcacct

SEQ ID NO: 73764 - DNA, 201 bp, Homo sapiens
atataaatatctacctgaaagaccaagggaacattggcctgatccactgatggcattcttggatgagaagtaggaacagaatttgtttggaaatttgacaygtacatgtagaatggtatataacgctgatttatgttcgagagagactttttgggggtttggagaggattcgggaaatatataataaagaaaggataaaag

SEQ ID NO: 73765 - DNA, 201 bp, Homo sapiens
atactttgttaggccgggcgtggtggctcacacctgcaatcccagcactttgggagtccgaggtgggcagatcacaaggcaggagtttgagaccagcctgrccaacatggtgaaaccctgtctctactaaaaatacaaaaattacctgggtgtgttggtgggcacctgtaatcccagctactcgggaggctgaggcaagag

SEQ ID NO: 73766 - DNA, 201 bp, Homo sapiens
aggccgggcgtggtggctcacacctgcaatcccagcactttgggagtccgaggtgggcagatcacaaggcaggagtttgagaccagcctggccaacatggwgaaaccctgtctctactaaaaatacaaaaattacctgggtgtgttggtgggcacctgtaatcccagctactcgggaggctgaggcaagagaattgccccg

SEQ ID NO: 73767 - DNA, 201 bp, Homo sapiens
catcatatcagggggttcatgctatcaccgtggatttatcatcagttatgttaatttaggtcattcagttaaggaaatacctgccaggtttctccactgtrggagtggtgagagatgacttgcagcctttcctcatcttaggagaaagcattctgtctcttaccattaactatatataatgtggtggtacttttttttata

SEQ ID NO: 73768 - DNA, 201 bp, Homo sapiens
tgaaatttgctaagagagtagatcttaagtattctcaccacaaaaagtcagtatgtgaggtgatggacatgttgattagctttactgtagtaatcattttmcaatgtatacatatagcaaaatatcataatcactttgtagcctgtaaatacataatttattttttctcaatttacaattaaaaagggttaaaaaatccca

SEQ ID NO: 73769 - DNA, 201 bp, Homo sapiens
tctacctactagattacagtagtatttcctaaatgatgattaaaaaaaaatgtccctagaccatgagtagaggggaggggaagggggagatcactcctggktgagaaccactagctaacccagtttcttttccttcaaactcataatacccaatgtactacccataatgtatcagtttttctccctgggtaggaaaagggc

SEQ ID NO: 73770 - DNA, 201 bp, Homo sapiens
tgtctttttaaactgctgttgctttaaagtttgttttgtctgatgtaagaatagctactcctgctcacttttggtgaccgtttgcatggaatatctttttytacccctttaccttaagtttatgtgagtccttatgtgtgtttggtgagtctcttgaagacagcagctggttggtgaattcttatccattctgtgattctg

SEQ ID NO: 73771 - DNA, 201 bp, Homo sapiens
aatcgcttgaacctgggaggacgaggttgcagtgagccaagatcatgccagtgcacttcagcctgggagacagagtgagactccatctcaaaaaaaaaaamaacaacaacaacaacaaaaaaagactcaattcaaaactcacagaagaagaaatagacaatctgaataggctcatatctattaaagaaattgaattggtaa

SEQ ID NO: 73772 - DNA, 201 bp, Homo sapiens
aaaaatgaaatactcaggcataattctaacaaaatatgtacaagatctatataaggaaaactacaaaattctgataggagaaatcaaagaactaataaagraggagatgtctcatgttcattgctagaaatactcaatattgtcaagacgtcagttcttcccaacttgatctataaactaaatgcagtctcagtcaaaatc

SEQ ID NO: 73773 - DNA, 201 bp, Homo sapiens
cacaaaaatgtattcaaaaatgaatcgctgttctaaatgtaaaatgcaaaactataaaattcctagaagttaacataggagaaaatctagatgaccctgcttatggtaatgacattttagataccatgtcaaaggcgcaatctatgaaataaagaataagctgaaattcattaaaattaaaactactatttgaaaaatact

SEQ ID NO: 73774 - DNA, 201 bp, Homo sapiens
aactgcttgatgaaggaggcaaaacaaaggcagcaggagataatgtgattggtacacaaaagctaaagcagtggctggggctttgtttttaaattttgggtttttttttttgttgttgttaatgagcagaaagagagacataatgacagctgatgttaaacttttcatatttcaaattagattccctaggaggtataatat

SEQ ID NO: 73775 - DNA, 201 bp, Homo sapiens
tagtgaagacttctacaatgttaagatttcccccgctcggttggaaaccctgaatttgtgtgtatgtatttgtgtaaggtaagttacattttttattggtstgcgtttttctgtcatgcctgtgtacttgggaaatctgaaactgagtgtcttaggaacttcttaaagcaaatgtgagggaacattaaaaagtatatttaa

SEQ ID NO: 73776 - DNA, 201 bp, Homo sapiens
tcttagaagttttagagatagaactaggaccaaaaagtatgaatcagaagttacaggactctctctctctctctctccatatatatatgtatgtctctctscatatatatatatatgtgtgtgtatatatatatacacacacacatatacacacatatacatttatacacacatacatatatacatatatatacacacata

SEQ ID NO: 73777 - DNA, 201 bp, Homo sapiens
gatagaactaggaccaaaaagtatgaatcagaagttacaggactctctctctctctctctccatatatatatgtatgtctctctccatatatatatatatrtgtgtgtatatatatatacacacacacatatacacacatatacatttatacacacatacatatatacatatatatacacacatatatatatatacatata

SEQ ID NO: 73778 - DNA, 201 bp, Homo sapiens
gcgcccgcccccagcgcccgccctcagccggctgcgggaggcaaaaggctctgcgcacgcgctgtggggtggggcacacttggttgggggcggacgggggwttaggaggacggcgaggagcgggcgcagaagggtggcggggccgccgggtcgttgcgcggcagttgcgtccggcctcttgcgcgcggcgcccgggaaggg

SEQ ID NO: 73779 - DNA, 201 bp, Homo sapiens
tgtctctctccatatatatatatatgtgtgtgtatatatatatacacacacacatatacacacatatacatttatacacacatacatatatacatatatayacacacatatatatatatacatataacaattttagctatttgtggattgggcagctcttcaaagaaatggtgagtttgatgtcactggaagcatgaagag

SEQ ID NO: 73780 - DNA, 201 bp, Homo sapiens
ccccagcgcccgccctcagccggctgcgggaggcaaaaggctctgcgcacgcgctgtggggtggggcacacttggttgggggcggacgggggtttaggagracggcgaggagcgggcgcagaagggtggcggggccgccgggtcgttgcgcggcagttgcgtccggcctcttgcgcgcggcgcccgggaaggggcggggcc

SEQ ID NO: 73781 - DNA, 201 bp, Homo sapiens
ctccatatatatatatatgtgtgtgtatatatatatacacacacacatatacacacatatacatttatacacacatacatatatacatatatatacacacwtatatatatatacatataacaattttagctatttgtggattgggcagctcttcaaagaaatggtgagtttgatgtcactggaagcatgaagaggaagaga

SEQ ID NO: 73782 - DNA, 201 bp, Homo sapiens
ccccctagtgatatgaaagagtgagatttctgcagtcaaatcagtggaaataaacaagtgttgtaccatgtgagaactctggcgtacttcttcttgggttmaagactaggatagggtagcaatgagacagtaaggaagaactccagtgattaaagctttgctactcacctagcttttggttgtttttcttttaaaatacct

SEQ ID NO: 73783 - DNA, 201 bp, Homo sapiens
caaagcaatccgtttcacttccatttaggatatagaaagctgcaagagaacatcactcttattctaataacagtaggttatccacaaaatccacacagtcrtaacttcttgagcacatcagagttggtcaccaggcagccaagtgagctgaattctcaagagtaacaaacccctcttaggatagatgggacacaggaacat

SEQ ID NO: 73784 - DNA, 201 bp, Homo sapiens
atctatgtctcccgaaatcttgttggtattttgataggaattgtgttaaagctgtataccactttggggagaatcgccatatttaccatgctgaatttccyagtgtgtgcctctctgattgcttagatatcctttgatttctttcagcattgtgtattttcagcctacaacttctgtacatattttgttagttttttggag

SEQ ID NO: 73785 - DNA, 201 bp, Homo sapiens
gcagtatataatggattccagctgtataccttccattattgctaaggccaaattactgaagtctttggcaaaccttgaattccctgttttggaaaagtackaggtctgtgaatataaagggtttggagattgtttcccatctctgtttccttgtcttttgttatgagaacaaccatgggaggcatctgtgtcttttttcct

SEQ ID NO: 73786 - DNA, 201 bp, Homo sapiens
atagtccttgtagttcacccatttaaactgtacagttaagtgagttttagtatattcacagaattgtgcaaccatcactgcaatcaattttagaacatttycatcacccccaaaagaaaccttgtactattagcagttgctcctcagtaccaaccctctcagcctttgggaaccactattctgctttctgtatctatggat

SEQ ID NO: 73787 - DNA, 201 bp, Homo sapiens
cttatttggatcttctctcttcttggttaatctcgctagtggtctatcaatgttgtttatcttttcaaagaaccagctttttgtttcacttatcttttgtwttttttttttgtttccctttcatttagtcctgttctgatctttgttacttcttttcttctgctgggtttgggtttggtttgttgtttctctagttccttg

SEQ ID NO: 73788 - DNA, 201 bp, Homo sapiens
aagaacaaaaggaacactctcccctgccatccattgctggtatcctgtgtgtgtttgatacctcagattcagcatctactacagcacgaagtgcttatgcrtgtcctgaattataggagagtcggattcaccaccctgcccagaaacagaagcattccagaggtttcttcatagatcatgaaatgaaatggccggtccact

SEQ ID NO: 73789 - DNA, 201 bp, Homo sapiens
agcttatttggatcttctctcttcttggttaatctcgctagtggtctatcaatgttgtttatcttttcaaagaaccagctttttgtttcacttatcttttktattttttttttgtttccctttcatttagtcctgttctgatctttgttacttcttttcttctgctgggtttgggtttggtttgttgtttctctagttcct

SEQ ID NO: 73790 - DNA, 201 bp, Homo sapiens
caaccatggtccaaaaacattaaatgaaaaattccagaaataaacaatctaaaagtcttaagcagcatgccattctgagtagtgggatggaatcttgcatygtcctgctctgtcccacccaggatgtgaattctccccttgcccaatgtctccacactgtctatgctcctcgcccatgagtcacttagtagccttctctat

SEQ ID NO: 73791 - DNA, 201 bp, Homo sapiens
aactgagataatatacataaattatctgaaaggtgtggtccctaatctcaagaatttgatcatctcatgggcccaggagtctcatagagatgaatcattaygatggcttgggtagcttctgctgaatatctgttttctagacatgccttgggttataaagaatggagtgtgcatagattgttaagtgtttttgtttttcct

SEQ ID NO: 73792 - DNA, 201 bp, Homo sapiens
acaaatatggtagttcattttgctgttcaggatatcctgtttgtattacttttgccgtgcaagctttatgattttgtctgaggggttttagaaatttggtygagcctactgtcatttcaatttcaaaccatctcacaggctctacagaattgcttaaggcaaatggttattgcaaatatttacaagatttttctgaactat

SEQ ID NO: 73793 - DNA, 201 bp, Homo sapiens
aatttcaaggatccccactataatatttgggatctttagtaattcaacattatatttgtatgtaaatcaagataatgaacatgaatttatactggacacartacgtctggttgagagatttttctctaatatatggtttgaacccaaacccaggaaagataaatggccatatttatttagaattaaggttctgcctagtgg

SEQ ID NO: 73794 - DNA, 201 bp, Homo sapiens
agtcatcttcctcccggcggctccaacctttagcgccagcaaacctagtttacggaccggacccctttcccctggccattgcttaattagctgccttagckcctctcactcccacctgccgcaatatctcaaatctctggtttttttccagccccggagtttatttccttccctcccccactccagatcttgtccttttca

SEQ ID NO: 73795 - DNA, 201 bp, Homo sapiens
atatgaggtacaaaatatacatgttttcatatgactgttatatatgtatttgaaattctatcagtatatataaaatgaaagaaaagaataatatgcttttrtttagttcaccatttatcaaaaattcattttccttaagtctaatcatgtttctgcttatgtatattttttaaattttcttttctaaatcataggaaatac

SEQ ID NO: 73796 - DNA, 201 bp, Homo sapiens
aagcctctgtgtaacctaagaaaagggtaggatttaggaggtcaaagcttattgacagtaataatatgtaatacattttactgtagttggaagagttgctrtgataatctgacaggaagaagaatgagttgtagtttttatttcaaaatttggttcccaggaatcatactttttacttaatgatttcttttaaaagtgttt

SEQ ID NO: 73797 - DNA, 201 bp, Homo sapiens
tggggccaagccttgacaggcattttgatggagacaaaccatattaaaaccagtaccctatggcatacagtgttgctacatattccatctctcttttctcycatcaaaacttaactgacttgtgtgtgtatagggctaagaatttgactttaactttttcacctaattgacattaagacagatcctgagacattgtctaca

SEQ ID NO: 73798 - DNA, 201 bp, Homo sapiens
tcttgatatatattcttcgggcacttgaatggaatgtgtattctgctgttggatagagtgttctataaatgtctactaaatcttggttgatggtattcttragttcttctatatctttgctgattccctgtgtagttctgtcagttgttgagagatgggttctgaaatctccagctgcacctgtgtatttttgtctgtttt

SEQ ID NO: 73799 - DNA, 201 bp, Homo sapiens
ttgaacctctaccctgggccaggcattgtcattttctttttctttcagattattctctttcagttctttagcagtgtagtaaatttatttcctctggttgktgtaacaaattaccgcaaaccaggtggcttaaaaataatagaaatttattctgtcacagttctagaaaacagaagtctgaagtcaagatgtcagcaggga

SEQ ID NO: 73800 - DNA, 201 bp, Homo sapiens
ttcatggcagggcagcttcatttagaatcagaatatgtttctttctaatagaacttactctaaagcaaaaataatattattttaaaaactatgtaaaacaygtattaaagtcttatgtacgtataactacaaatccatttgaagagataagtaaaaataattctaatcaataagtaaatattatggaatcagctatcaata

SEQ ID NO: 73801 - DNA, 201 bp, Homo sapiens
aattttatatctaaatgatgtatttctggcttaaaacttagaagtctgagtgcttaacattcaaagcagtcatttttccaattagtccatactttttatarctgtgcagaggaattcagcttataattataaattttaaatttgtgttttctttgtaagtgctggtcaagatgtccaaggaacaagtgtgattgcaaatct

SEQ ID NO: 73802 - DNA, 201 bp, Homo sapiens
gtgtcctccaagagtttacctactaatggggtcagtgaggttacatactaatgaggattatgtttgctaatagaggttggtagattttgctttgttttttwatttggatatagctcttgtcataatttttaatttatgtgtttaaaatactgaagttattattgagtccttgagttttatttttaggcatgtgtagcatgg

SEQ ID NO: 73803 - DNA, 201 bp, Homo sapiens
acgcctgtaatcccagcactttgggaggctgaggtgggcggatcacctgaggtcaggagtttgagaccagtctgaccaacatggagaaaccccatctctastaaaaatacaaaattagccaggcgtggtggcacatccccgtaatcccagctactcaggaggctgaggcaggagaatcgcttgaacccgggaggcggaggt

SEQ ID NO: 73804 - DNA, 201 bp, Homo sapiens
tcatcagggtcagaattaagaggtcttgtggtttaggaagcataaaattatgtaacttattgtttatttcactcagaaaataaaagtattaatgaaaggarttagagatgaacagattgatacaaactgttctatggtttacagcttaaaaaataaaggtacatttaatgctatgcattttgagaataatgtcttttatgc

SEQ ID NO: 73805 - DNA, 201 bp, Homo sapiens
tgttattaatttatctaccattaaaactaaagaaaagacggtcagtagccttatcacttcaaagttgtttggtgagcatccgttagtttctagaggcccayttattcaaagaagtagaactgcttcaaagtcttcatcttgtcttctatgttttgccttatattattgaaatccagtaaaatgttaattgcatttgattaa

SEQ ID NO: 73806 - DNA, 201 bp, Homo sapiens
caccgcacgcgcgtgcacacacacacacacacctcctcacccctagacaccgcacgcgcgcgcacacacacacaccctcacccctagacaccgcacgcgcrcacacacacaccctcacccctagacaccgcacgcgcgcacacacacacccccctcacctctagacactgcgcgcgcgcacacacacacactcacccctag

SEQ ID NO: 73807 - DNA, 201 bp, Homo sapiens
ggctctctataactacaaacatttgatatcctgcacatagttgaacagtagcaaagctggagttctcagatatagtactgactgattatgtcacgtcatcrtttttggatagcatctgctcatctcctctctcttgtctaagtggtttaggattaaacaaattatgagggtgtccaggctaggaaaagaggactttgtgct

SEQ ID NO: 73808 - DNA, 201 bp, Homo sapiens
ttttgactctgtggcttattttctttggccagttttggaaaattctcaggtatctttttacatgtgcctctgcctaatcttctctctctcctccttctaakactccaattttatgtatattagatcttttaatagtatttccatgtcctttatcttcttttctttcttttccatccttttttctgtttgtgattcattggt

SEQ ID NO: 73809 - DNA, 201 bp, Homo sapiens
tagccatttaccaatctgaaattgaaacgaccaaagtaatggatattttgctaatgtgatttaggaaataccgtctagaaaatgaagggtaattattacartgataccaaactcattgttttagcttgacaaaccctcaagggcataattctgtagatatgaaaagagcacaaatctgaaagaaccctgaattctttagac

SEQ ID NO: 73810 - DNA, 201 bp, Homo sapiens
taggtaaagaaatcaagaaatccaaactgattcgaagccagtcttttaataatcaagcttttcatgcaaaatatggcaacttagagaaatgtgctaggtaygatctgtaagcccttcaatttttaacataatttttatctttattcacatcttcatatatatgagtttacattttataaaaatcagaattaattttgaggt

SEQ ID NO: 73811 - DNA, 201 bp, Homo sapiens
ctgggctcaagtgttcctcctgcctcaacctcctgagtagctgagactacaggcactagccaccatgcctagctaattaagttttttttgtagagttaggrgtcttgctctattgcccagtcttgtcttgaactcctggcctcaagtgatccacctgcctcaaccccgcaaggtgctgggattataggtatgagtcaccag

SEQ ID NO: 73812 - DNA, 201 bp, Homo sapiens
agactgtgtgatatacataatttacaagtagctaataacatccaaatttaataacatgtaaaataccttgtaaactattattttttttctattaaagtacrtttgttattattaaggtgagttaagattttaatgataattgtttgggaatattattctgaaacactcattcatttgcatgtttcttttctccccaccttc

SEQ ID NO: 73813 - DNA, 201 bp, Homo sapiens
aggtaagttacattttttattggtctgcgtttttctgtcatgcctgtgtacttgggaaatctgaaactgagtgtcttaggaacttcttaaagcaaatgtgrgggaacattaaaaagtatatttaaaatatagaataggtccattttctaccttaaagagtagtatattaaatacaattattatgctgttgttgctttgcag

SEQ ID NO: 73814 - DNA, 201 bp, Homo sapiens
gaagcattccagaggtttcttcatagatcatgaaatgaaatggccggtccactttgatgacaggaggcatggaataagcagtaatttctgacaagattccygccactgcctcagtgcccctttcatcaacttcaatcactgttctttgtaaaacctggaaaaaggaaataatgtgaaaaaccatttgtgtggcagtgcaaa

SEQ ID NO: 73815 - DNA, 201 bp, Homo sapiens
tttgtgtgtatgtatttgtgtaaggtaagttacattttttattggtctgcgtttttctgtcatgcctgtgtacttgggaaatctgaaactgagtgtcttargaacttcttaaagcaaatgtgagggaacattaaaaagtatatttaaaatatagaataggtccattttctaccttaaagagtagtatattaaatacaatta

SEQ ID NO: 73816 - DNA, 201 bp, Homo sapiens
gcatccctttaaacacctagcttaaggatatggtatttaatcacccagtgtgcagaaagattggtaaagctgatgtcacttaagaaataagtggcagcatkgaacccagaattgtgagtccaataaactgaagagatttacagactgtacttgtgtcttgaagctgaggttataaagggcctcctttctccttttccccca

SEQ ID NO: 73817 - DNA, 201 bp, Homo sapiens
gcagcaagcaagagggtgtatgtaggggaactgcccttttataaaaccaccagatctcgtgagacttattcactatcacgagaacagcatgggaaaaattygcccccatgattcagttacctcccaccgggtccctcccacaacacatgggggttattacagttcaaggtgagatttgggtagcgacacagagccaaacta

SEQ ID NO: 73818 - DNA, 201 bp, Homo sapiens
taaggaaaaaaggctaaagccatctgtgttttactgaaaatgatggtagttggggagggaatgggggttggagcagccgaggatgaactgaatacattttycttttttctgcttattgctctaggtaaagaaatcaagaaatccaaactgattcgaagccagtcttttaataatcaagcttttcatgcaaaatatggcaac

SEQ ID NO: 73819 - DNA, 201 bp, Homo sapiens
tcatgttggcctggctggtctcaaactcctgatctcagatgactcacccatcttggcctcccaaagtgctgggattactggtgtgagccactgtgcccagsctctctatgtatattatacttaaataaagcatttaaaaatatccaagaccattttcttttctctcaatctttttaaagaaagatattatttagccattta

SEQ ID NO: 73820 - DNA, 201 bp, Homo sapiens
ggttgttctactgactttattatattataaaataggcatataagggaaattttcattattgccataattgagcaagtaatacttcttgttgcctttacatyacacacacaaacacacacactttctctctctatctctctctctcatagagaagtacagtaatatctttgaggcttacgtagaaagatagtttttttgacc

SEQ ID NO: 73821 - DNA, 201 bp, Homo sapiens
ggctggagtgcagtggcatggtccaggctcactgcaacctccacctcccgggttgaagtgattctcctgcctcagcctcctgagtagctgggattacaggygtgcatcaccatgcctggctaattttttttatgtttttagtagagatggggtttcatcatgttggcctggctggtctcaaactcctgatctcagatgact

SEQ ID NO: 73822 - DNA, 201 bp, Homo sapiens
gaaccatgtatgtatcatatagcactagtatctggagctccttttggcatgtttatattttgtattgtttctgcttattatcttatctccttatatatgtkgatattattgattatgtgcttggtcttgtatttgacaaattatttgtagaaatagtttgaggcctaggatgatatctttctcatggaaggaatatatttt

SEQ ID NO: 73823 - DNA, 201 bp, Homo sapiens
ttgagatggagtctcactctgtcacccaggctggagtgcagtggcatggtccaggctcactgcaacctccacctcccgggttgaagtgattctcctgcctyagcctcctgagtagctgggattacaggcgtgcatcaccatgcctggctaattttttttatgtttttagtagagatggggtttcatcatgttggcctggct

SEQ ID NO: 73824 - DNA, 201 bp, Homo sapiens
tggagctggttatacaagtgcgtctattttgggaaaattcattgagctatgaatttgtatacctataatttgtgtactttctttatacatatttatgtatstatatttgagatggagtctcactctgtcacccaggctggagtgcagtggcatggtccaggctcactgcaacctccacctcccgggttgaagtgattctcc

SEQ ID NO: 73825 - DNA, 201 bp, Homo sapiens
ccagcctctctatgtatattatacttaaataaagcatttaaaaatatccaagaccattttcttttctctcaatctttttaaagaaagatattatttagccrtttaccaatctgaaattgaaacgaccaaagtaatggatattttgctaatgtgatttaggaaataccgtctagaaaatgaagggtaattattacaatgata

SEQ ID NO: 73826 - DNA, 201 bp, Homo sapiens
gcatttgaaaagaatatttattctccacttgttgactctagtattctagcatgtcagttataccaagtttgttcagaacttgctgtgtttgttgattttcwtgcctattctgttagcataagggcctcctgtgttttggtaacgttttgtttcatgatattggagctggttatacaagtgcgtctattttgggaaaattca

SEQ ID NO: 73827 - DNA, 201 bp, Homo sapiens
tggcacaatcttggctcactgcaacctccacccgccaggttcaagtgattcctcctgcctcagcctcccaagtggctgggattacagatgtttgccaccayacccagctaatttttgtatttttagtagagacggggtttcaccatgttggtcaagctggtcttgaactcctgacctcaggtgatctgcctgcgtcggcct

SEQ ID NO: 73828 - DNA, 201 bp, Homo sapiens
ctctattctacattcttctgcctttgccatgaccctgaagtaccagtcagatacactattgctatttgcttttatgaagtaagtctgaagacttgatatcrctttacgtttgttgttaattctacctatgtatactagatgattttgtgcttatagattataagatatagactggatatctctttcatgttctagtcttaa

SEQ ID NO: 73829 - DNA, 201 bp, Homo sapiens
tctagtcttaaatcttgtttaaaaatttccttaattttcttcttttttagtatgtttactgaatcatttccataaatacattatatttgtgtattcttttwttaacccattcattcagcatatctataccaagtgtttaaaccagacattgtggtagatatgggtgatgcggattttaaagtaaaatcagtttttatatgc

SEQ ID NO: 73830 - DNA, 201 bp, Homo sapiens
atgcaaaagataaaatagatcatagacctaaatgttaaagactgaaattattaaaacttctagaggaaaccataagagaaaatttttgtgaccttgggttrggtaaaagtttcttacatatgactctagaagcatgatccttagaagaaaaatttgataaattagatctgttcttcagaagacactattaagtgaatgaaa

SEQ ID NO: 73831 - DNA, 201 bp, Homo sapiens
ttaaaacatatatctgagtacttatgtgctaggcatctcctggggaatgaaggtcattatactagcagatacttgtattcaaggagatagtttaaggaagsaaatgcatttttcttaaatttcagtagaatagaggttatccccaattaacaggtactgggagtcagtgtgttgtattggaaatagtttaagacagaccca

SEQ ID NO: 73832 - DNA, 201 bp, Homo sapiens
aaatttgtcataaaattatataaaagaaatcgagcaattccaggcacagataaaaataatgtagccaatatttattgaggtcttactatgtgtcaggcacygtattctgtcagatattctacacattttaatctgaatactcatagcagttctataatgatcacttgacagtggaagaaacaacttagttaagtaacttgc

SEQ ID NO: 73833 - DNA, 201 bp, Homo sapiens
gcaatctaagttcttcaaaaagttgctaaatttaacaaaatattattttccttaaatgacctatttctttagtactagatgtagtgttttcttaaatctawatctttatcaggtccctaagaaattaaacttttgtctagcaattgagaaaatatttgactaaactattttgtcttcactgtgtcaagactcaagagttta

SEQ ID NO: 73834 - DNA, 201 bp, Homo sapiens
atgcatattcagtaattccagctactttgagaggaaacaagccagttgactatagagtcatagaattttagaaattaaagagatcttagtaggacatattyttgtttccattttaaatagatgagaaactggagattagaaatagcgagattatgggctgggcgcggtggctcacacctgtaatcccagccctgtgggagg

SEQ ID NO: 73835 - DNA, 201 bp, Homo sapiens
gtagatccatcaagagtacctggccagtagagtgatctcaagatagaaaaaagagattataactaaagataagttttgtttccaagaaaattttacccatyttagctgccttgcttgaacctcaaaagaaaaactgtaattctgatgaagcaaaagtttaaggaaatgctttcaagttatagacgaagtaagtgttgtgag

SEQ ID NO: 73836 - DNA, 201 bp, Homo sapiens
ttatatccttccacatgtttaaaatcatctctagatgctaatagtacctaatacaatataaatgctatgtaaatagttatgctgtattgttcaggaaatawtgacaagaaaaaagtctgtacatgttcagtaaagaagaaatttttttctgaatattttctattcatggttggttaaatccacagatgtggaacctgcaga

SEQ ID NO: 73837 - DNA, 201 bp, Homo sapiens
tgtaggaaatgacaaactaattctaagattcgtatgagaatgtaaaggacctagaatagccaaaacaactttgaaaaataggaacaaaattggaggacttrcattacctgatttcaagacataatatatagccacagcagttaatactgtatgattggtgtaaagacagataaagtaatcaatgagacatagagaaagttt

SEQ ID NO: 73838 - DNA, 201 bp, Homo sapiens
acatgttcagtaaagaagaaatttttttctgaatattttctattcatggttggttaaatccacagatgtggaacctgcagatgttgagggccgactacackctaatggaagcctttctatagctcctgtgcaacttcaggcttccaatgtttgttttgttgctctccttgttctttttttttttttttttttttttttttt

SEQ ID NO: 73839 - DNA, 201 bp, Homo sapiens
gaacctgcagatgttgagggccgactacactctaatggaagcctttctatagctcctgtgcaacttcaggcttccaatgtttgttttgttgctctccttgktctttttttttttttttttttttttttttttgagagggagtctcactctgtcacccaggctggagtgcagtggcgcgatctcggctcactgcaagctccg

SEQ ID NO: 73840 - DNA, 201 bp, Homo sapiens
ttcaatcttagaagtgtgatattaaagggagtcttacctaaaaaccatcttgggaaatcttttcttttaaaaacaagattcaaaattggtacaaaaatcaytggaacctctcatttttagcagaagttgcactgatttcatctggttctttgttgcacaagctaggacaatcagattgtggtcattggtacctttgttaat

SEQ ID NO: 73841 - DNA, 201 bp, Homo sapiens
attagcatacatggtgagaaaagagagaattcttattttttctctttttttctagaaatcattgccagatgtcacatgaagaatcttttaattaagtgatytgatgacttagtatgaattagtatagttttagttttaatgaaatgtgaattcttctttcattaactggtataaccagaaatacgtagagttgcacatgca

SEQ ID NO: 73842 - DNA, 201 bp, Homo sapiens
agagagaattcttattttttctctttttttctagaaatcattgccagatgtcacatgaagaatcttttaattaagtgatttgatgacttagtatgaattastatagttttagttttaatgaaatgtgaattcttctttcattaactggtataaccagaaatacgtagagttgcacatgcatttaaatctacacacacacac

SEQ ID NO: 73843 - DNA, 201 bp, Homo sapiens
gttttcagaattttaagtgggttgtttattattgttgagaggtaagagcttttaatccattctgaatacaatttctttcacagatatacatattatgaatwttttcttggagtctgaggcttatctgttcatttattaatggtgtcttttgaacaacagaaatatttgattttgatgaagcccagtttatcaattctttct

SEQ ID NO: 73844 - DNA, 201 bp, Homo sapiens
ccagtttatcaattctttctttgataattcttttttgttccaagaatcctttgtctgtcccaagatcatagattttttcctctattttcttttaaaaattytcattttaggttttatatttaggtttatgatccatttcaagtacatttttatataatatatgtttatttttttccatagggaatattcatttattccagc

SEQ ID NO: 73845 - DNA, 201 bp, Homo sapiens
ccagctactcaggaggctgaggcaggagaatggtgtgaacccgggaggcagagcttgcagtgagccgggagagagagcgagactccatctccagaaaaaamaaaaacaaaaacaaaaacaaacaaacaaacaaacaaaactgtaaggaaaggtcagagtcagagcttggaatgccagattggatactttttacttaacacg

SEQ ID NO: 73846 - DNA, 201 bp, Homo sapiens
tttcttctgattcagtgccccatttacagtgataatcagtcaaatgaacagacaggagccactgtatattatttgggactctctttctgggtcagattatrcactctggatttcagtcatcatttccatggcatgatttccaaatgtggctgtagccttggcctttccttctcaactttggatcatttctgtttgctgggc

SEQ ID NO: 73847 - DNA, 201 bp, Homo sapiens
acttgaatgcctgggcctgagctggagtgatcttcctctcttagtctcttgactagctgggactataggcgcagtaccccacaccgggcaatacttggttyatttatactgattatgactaaagtcagcagaacaaaacaacatgttcacagccccaagaaattcccaggcatgcaagttaagaactcccattttaatgca

SEQ ID NO: 73848 - DNA, 201 bp, Homo sapiens
atccttgccaacatttggcacgttgagtccttataattttagttattttagtgaatgtgtagtgatatctcattgtggttgtaatgtaattttacctaacrattaaaattttgttgagcattttaagatgtatttatttgccatttttatattttctttggtgaggtgttcaaatcttttgtctgctttttattggatgtt

SEQ ID NO: 73849 - DNA, 201 bp, Homo sapiens
tgattctatttccttagtagacattagataatgtagatcttctgtttcttctgttgtcaattttggtaagttgcttcccttccaccccagtttacatgttrtttaaactgacaaatctgttggcatgaagttatttataatattctattatccttttaattatggcattaatctatgatgataaccattttattcttgtgt

SEQ ID NO: 73850 - DNA, 201 bp, Homo sapiens
gtctttgcttactggccatctttatctcttatttgataaagtttgttttcagaattttaagtgggttgtttattattgttgagaggtaagagcttttaatycattctgaatacaatttctttcacagatatacatattatgaattttttcttggagtctgaggcttatctgttcatttattaatggtgtcttttgaacaac

SEQ ID NO: 73851 - DNA, 201 bp, Homo sapiens
gaatagaatggctgatttgtatggcatgcttaacttaaaaataaaataaaactaaatttaaaaaaatggccgggtgtggtagctcatgcctgtaatcctarcacttttgggaggccgaggcagacggatcacgaggtcaggagatcaagaccatcccggctaacatggtgaaaccccatctctactaaaaaatacaaaaaa

SEQ ID NO: 73852 - DNA, 201 bp, Homo sapiens
aataggaaaagttccccagaccgctcgcagggcgtgcagtgggggagtggcgtgcttctttggtgccccactgctcaaacctctagggggagcatgcagaygggcaggttgtggggctctgaccccatggcagtgtctagaggtagatgtttagagctcccgaagtcccagtgggcatgtgttacagggtgctctttcagt

SEQ ID NO: 73853 - DNA, 201 bp, Homo sapiens
atgcctgtagacttggtcttcttaaggttaaaaactttcaaaagttaaaattgaccctggcatgattgtataaagattgattgtaagtacaatgtagaatkgggcagaactttagttttctgacttagtcttccccctagtgcagaagtcttctatttgaacctccatttgcaaaataagttgctgagaaatgattggttg

SEQ ID NO: 73854 - DNA, 201 bp, Homo sapiens
gcgatctcggctcactgcaagctccgcctcccaggttcatgccattctcctgcctcagcctcccaagtagctgggactacaggtgcccaccaccacgcccrgctaattttttgtatttttagtagagacggggtttcaccgtgttagccaggatggtctcgatctcctgacctcgtgatccgcctgcctcggcctcccaaa

SEQ ID NO: 73855 - DNA, 201 bp, Homo sapiens
ttatatgcatttggtatttgaaatatgcctgtagacttggtcttcttaaggttaaaaactttcaaaagttaaaattgaccctggcatgattgtataaagaytgattgtaagtacaatgtagaattgggcagaactttagttttctgacttagtcttccccctagtgcagaagtcttctatttgaacctccatttgcaaaat

SEQ ID NO: 73856 - DNA, 201 bp, Homo sapiens
agacagccaaacatttaatcactcccatttcaaatgataaaatctgtgtttctgtgcatattattttaaattcattgtattcagattttgttatgacttaytggtactcctggttagcacctttgtcaattccacctcacttctgtgagtgtctactttccagtgatgaaatgctgacagcatctcgggtaactgctttat

SEQ ID NO: 73857 - DNA, 201 bp, Homo sapiens
aagacaaatagtaaattgagagaatattttcagagcagatataaaatttctacagaagggaactaaggattattaggccccatgatggcttgtctcattcrtatatagctaaaagactttttaaaacttcaaaagctacattatgtttctgaaaattcagaaaagattggcactgggagttactagaaattagttagatta

SEQ ID NO: 73858 - DNA, 201 bp, Homo sapiens
aatagagtattgtgtgcttgtgacttgatgtaaaaatgctgaagaataaggcaaatgagaagggctttatgggggtaactccagtaataatgacttttatygatagtctaatatataatgtagacagccaaacatttaatcactcccatttcaaatgataaaatctgtgtttctgtgcatattattttaaattcattgtat

SEQ ID NO: 73859 - DNA, 201 bp, Homo sapiens
atatatcttgcatgaataaatgaactctcaggctatctaaaacttgatttttgttttatgtttctgttattcttagttattaacttcactcaagagtaaayactattttattgtagaatgaaactttgctacctgttgcccaaagtgaaatctactctgaagattcctgctgataagcatctacttcagcagttagaaatg

SEQ ID NO: 73860 - DNA, 201 bp, Homo sapiens
taatagacactccatgaatatatcttgcatgaataaatgaactctcaggctatctaaaacttgatttttgttttatgtttctgttattcttagttattaamttcactcaagagtaaatactattttattgtagaatgaaactttgctacctgttgcccaaagtgaaatctactctgaagattcctgctgataagcatctac

SEQ ID NO: 73861 - DNA, 201 bp, Homo sapiens
tttctgcttattatcttatctccttatatatgttgatattattgattatgtgcttggtcttgtatttgacaaattatttgtagaaatagtttgaggcctargatgatatctttctcatggaaggaatatattttcttctggcagacacctaactgcactagcaatagagtcttacttaacctgatttcaggtactggatga

SEQ ID NO: 73862 - DNA, 201 bp, Homo sapiens
atgaatgtttgacacataatagacactccatgaatatatcttgcatgaataaatgaactctcaggctatctaaaacttgatttttgttttatgtttctgtyattcttagttattaacttcactcaagagtaaatactattttattgtagaatgaaactttgctacctgttgcccaaagtgaaatctactctgaagattcct

SEQ ID NO: 73863 - DNA, 201 bp, Homo sapiens
acttaagtactttccaaagaatagaaaatgtctgtgatgagaaaatgttataaattaaagggtattattgtcacatgtgactctgttatgttagtttatayagaataacttatatatggcaaaggcattataaccttagggaatcaacaggaaacatttaaatggctcccactaatgtctgaaatctattttttttctatg

SEQ ID NO: 73864 - DNA, 201 bp, Homo sapiens; identical to SEQ ID NO: 35081

SEQ ID NO: 73865 - DNA, 201 bp, Homo sapiens; identical to SEQ ID NO: 35268

SEQ ID NO: 73866 - DNA, 201 bp, Homo sapiens; identical to SEQ ID NO: 35269

SEQ ID NO: 73867 - DNA, 201 bp, Homo sapiens; identical to SEQ ID NO: 35270

SEQ ID NO: 73868 - DNA, 201 bp, Homo sapiens; identical to SEQ ID NO: 35409

SEQ ID NO: 73869 - DNA, 201 bp, Homo sapiens; identical to SEQ ID NO: 35109

SEQ ID NO: 73870 - DNA, 201 bp, Homo sapiens; identical to SEQ ID NO: 35272

SEQ ID NO: 73871 - DNA, 201 bp, Homo sapiens; identical to SEQ ID NO: 35274

SEQ ID NO: 73872 - DNA, 201 bp, Homo sapiens; identical to SEQ ID NO: 35226

SEQ ID NO: 73873 - DNA, 201 bp, Homo sapiens; identical to SEQ ID NO: 35276

SEQ ID NO: 73874 - DNA, 201 bp, Homo sapiens; identical to SEQ ID NO: 35228

SEQ ID NO: 73875 - DNA, 201 bp, Homo sapiens; identical to SEQ ID NO: 35278

SEQ ID NO: 73876 - DNA, 201 bp, Homo sapiens; identical to SEQ ID NO: 35280

SEQ ID NO: 73877 - DNA, 201 bp, Homo sapiens; identical to SEQ ID NO: 35282

SEQ ID NO: 73878 - DNA, 201 bp, Homo sapiens; identical to SEQ ID NO: 35284

SEQ ID NO: 73879 - DNA, 201 bp, Homo sapiens; identical to SEQ ID NO: 35173

SEQ ID NO: 73880 - DNA, 201 bp, Homo sapiens; identical to SEQ ID NO: 35145

SEQ ID NO: 73881 - DNA, 201 bp, Homo sapiens; identical to SEQ ID NO: 35612

SEQ ID NO: 73882 - DNA, 201 bp, Homo sapiens; identical to SEQ ID NO: 35615

SEQ ID NO: 73883 - DNA, 201 bp, Homo sapiens; identical to SEQ ID NO: 35237

SEQ ID NO: 73884 - DNA, 201 bp, Homo sapiens; identical to SEQ ID NO: 35239

SEQ ID NO: 73885 - DNA, 201 bp, Homo sapiens; identical to SEQ ID NO: 35242

SEQ ID NO: 73886 - DNA, 201 bp, Homo sapiens; identical to SEQ ID NO: 35245

SEQ ID NO: 73887 - DNA, 201 bp, Homo sapiens; identical to SEQ ID NO: 35298

SEQ ID NO: 73888 - DNA, 201 bp, Homo sapiens; identical to SEQ ID NO: 35447

SEQ ID NO: 73889 - DNA, 201 bp, Homo sapiens; identical to SEQ ID NO: 35249

SEQ ID NO: 73890 - DNA, 201 bp, Homo sapiens; identical to SEQ ID NO: 35252

SEQ ID NO: 73891 - DNA, 201 bp, Homo sapiens; identical to SEQ ID NO: 35160

SEQ ID NO: 73892 - DNA, 201 bp, Homo sapiens; identical to SEQ ID NO: 35254

SEQ ID NO: 73893 - DNA, 201 bp, Homo sapiens; identical to SEQ ID NO: 35369

SEQ ID NO: 73894 - DNA, 201 bp, Homo sapiens; identical to SEQ ID NO: 35256

SEQ ID NO: 73895 - DNA, 201 bp, Homo sapiens; identical to SEQ ID NO: 35370

SEQ ID NO: 73896 - DNA, 201 bp, Homo sapiens; identical to SEQ ID NO: 35258

SEQ ID NO: 73897 - DNA, 201 bp, Homo sapiens; identical to SEQ ID NO: 35151

SEQ ID NO: 73898 - DNA, 201 bp, Homo sapiens; identical to SEQ ID NO: 35260

SEQ ID NO: 73899 - DNA, 201 bp, Homo sapiens; identical to SEQ ID NO: 35090

SEQ ID NO: 73900 - DNA, 201 bp, Homo sapiens; identical to SEQ ID NO: 35091

SEQ ID NO: 73901 - DNA, 201 bp, Homo sapiens; identical to SEQ ID NO: 35393

SEQ ID NO: 73902 - DNA, 201 bp, Homo sapiens; identical to SEQ ID NO: 35396

SEQ ID NO: 73903 - DNA, 201 bp, Homo sapiens; identical to SEQ ID NO: 35644

SEQ ID NO: 73904 - DNA, 201 bp, Homo sapiens; identical to SEQ ID NO: 35399

SEQ ID NO: 73905 - DNA, 201 bp, Homo sapiens; identical to SEQ ID NO: 35646

SEQ ID NO: 73906 - DNA, 201 bp, Homo sapiens; identical to SEQ ID NO: 35649

SEQ ID NO: 73907 - DNA, 201 bp, Homo sapiens; identical to SEQ ID NO: 35651

SEQ ID NO: 73908 - DNA, 201 bp, Homo sapiens; identical to SEQ ID NO: 35653

SEQ ID NO: 73909 - DNA, 201 bp, Homo sapiens; identical to SEQ ID NO: 35162

SEQ ID NO: 73910 - DNA, 201 bp, Homo sapiens
aggaaggcgactttctgtttctccccctctgcgccccgtcccccactacctacggtactctgagagagaaatcgtccacttaaaatacgtgggttcacatrtactgaacacacgtaagggatatttcgattcccacggttttatgtggtttctggagtcttctcgctattgtttgtatgtatatttgcttatttttctaga

SEQ ID NO: 73911 - DNA, 201 bp, Homo sapiens
cccgccgggccctcccggggagcgcgcccgccctcgccgccgcggctcccgccccccgcgcagccgtcgcgctccatcgtggccccggccgctccggcccsgctgcccggccgcgcctttaataggccccgcgccgcccgccccgccccgcccctccccgccgcgcccgcccctcgcggtcagatccttggctccccgccc

SEQ ID NO: 73912 - DNA, 201 bp, Homo sapiens
ttaaaagcattttgttcctgacagctgcctcacccactatcttcatgttcctggaatgtgtgatacaaagaacaatgtatagccaaccaatagctcgttaktgtaacatgaatgcttgataaacaacttaggaactgcctcttcctttttcctttaaaaacccatttgtaactgctgctaataggagcatctactcagggc

SEQ ID NO: 73913 - DNA, 201 bp, Homo sapiens
atgtattcataagtatagcagaaggtcacaaacaacacaaaaaaaatgcttttgaggagctaactggagaaatgtattgcaatgtagttgagaattacatsactgtaaaatcacaccaagaaacaagaaggatatttaaatacatctccaagtcaacacatctcggtggaagtctacacttcagttcaaaacttcatttac

SEQ ID NO: 73914 - DNA, 201 bp, Homo sapiens
aatttttgtatcttttgtagagatgggtttcatcatgttgcccaggctggtctcaaactcctgggctcaagcaatggaaccgcctcaacttcccaaagtgmtgagataataggtatgagtcaccgcaccaggtctatttggtaacatttgtatgttaatgtctcacagtgttccatcaaaagatatgaagtaagaattctt

SEQ ID NO: 73915 - DNA, 201 bp, Homo sapiens
aaaactagacctttgctgatatctgttgtggatgtataagtaaatgagcaagaaaaatttaaaacctgaattttgcaattggaaaacctgtaaaggtttayaggcatgtagaaatggttttacacaagagttacacactgattccatatacaattatcgactacctcatcgtgtgtgaaacacctcaaggtattaatacta

SEQ ID NO: 73916 - DNA, 201 bp, Homo sapiens
aattgaccagcattaatgttacaatagaaataagaccgcgaaaacgtctctgtggcaataagacaccaagttataaacaagaccttaagggtatgcaaggrgagggttaagtcatgtctgcacacccatcaattttgctacatagcatcatgcttaacttacaacatcccttttttttttttgagacagagtcttgctctg

SEQ ID NO: 73917 - DNA, 201 bp, Homo sapiens
gtagccctcttgcacaaataactcacaatcttcctgcactcagctatcatcagaccctcgggtgattaaaaaaaaatgcaagctaattcactgcaacctcrgtgttatcagtactgcacaaagccctcttcagcacacagcacaagcaccattctagaacatccccagcaagccttcgtctccttgcagtcagctcctctc

SEQ ID NO: 73918 - DNA, 201 bp, Homo sapiens
ctgcagctttatgaaaagtgtgctgaggtttaatctgaaaacaaaaggaattctataattgcagctcctttctagaagacatatcccagagctctttgacsacaattgtcaggatgcttttggggccttttccatttggaagcccattatttggggaagtttttggggggggggcggggttgggggaaaaaggtattgaag

SEQ ID NO: 73919 - DNA, 201 bp, Homo sapiens
aagaactctttcactgaaacatgaaagtagtcttcagtgaccaccacccatacgcaagccctttacacatacacagatacacagatatatgtattcataartatagcagaaggtcacaaacaacacaaaaaaaatgcttttgaggagctaactggagaaatgtattgcaatgtagttgagaattacatgactgtaaaatca

SEQ ID NO: 73920 - DNA, 201 bp, Homo sapiens
cagcttgagctattataaataatgcttctatgaacattcatgtacatgtctttgtgtgaatctgcattttcatttcccttgggtagataactgggagtttmattgttaagtcatatgcaaagcgtatatttaaatttttgagaaacagagaaactgtttcccaatgtggctgtaccattgtacattcctgccagcaacatg

SEQ ID NO: 73921 - DNA, 201 bp, Homo sapiens
caaagtgctgagataataggtatgagtcaccgcaccaggtctatttggtaacatttgtatgttaatgtctcacagtgttccatcaaaagatatgaagtaaraattctttccaattcaatagatgcaaaagaccccaattaatggataaaaaaggtccataatagtcctacttgtggaagtaagtcctaggacacttccatg

SEQ ID NO: 73922 - DNA, 201 bp, Homo sapiens
cctgggttgcagtcctcaaacttgagccaaacggactctctacatatatatagatatagatatagatatagatatagatatagatatagatatagatatakatatatagatatagatatagatatatgtttttttaaagaactctttcactgaaacatgaaagtagtcttcagtgaccaccacccatacgcaagcccttta

SEQ ID NO: 73923 - DNA, 201 bp, Homo sapiens
gcagctcctttctagaagacatatcccagagctctttgacgacaattgtcaggatgcttttggggccttttccatttggaagcccattatttggggaagtytttggggggggggcggggttgggggaaaaaggtattgaagtagggaagggaaagaagaatacgagtttgcactttcagttcagtagctaaatagcaattt

SEQ ID NO: 73924 - DNA, 201 bp, Homo sapiens
tgggttgcagtcctcaaacttgagccaaacggactctctacatatatatagatatagatatagatatagatatagatatagatatagatatagatatagakatatagatatagatatagatatatgtttttttaaagaactctttcactgaaacatgaaagtagtcttcagtgaccaccacccatacgcaagccctttaca

SEQ ID NO: 73925 - DNA, 201 bp, Homo sapiens
gtaagtgaatgacctgaaatcccgctgctctgtccccttatttttcaatccaatccctgaattgttgcctaccaattcagccttggaacctcactaagttyttaagtgatagtacttctgcccatctcattccctctgacatgggacaagactatccggaaatgagccttcccagcaatgtgggacaaacttacatccaaa

SEQ ID NO: 73926 - DNA, 201 bp, Homo sapiens
gccctcccggggagcgcgcccgccctcgccgccgcggctcccgccccccgcgcagccgtcgcgctccatcgtggccccggccgctccggccccgctgcccsgccgcgcctttaataggccccgcgccgcccgccccgccccgcccctccccgccgcgcccgcccctcgcggtcagatccttggctccccgccctacacccg

SEQ ID NO: 73927 - DNA, 201 bp, Homo sapiens
tcccgccccccgcgcagccgtcgcgctccatcgtggccccggccgctccggccccgctgcccggccgcgcctttaataggccccgcgccgcccgccccgcyccgcccctccccgccgcgcccgcccctcgcggtcagatccttggctccccgccctacacccggctctcgcagtcagggcaaagcgactcaacgccccgga

SEQ ID NO: 73928 - DNA, 201 bp, Homo sapiens
ggatgaaggagactacgaaccagctctcctgaaaagttgtaaactaaaaataaaatccaaagccctcgaccaactgagtggacccactctctgccaaggaraccccagagaaacctcaaaaactgagctctcagtcaaaataggaagagaggtcaaacgcacttaattctactccctcccttttggagttgaggcgtaaca

SEQ ID NO: 73929 - DNA, 201 bp, Homo sapiens
ttgcagtcctcaaacttgagccaaacggactctctacatatatatagatatagatatagatatagatatagatatagatatagatatagatatagatatakagatatagatatagatatatgtttttttaaagaactctttcactgaaacatgaaagtagtcttcagtgaccaccacccatacgcaagccctttacacata

SEQ ID NO: 73930 - DNA, 201 bp, Homo sapiens
cagccgtcgcgctccatcgtggccccggccgctccggccccgctgcccggccgcgcctttaataggccccgcgccgcccgccccgccccgcccctccccgmcgcgcccgcccctcgcggtcagatccttggctccccgccctacacccggctctcgcagtcagggcaaagcgactcaacgccccggattatttggcttcct

SEQ ID NO: 73931 - DNA, 201 bp, Homo sapiens
tcgagtatttctaaggatgaccgttttgaacagcctgctttcacaggcatccataattcaagtgagagtgaaccatcctgccctggcaaggtacctggcargggcggctgtgtagggcacttgcaaaggctgcggaggagagcgcgcgggcgaagaagcactcccggaccatgcctctctccggtgcccggtgctgactgc

SEQ ID NO: 73932 - DNA, 201 bp, Homo sapiens
ataaagggtctcaccgtgtcacccaagctgaagtgcagtggcacaatcacagttcactgcagccttaactttccctggctcagctgaacctcccatgtcakcctcccaagtagctgggacatagacgcatgctaccatacccagctaatttttgtatcttttgtagagatgggtttcatcatgttgcccaggctggtctca

SEQ ID NO: 73933 - DNA, 201 bp, Homo sapiens
attttacagagtttggtttttccattaacaaggtgatactcttcactattgtcaaggccttataagtttctcactgaaaattctaaattaattaaggattmttttaacagcaagctcttaggagacaaaaacatcaaagatcatggtctccaacctggaagattttgtttaatagaaaataccatcaaataaaggactcct

SEQ ID NO: 73934 - DNA, 201 bp, Homo sapiens
taaaagccaaacaaaatgtagcacatctgcaggacagacctggcacacacgtcaccaggatgtggcctctgcctaatgctcatgcctcatctgtgccaggygggacttaatatgggtaattataaaaacccaattggaagtctaaaatcggaagaataaaaatgagccaaggccgggcacggtggctcacgcctgtaatct

SEQ ID NO: 73935 - DNA, 201 bp, Homo sapiens
catcgtggccccggccgctccggccccgctgcccggccgcgcctttaataggccccgcgccgcccgccccgccccgcccctccccgccgcgcccgcccctygcggtcagatccttggctccccgccctacacccggctctcgcagtcagggcaaagcgactcaacgccccggattatttggcttcctgtctgatttcgggc

SEQ ID NO: 73936 - DNA, 201 bp, Homo sapiens
gtaacaaaacgaatagagagaattcagaagtgtaagatccaaaggagagtaatagaacctgggaaaatggaaaacgcatgtaccatccaaagagagtgtgsggttctaattagggaaaaggagtcaggatggcgggaccgagggaaagcaaaaatataaagcagataagctgtaagtctgccttgctttgtggtccagaac

SEQ ID NO: 73937 - DNA, 201 bp, Homo sapiens
cagctcctttctagaagacatatcccagagctctttgacgacaattgtcaggatgcttttggggccttttccatttggaagcccattatttggggaagttyttggggggggggcggggttgggggaaaaaggtattgaagtagggaagggaaagaagaatacgagtttgcactttcagttcagtagctaaatagcaatttc

SEQ ID NO: 73938 - DNA, 201 bp, Homo sapiens
ataaaaacccaattggaagtctaaaatcggaagaataaaaatgagccaaggccgggcacggtggctcacgcctgtaatctcagcattttgggaggctgacrcgggtggttcacttgaggtcaggtgtctgagaccaacctggccaacatgatgaaaaccagtctccactaaaaatacaaaaattagcagggcatggtggca

SEQ ID NO: 73939 - DNA, 201 bp, Homo sapiens
ctcctttctagaagacatatcccagagctctttgacgacaattgtcaggatgcttttggggccttttccatttggaagcccattatttggggaagtttttggggggggggcggggttgggggaaaaaggtattgaagtagggaagggaaagaagaatacgagtttgcactttcagttcagtagctaaatagcaatttcaac

SEQ ID NO: 73940 - DNA, 201 bp, Homo sapiens
agacaccgcctccccactagctcatctataaaaacccctgcatttcaccacgtattgcaacccattttttgggacccctctctgtagcagagctattctcytccttttgcctattaaaaattctgctccaaacctcaccctttgtgtgtgtccacatatttgatctttgtggccgtgagaccaagaacctcggatgtcacc

SEQ ID NO: 73941 - DNA, 201 bp, Homo sapiens
gcagtcctcaaacttgagccaaacggactctctacatatatatagatatagatatagatatagatatagatatagatatagatatagatatagatatatakatatagatatagatatatgtttttttaaagaactctttcactgaaacatgaaagtagtcttcagtgaccaccacccatacgcaagccctttacacataca

SEQ ID NO: 73942 - DNA, 201 bp, Homo sapiens; identical to SEQ ID NO: 37150

SEQ ID NO: 73943 - DNA, 201 bp, Homo sapiens; identical to SEQ ID NO: 37151

SEQ ID NO: 73944 - DNA, 201 bp, Homo sapiens; identical to SEQ ID NO: 37153

SEQ ID NO: 73945 - DNA, 201 bp, Homo sapiens; identical to SEQ ID NO: 37155

SEQ ID NO: 73946 - DNA, 201 bp, Homo sapiens
caggaatattcattcagctggatgtatcatgctgttcttaatttcttaactggtgtaaatcgaggtgtgataaacatgtgtctgctaaaactttttctgtrtttatgatgatttccttaatatctattttcaggtgtggaattactgggtcaaagattctgatcattaaaaatattttaagatgcgtggctacgttgcttt

SEQ ID NO: 73947 - DNA, 201 bp, Homo sapiens
tggctggtcacagggcccgtagttttgaaccaggaggcagggggagtgggtggggttgaggggggagtgtggctgctgctgagacccagcgcccaggaggrcgggagatgaggcacggtggggaggtggcttccggggcccctggcagggtcctgggccatgtcctgccctggcccaggaggtaacctgacttcccagaac

SEQ ID NO: 73948 - DNA, 201 bp, Homo sapiens
gcaagggaaagggactaggcctgaggtcacccagcagggccgtgtccctggatgcagggttgtatgcactcctgcggcccatggctacgtgcagcactgtrggctgcctgggctggggctgtggctggacagcagtgctacctgtcccgagccaggggcacccgctgctgaggccccatcacactgctcttcctgtgctct

SEQ ID NO: 73949 - DNA, 201 bp, Homo sapiens; identical to SEQ ID NO: 37034

SEQ ID NO: 73950 - DNA, 201 bp, Homo sapiens; identical to SEQ ID NO: 37156

SEQ ID NO: 73951 - DNA, 201 bp, Homo sapiens; identical to SEQ ID NO: 37157

SEQ ID NO: 73952 - DNA, 201 bp, Homo sapiens; identical to SEQ ID NO: 37036

SEQ ID NO: 73953 - DNA, 201 bp, Homo sapiens
tggcccagttagcccaggaattgctgctggcctggaaattccagccaggatggagaatcagccccggggacgcttaagccccagtggaccctgccaccagstgacgccaaactgcagcaaggtctgggccgaccccgcagaccccgcagcctgcagccctcccatgatgagaccctgtgttccatgtggttgaattccagg

SEQ ID NO: 73954 - DNA, 201 bp, Homo sapiens
tttttaaaatttctatatgtttttagagacagggtcctgctctgtcaccaggatggagcgcagtggtgagatcgtggccactgcagtctcacactcctggrcttaagtgatcctcccgccttggcctcgtgttgggattttgccagtattttattttaaaacacttaagcttatcttaaaaacattctgagaacaggtgaa

SEQ ID NO: 73955 - DNA, 201 bp, Homo sapiens; identical to SEQ ID NO: 37169

SEQ ID NO: 73956 - DNA, 201 bp, Homo sapiens; identical to SEQ ID NO: 37040

SEQ ID NO: 73957 - DNA, 201 bp, Homo sapiens
tcacccatcccttaacacccaagacagcctgcccctctgagccaccaccacacctacccatgatgaagagcatggtggccagcaggggcaccagggtgagrtagccagcgggtgctgccaggggctgcgccaagtccccccaggactcgctttccaggcccgcagtgctgttggggctcagaggcctggggccaaagtgga

SEQ ID NO: 73958 - DNA, 201 bp, Homo sapiens
ggctgcctgcagggtgcttacctgagacgaagagcagcaccttgcggcctgcgaggtccatggtgagggcggcgatcagcacggacaggagccgcacggcyccaacgatggctgcgtcgtccttggggggctatcggggggagaccaccagggctgagggacctgcctgctgttcccatccccctccaggacccagcttgt

SEQ ID NO: 73959 - DNA, 201 bp, Homo sapiens
tcggacaagctttgatcccctctccgcggtggagattccgagtaacttgcccgcgaagctagtaggtcctggatgggaagccagattctctgtcacaggcwctttctggccagtttttctcacagtgagggcactggaccatctcgttactgtttagctctttttgggatcacagaccccttcaaaaatctgatgaaagct

SEQ ID NO: 73960 - DNA, 201 bp, Homo sapiens
ctctgccctgtggcctcagcccgctggcctctctgaccgtgaggctggctctcagccatcgggcaggtgcctggtcgggcctggcttagcccaggtggggyttggcagaagcgggcgggtgtggaagatattccatctggggccaaccccaggctgggcctgcgctgagcttctggagcgcaggtactgggtcttgctaag

SEQ ID NO: 73961 - DNA, 201 bp, Homo sapiens
atggctggtgggagccccttcccctcccaggtctgcaccgggcattgtactcagttgccaccctctctcctgcagagcccagactgaggctggttccttcrcagcccagcatcccagggagcctgggccattctcagaggggacaagacaggcctttgccaccccagcagttgtctctggggaaatcagaatgcctgcagg

SEQ ID NO: 73962 - DNA, 201 bp, Homo sapiens
cgaggcagaggtcccagtaactcattggtgcctccagggctcagctcgagtgggtgaagacagaggacttacaacacttctgcgtggcccagtcttgcccygtcacggcctgcagcaaggatagcaaaaacatggctggtgggagccccttcccctcccaggtctgcaccgggcattgtactcagttgccaccctctctcc

SEQ ID NO: 73963 - DNA, 201 bp, Homo sapiens
catctcctacaggaagcctaccctgattgccccaggcagggtggggctgcagggattgctcagcccctggcacatagtgggaagtccttggaaagtcttakggccagggcaggatgaggaaggggtaggttgggcaggcaaggccctaggcctccacccaagacctccacgccccctcaactgagcagctgcacgcactgt

SEQ ID NO: 73964 - DNA, 201 bp, Homo sapiens
gtgtccactcggagccccagcggacctttctggaccactggcctgggccagggccctgccgatgctagggaggcaggtgctctgcagttcccagccacacmgccccaccccgaggcaggcctgcacacccagcccagccctgacccatgcggaggagtggggcaggagggctgcctgcagggtgcttacctgagacgaaga

SEQ ID NO: 73965 - DNA, 201 bp, Homo sapiens; identical to SEQ ID NO: 37193

SEQ ID NO: 73966 - DNA, 201 bp, Homo sapiens; identical to SEQ ID NO: 37067

SEQ ID NO: 73967 - DNA, 201 bp, Homo sapiens; identical to SEQ ID NO: 37069

SEQ ID NO: 73968 - DNA, 201 bp, Homo sapiens
ggcattgtactcagttgccaccctctctcctgcagagcccagactgaggctggttccttcgcagcccagcatcccagggagcctgggccattctcagaggrgacaagacaggcctttgccaccccagcagttgtctctggggaaatcagaatgcctgcaggtcacacctgggtcacagggcaggaaccgggcagtggtcag

SEQ ID NO: 73969 - DNA, 201 bp, Homo sapiens
cgtggcccagtcttgccccgtcacggcctgcagcaaggatagcaaaaacatggctggtgggagccccttcccctcccaggtctgcaccgggcattgtactyagttgccaccctctctcctgcagagcccagactgaggctggttccttcgcagcccagcatcccagggagcctgggccattctcagaggggacaagacagg

SEQ ID NO: 73970 - DNA, 201 bp, Homo sapiens; identical to SEQ ID NO: 37072

SEQ ID NO: 73971 - DNA, 201 bp, Homo sapiens
ccggccggggctgggctctcaccagcaggacagcggtgctgtcgaagatggactgcaggtagaccaggatgggcgtgatgcccgtcagctgctgcaggagrcgcatcagcaaggccacggtgatgggccggcacacgtggggggcccgtgcctcagcccacgatactcggctgctctgaaacacaaggccgccgctgaggg

SEQ ID NO: 73972 - DNA, 201 bp, Homo sapiens
actcggctgctctgaaacacaaggccgccgctgagggcgttgggccagcctctccagcaggcgccatcctgccctggaccgccaggggttgtgtgggagamctcctttttccctcctccaggaaagaaccagcttaccaggccacccaggctctgggaacagccccccaccccaacccaggcacttggattagtgggaact

SEQ ID NO: 73973 - DNA, 201 bp, Homo sapiens; identical to SEQ ID NO: 37082

SEQ ID NO: 73974 - DNA, 201 bp, Homo sapiens
tttatctatttgttatctaagagggaaaaatattttcccacgtgtttccattgcattttctgatatgaaaattttcgagtttactttttaacctgtgggawcctcagtgttctgcttagcaagttcagtgtgttttctgtattaaagatttcatgatccttggttgtatttcctgcaactatttttccaggctcttgtttg

SEQ ID NO: 73975 - DNA, 201 bp, Homo sapiens
cctcctccaggaaagaaccagcttaccaggccacccaggctctgggaacagccccccaccccaacccaggcacttggattagtgggaactactgtggtccygtcttccaggaaaagcctccacggccacacacagctgaagtgctggaggtgggcctgcccggttcgggcgcacaccctcctgcacctgtctccggacgtt

SEQ ID NO: 73976 - DNA, 201 bp, Homo sapiens
agtggggagagcaggctctccctggcaccgagggtgcccaccctctccctggtgtggccccgtcaacatcagccacagcccagccccattagtgggttagygggtctgacctcagccccactcaggtgctcctgctggcctgcccaagccctgccctcagggagcttctgccttttaagaactgggcagaggccacagtca

SEQ ID NO: 73977 - DNA, 201 bp, Homo sapiens
tgtcgaagatggactgcaggtagaccaggatgggcgtgatgcccgtcagctgctgcaggaggcgcatcagcaaggccacggtgatgggccggcacacgtgkggggcccgtgcctcagcccacgatactcggctgctctgaaacacaaggccgccgctgagggcgttgggccagcctctccagcaggcgccatcctgccctg

SEQ ID NO: 73978 - DNA, 201 bp, Homo sapiens
ggggcgtgctgtccagcaggggccctgccttgcaaggaacgtctcttccggcggctgggccgctcctgcctggtctgggctgtgtgtggcgccctttcctycttgtttgttcctctgtgttctgtgtgcgtcttaagcaataaagcgtggccgtggctcgcgtgcctgccctctgctcccttctgccttggtgcctgtgtg

SEQ ID NO: 73979 - DNA, 201 bp, Homo sapiens; identical to SEQ ID NO: 37085

SEQ ID NO: 73980 - DNA, 201 bp, Homo sapiens
gccttctgtggggcgtgtccttcacgcaagggaaagggactaggcctgaggtcacccagcagggccgtgtccctggatgcagggttgtatgcactcctgcrgcccatggctacgtgcagcactgtgggctgcctgggctggggctgtggctggacagcagtgctacctgtcccgagccaggggcacccgctgctgaggccc

SEQ ID NO: 73981 - DNA, 201 bp, Homo sapiens
tataaagctggtttcctttgtaatcccatgtattttatttaatttttaaaatttctatatgtttttagagacagggtcctgctctgtcaccaggatggagygcagtggtgagatcgtggccactgcagtctcacactcctgggcttaagtgatcctcccgccttggcctcgtgttgggattttgccagtattttattttaa

SEQ ID NO: 73982 - DNA, 201 bp, Homo sapiens
tcctctgctcctttctccagactggcttaagccaggagccactggctgctggtgtgagggtctgggctgctggacttgaggcagagcctgcagcagctgtstggacactacccagccctactcctctgctgggtgggtctgcagatctcacaccacagacagggctgcctgtgacctgctgtgacctgggagcagcttccc

SEQ ID NO: 73983 - DNA, 201 bp, Homo sapiens; identical to SEQ ID NO: 37207

SEQ ID NO: 73984 - DNA, 201 bp, Homo sapiens; identical to SEQ ID NO: 37208

SEQ ID NO: 73985 - DNA, 201 bp, Homo sapiens; identical to SEQ ID NO: 8061

SEQ ID NO: 73986 - DNA, 201 bp, Homo sapiens; identical to SEQ ID NO: 37090

SEQ ID NO: 73987 - DNA, 201 bp, Homo sapiens; identical to SEQ ID NO: 37092

SEQ ID NO: 73988 - DNA, 201 bp, Homo sapiens
gtgggggatgctccctgctggccctgggaaccttggacaggccacctcaaggcccctcggctgcccctcctccctgggcctgctggggcccctaggttctrcccatcaccccccgcccctgctggccttggtgctaaggaagtggggagagcaggctctccctggcaccgagggtgcccaccctctccctggtgtggcccc

SEQ ID NO: 73989 - DNA, 201 bp, Homo sapiens
ccagggcctgggacagcctgccgctgccagcaacctcccactgctgcctagggtgcagcgcccactgtcaccctgccttctgaagaagcccacagggctcytaaggtgcaccccggtacctggaactgcagccttggcagtgactggacagctgggtgggggatgctccctgctggccctgggaaccttggacaggccacc

SEQ ID NO: 73990 - DNA, 201 bp, Homo sapiens
ccagggtgcaggtttgtagccaacacagaggcccagccactgggggtttggccccctccaggcggggaccttgacctagcgcaagaaggaccttctccccrtgcggaagaaggactcgatctgctccagggaccgtcccttggtctcgggcacacagcagcctgtgaacaccaggctcaccaagcagatggccgcgaagaa

SEQ ID NO: 73991 - DNA, 201 bp, Homo sapiens; identical to SEQ ID NO: 37103

SEQ ID NO: 73992 - DNA, 201 bp, Homo sapiens; identical to SEQ ID NO: 37225

SEQ ID NO: 73993 - DNA, 201 bp, Homo sapiens
acacgcagtgtcatgtccttaggggttcaaaaaactgtattttaaaaatgctagacatcatagaaattcattcacaataatttggaatatagaacaatgtyactcgaagcccgctgcctgctaatcttctgatgtgtgtgcttcctgtctgcaggcattttttaaaagcctgcttttaacacagttataaccattatgaat

SEQ ID NO: 73994 - DNA, 201 bp, Homo sapiens
cagactttataacattctttcaatacaggaatattcattcagctggatgtatcatgctgttcttaatttcttaactggtgtaaatcgaggtgtgataaacatgtgtctgctaaaactttttctgtgtttatgatgatttccttaatatctattttcaggtgtggaattactgggtcaaagattctgatcattaaaaatatt

SEQ ID NO: 73995 - DNA, 201 bp, Homo sapiens; identical to SEQ ID NO: 37125

SEQ ID NO: 73996 - DNA, 201 bp, Homo sapiens
gggatgagggcaggagggtgagggaggtggcattccttatggcactggcactgggggccgccctcatcctcctgggattgtcagtcgctgctcttctcctrccctggtccctgcagcatgaatgccttcatcttgttgctgtgtgaggcgcccttctgctgccagttcatcgagtttgcaaacacagtggcggagaaggtg

SEQ ID NO: 73997 - DNA, 201 bp, Homo sapiens; identical to SEQ ID NO: 37133

SEQ ID NO: 73998 - DNA, 201 bp, Homo sapiens; identical to SEQ ID NO: 37136

SEQ ID NO: 73999 - DNA, 201 bp, Homo sapiens
aactcagagcatttatttagtgcctgtggtggtcagcattgtgtaggtaacatgactgacctcggacaagctttgatcccctctccgcggtggagattccragtaacttgcccgcgaagctagtaggtcctggatgggaagccagattctctgtcacaggctctttctggccagtttttctcacagtgagggcactggacc

SEQ ID NO: 74000 - DNA, 201 bp, Homo sapiens
tgttttctgtattaaagatttcatgatccttggttgtatttcctgcaactatttttccaggctcttgtttgcctttaattttgtttttgtcagaaggttcyccgccgtggtctttttctttgtaatttctattattattttatcattttgaaattttttaacgacagaaaaatctcacaaccacatgtctacaagaatgga

SEQ ID NO: 74001 - DNA, 201 bp, Homo sapiens
acaccacttcacattcgcatttatctatttgttatctaagagggaaaaatattttcccacgtgtttccattgcattttctgatatgaaaattttcgagttyactttttaacctgtgggaacctcagtgttctgcttagcaagttcagtgtgttttctgtattaaagatttcatgatccttggttgtatttcctgcaactat

SEQ ID NO: 74002 - DNA, 201 bp, Homo sapiens
acttaagcttatcttaaaaacattctgagaacaggtgaaggcactggaactgtctccacaaggcccagatctcagatcttgctgtggcatccctgacaccyggcacagagcaggtgtgggtaagaccaggggttgggtaagtgcaggagcaggccctgcctcccctgccctgccagcctccaggggaccccgtgggtgggc

SEQ ID NO: 74003 - DNA, 201 bp, Homo sapiens
agattctgatcattaaaaatattttaagatgcgtggctacgttgctttccaaagaggtcccttgagtctctcccccgcccccaccccagcccagggctgcmcaccacttcacattcgcatttatctatttgttatctaagagggaaaaatattttcccacgtgtttccattgcattttctgatatgaaaattttcgagttt

SEQ ID NO: 74004 - DNA, 201 bp, Homo sapiens
cagggggtgtgtgctcatctcctagggtcactgagagttagggtcctgacagcaggccttggcacagcccctggcactgagaagggtcctggccagtcagmgagggcctaggggcctggggcctggggctgaacactcaccaccactggcaggaaggacttggtgaggacgaaggcggtgagccagctggccagcacgcag

SEQ ID NO: 74005 - DNA, 201 bp, Homo sapiens
tttctgtgtttatgatgatttccttaatatctattttcaggtgtggaattactgggtcaaagattctgatcattaaaaatattttaagatgcgtggctacrttgctttccaaagaggtcccttgagtctctcccccgcccccaccccagcccagggctgcacaccacttcacattcgcatttatctatttgttatctaaga

SEQ ID NO: 74006 - DNA, 201 bp, Homo sapiens; identical to SEQ ID NO: 37141

SEQ ID NO: 74007 - DNA, 201 bp, Homo sapiens
ccaagacagcctgcccctctgagccaccaccacacctacccatgatgaagagcatggtggccagcaggggcaccagggtgaggtagccagcgggtgctgcmaggggctgcgccaagtccccccaggactcgctttccaggcccgcagtgctgttggggctcagaggcctggggccaaagtggatgtacagccccagagtca

SEQ ID NO: 74008 - DNA, 201 bp, Homo sapiens; identical to SEQ ID NO: 37143

SEQ ID NO: 74009 - DNA, 201 bp, Homo sapiens
agccttctgtggggcgtgtccttcacgcaagggaaagggactaggcctgaggtcacccagcagggccgtgtccctggatgcagggttgtatgcactcctgyggcccatggctacgtgcagcactgtgggctgcctgggctggggctgtggctggacagcagtgctacctgtcccgagccaggggcacccgctgctgaggcc

SEQ ID NO: 74010 - DNA, 201 bp, Homo sapiens
gacagcctgccgctgccagcaacctcccactgctgcctagggtgcagcgcccactgtcaccctgccttctgaagaagcccacagggctcctaaggtgcacyccggtacctggaactgcagccttggcagtgactggacagctgggtgggggatgctccctgctggccctgggaaccttggacaggccacctcaaggcccct

SEQ ID NO: 74011 - DNA, 201 bp, Homo sapiens
agactttataacattctttcaatacaggaatattcattcagctggatgtatcatgctgttcttaatttcttaactggtgtaaatcgaggtgtgataaacatgtgtctgctaaaactttttctgtgtttatgatgatttccttaatatctattttcaggtgtggaattactgggtcaaagattctgatcattaaaaatattt

SEQ ID NO: 74012 - DNA, 201 bp, Homo sapiens
gcaggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccct

SEQ ID NO: 74013 - DNA, 201 bp, Homo sapiens
aggggcattatagcctggtggacatgtgccttcagggttcctccggggccaccttcctcaggccagtgctgggttcaaagggctgtgtgtgtgtgtgtgtgtgtgtgtgtatgtatatgtgtgtgggtgcacacatctgtcccatgtatgcagtgagacctgtctacctcccacaaggagcaagggctctgcccgccctct

SEQ ID NO: 74014 - DNA, 201 bp, Homo sapiens; identical to SEQ ID NO: 37144

SEQ ID NO: 74015 - DNA, 201 bp, Homo sapiens; identical to SEQ ID NO: 37146

SEQ ID NO: 74016 - DNA, 201 bp, Homo sapiens; identical to SEQ ID NO: 8139

SEQ ID NO: 74017 - DNA, 201 bp, Homo sapiens
gtaacatatacacaaactatgaaataacatccatcatataagaagaactcctagaaaccaacagtaagaaaaacaaaccacctactggaaaaaccgagcayaggaatgaacagaaaacaggaacaaatggccaagaggcagaggaaaagatcctcaagtccacaaatagaaaattcaagttaaacaacactgacatgtctt

SEQ ID NO: 74018 - DNA, 201 bp, Homo sapiens; identical to SEQ ID NO: 66550

SEQ ID NO: 74019 - DNA, 201 bp, Homo sapiens
tcccgacagccccatccctgaaggtcccagatggccgagctttttaggactcacttttgctccttccctctcgctcccaagcagcggccgccctgaccttrccgtcgcctatagctttgtgtcccttgcaatggcttgagaggccattgtgtgccaggcctgggagcccaaagggtcccaatgcccctttggcccccagag

SEQ ID NO: 74020 - DNA, 201 bp, Homo sapiens
tcagtacgtcgcggttgaaggagttccagggaacagaggtgaactgctgagacacggacgcctgagggcaggtgcagacatcctcgttgttgaacctggtsgggacaaggaacagccaggctggggagcagctgacgggcagggagcccagtgggcaccagcaacacctccctgcaactcgagtcctgtccctggggcaac

SEQ ID NO: 74021 - DNA, 201 bp, Homo sapiens; identical to SEQ ID NO: 66397

SEQ ID NO: 74022 - DNA, 201 bp, Homo sapiens
cagtcatttctccaacgtggctctgaggggagcagggactctataagacaggaccgtgactagaggccgcgacaacctccagcctctcacggcaaccctayggcctgccatcgcatgggaggggcagggcaggcaccctctgagtccccactgccagctttaagcccctcgctgggttgctgctcttggagctggtgaccg

SEQ ID NO: 74023 - DNA, 201 bp, Homo sapiens
tctgctccacttgagccacacaattcacaggataattattggagaccaccatggttaccgaagcagctggcacggatccactggcaaggtggcccatttgscaggacagccctggcttgtgcctgggacccaggtaattgtgaacagcatcccctttggctcccggaagcagccccgctgcgtgatgcatcacgtggctgc

SEQ ID NO: 74024 - DNA, 201 bp, Homo sapiens
ttcagtacgtcgcggttgaaggagttccagggaacagaggtgaactgctgagacacggacgcctgagggcaggtgcagacatcctcgttgttgaacctggyggggacaaggaacagccaggctggggagcagctgacgggcagggagcccagtgggcaccagcaacacctccctgcaactcgagtcctgtccctggggcaa

SEQ ID NO: 74025 - DNA, 201 bp, Homo sapiens
taacccaggtctgctccacttgagccacacaattcacaggataattattggagaccaccatggttaccgaagcagctggcacggatccactggcaaggtgkcccatttgccaggacagccctggcttgtgcctgggacccaggtaattgtgaacagcatcccctttggctcccggaagcagccccgctgcgtgatgcatca

SEQ ID NO: 74026 - DNA, 201 bp, Homo sapiens; identical to SEQ ID NO: 66562

SEQ ID NO: 74027 - DNA, 201 bp, Homo sapiens; identical to SEQ ID NO: 66563

SEQ ID NO: 74028 - DNA, 201 bp, Homo sapiens; identical to SEQ ID NO: 66565

SEQ ID NO: 74029 - DNA, 201 bp, Homo sapiens; identical to SEQ ID NO: 66573

SEQ ID NO: 74030 - DNA, 201 bp, Homo sapiens; identical to SEQ ID NO: 66577

SEQ ID NO: 74031 - DNA, 201 bp, Homo sapiens
tcctctcctgagcccctgaagcctgacaggttcatcttcactcagtcaacaggcctttaaggcgagcctcccgtggacagggtgtggcaaagccaccaagytgagcagcgcgtggcctctgtgctgaagagcttgctgtccagggaaaagcaagtggcagaaggtggtacttggcaggtcccctacgtggtgggccgagca

SEQ ID NO: 74032 - DNA, 201 bp, Homo sapiens; identical to SEQ ID NO: 66580

SEQ ID NO: 74033 - DNA, 201 bp, Homo sapiens
tgagtctccccatgaggtagcccagcccagagccacccacaggcaccctccccctgccctggatggctctccctccccctatcactttctgtgtccctctycttctggtggcacccccagccctctcagccaccccagctggtggcagtgagtgggacagccttcccgctgggcactcaccggatggaccgacacgacctt

SEQ ID NO: 74034 - DNA, 201 bp, Homo sapiens; identical to SEQ ID NO: 66586

SEQ ID NO: 74035 - DNA, 201 bp, Homo sapiens; identical to SEQ ID NO: 66589

SEQ ID NO: 74036 - DNA, 201 bp, Homo sapiens; identical to SEQ ID NO: 66228

SEQ ID NO: 74037 - DNA, 201 bp, Homo sapiens; identical to SEQ ID NO: 66590

SEQ ID NO: 74038 - DNA, 201 bp, Homo sapiens; identical to SEQ ID NO: 66229

SEQ ID NO: 74039 - DNA, 201 bp, Homo sapiens; identical to SEQ ID NO: 66591

SEQ ID NO: 74040 - DNA, 201 bp, Homo sapiens; identical to SEQ ID NO: 66230

SEQ ID NO: 74041 - DNA, 201 bp, Homo sapiens; identical to SEQ ID NO: 66592

SEQ ID NO: 74042 - DNA, 201 bp, Homo sapiens
caatctttactctatggcagaacaaagggactgggcaaagcttggcgtggcacttacaccagctgccgccccctcctcccgtgcagacaaagagcatgggrcagttctgcccagagacgaaacctggcacctgttggccaggacgcgtttttgccagcattgttctctgggccggattcctcctttcccagcttttctcat

SEQ ID NO: 74043 - DNA, 201 bp, Homo sapiens
agagcagtgctgagctgtggcaagcacccgacatcagccactgctgtgatatactgagcacctcctctagagagaataaaggactgacaaagctgtcctgyctccaccctgagtttgtgatcaggaacctaggacacttgtcacctgaaatccaagggagacaggaagggtggggtaacagctgtgaggcacaagaccctg

SEQ ID NO: 74044 - DNA, 201 bp, Homo sapiens; identical to SEQ ID NO: 66232

SEQ ID NO: 74045 - DNA, 201 bp, Homo sapiens
agcagtgctgagctgtggcaagcacccgacatcagccactgctgtgatatactgagcacctcctctagagagaataaaggactgacaaagctgtcctgtcyccaccctgagtttgtgatcaggaacctaggacacttgtcacctgaaatccaagggagacaggaagggtggggtaacagctgtgaggcacaagaccctggg

SEQ ID NO: 74046 - DNA, 201 bp, Homo sapiens
gcagctgacgggcagggagcccagtgggcaccagcaacacctccctgcaactcgagtcctgtccctggggcaaccgtcctgccacctcctccccagccccrctgcctccgccaggccaccccagatgctgccttcaccggcaacggcctcacctctcctgtcaccttggcgggtgggtaatggctgctgcaggctgggttg

SEQ ID NO: 74047 - DNA, 201 bp, Homo sapiens; identical to SEQ ID NO: 66425

SEQ ID NO: 74048 - DNA, 201 bp, Homo sapiens; identical to SEQ ID NO: 66426

SEQ ID NO: 74049 - DNA, 201 bp, Homo sapiens; identical to SEQ ID NO: 66432

SEQ ID NO: 74050 - DNA, 201 bp, Homo sapiens; identical to SEQ ID NO: 66595

SEQ ID NO: 74051 - DNA, 201 bp, Homo sapiens; identical to SEQ ID NO: 66596

SEQ ID NO: 74052 - DNA, 201 bp, Homo sapiens
tggatgcccggcaagaccctcccatccctggccccggggccgcgcctgcagaatggggctgatggtggggacttgcctggggtgctccacctgcagagccmtctgtttgcgagcccactcagtcactgcacaggtgcttagccgagaggcggcacagtcggggttggcacctgcacccataccagccctgcctcctgttcg

SEQ ID NO: 74053 - DNA, 201 bp, Homo sapiens; identical to SEQ ID NO: 66597

SEQ ID NO: 74054 - DNA, 201 bp, Homo sapiens
gtggcgtcagttccgccgccgtgaagccagattgggcagggaatatgcagtctcctcgctggatgcccggcaagaccctcccatccctggccccggggccrcgcctgcagaatggggctgatggtggggacttgcctggggtgctccacctgcagagccctctgtttgcgagcccactcagtcactgcacaggtgcttagc

SEQ ID NO: 74055 - DNA, 201 bp, Homo sapiens
tcttggtcctctgggccttcccgcacgcagcccctgcacagagccttccttcacctcctcccctctcccctgggctccatgtgacagccacatttctgacraggccctcccaggtccccgcacctctgcctcctcaacctggtttttaaagttttgttttgtaattttgcttgttgttagcagcaggtgctccaggcctgt

SEQ ID NO: 74056 - DNA, 201 bp, Homo sapiens
gccactgtgcatgccacggcacctctggggtacagtccctgtcgtccactacaaggagcccagcagattcatgtgcgaaggtcacaggctgagtgttcccragcaagttataaaccatcagctcctgtgacccagtgggtcacaacagggccagggcccaggccagtgggggtgcagctggtgggccatgacacatctcaa

SEQ ID NO: 74057 - DNA, 201 bp, Homo sapiens
tcaacatgcggatctcctggggcaggcagagccgaggggtgggggagaggagacctcagagagctgcagaccagacccccggccactgtgtcctccctcargcctccctgacctctgggggtgtccattttgccccagcctctacagtggaagccagagcccgctaagtgtggcttctggccagggagggcattagattca

SEQ ID NO: 74058 - DNA, 201 bp, Homo sapiens
aacgccctgggacgtggcgtcagttccgccgccgtgaagccagattgggcagggaatatgcagtctcctcgctggatgcccggcaagaccctcccatcccyggccccggggccgcgcctgcagaatggggctgatggtggggacttgcctggggtgctccacctgcagagccctctgtttgcgagcccactcagtcactgc

SEQ ID NO: 74059 - DNA, 201 bp, Homo sapiens
acgccctgggacgtggcgtcagttccgccgccgtgaagccagattgggcagggaatatgcagtctcctcgctggatgcccggcaagaccctcccatccctkgccccggggccgcgcctgcagaatggggctgatggtggggacttgcctggggtgctccacctgcagagccctctgtttgcgagcccactcagtcactgca

SEQ ID NO: 74060 - DNA, 201 bp, Homo sapiens
catctgccatgtgccagaggcctccctacgatcagacaccagacacccaagtggggagcacaggccacatgggtggggggcgggtggggctggcccaggaraaagaagccagcctggagccatccctatggtgtcaggaaacagtagacccaggaggtcgtgtggtggcagggtgtgggggcggggcaggggtggggtgca

SEQ ID NO: 74061 - DNA, 201 bp, Homo sapiens
tcagggagctgagaacgactggcttattgaggggacgagcccatgccctaagtgaggagtcaagacctgtcatccttcctcagatggctcaggctgaacaytcgccctgggcaggtgcagggggaagcgggggtgacttaccactgtggccagctcccggtcttccgtgttgtacgtgcaggaggtgatgagcacatctcc

SEQ ID NO: 74062 - DNA, 201 bp, Homo sapiens
cctgtcatccttcctcagatggctcaggctgaacactcgccctgggcaggtgcagggggaagcgggggtgacttaccactgtggccagctcccggtcttcygtgttgtacgtgcaggaggtgatgagcacatctccctgaggaaaagccaatgtgaccatcagcacctgccacctggcgttggcaggtgctggaggcctcg

SEQ ID NO: 74063 - DNA, 201 bp, Homo sapiens; identical to SEQ ID NO: 66246

SEQ ID NO: 74064 - DNA, 201 bp, Homo sapiens
gggtagtagtgcacgtagttgacacacatctcctccaggatcccgaagcccccctgcaagttggaggagacccgtcagccccgggccatgccacgcagacrctgccatccagcagctttcgccgcacccacgtgtacactgcgtccactcgtctgttcactgcaccgtgccaggcatgctctggggaaccgagtccctgcc

SEQ ID NO: 74065 - DNA, 201 bp, Homo sapiens; identical to SEQ ID NO: 66613

SEQ ID NO: 74066 - DNA, 201 bp, Homo sapiens
catttactaggaaggaaaatccactctaaacctcattacaacgaaatctgctgtcacggccacagctttcaaagtcagacagactggtatttgaatcttcmctctgcgtgactgctggcagtgtgatcccagcaagcctcagtctccccatctgtgaaatgggtacgtcaacacttactttgcaggtcactgtgagaagta

SEQ ID NO: 74067 - DNA, 201 bp, Homo sapiens; identical to SEQ ID NO: 66616

SEQ ID NO: 74068 - DNA, 201 bp, Homo sapiens; identical to SEQ ID NO: 66618

SEQ ID NO: 74069 - DNA, 201 bp, Homo sapiens
ttcctgccggagacaatgggtgccatgccggctgagagctccgtctcccttcagccttgaggaacctttgcttggaagactgggatgctctgggggctcasccacatgaagaacaaatcccaatcgacccatttactaggaaggaaaatccactctaaacctcattacaacgaaatctgctgtcacggccacagctttcaa

SEQ ID NO: 74070 - DNA, 201 bp, Homo sapiens
gggatgtcagggtagctgtaacccaggtctgctccacttgagccacacaattcacaggataattattggagaccaccatggttaccgaagcagctggcacrgatccactggcaaggtggcccatttgccaggacagccctggcttgtgcctgggacccaggtaattgtgaacagcatcccctttggctcccggaagcagcc

SEQ ID NO: 74071 - DNA, 201 bp, Homo sapiens
ggactcacttttgctccttccctctcgctcccaagcagcggccgccctgaccttgccgtcgcctatagctttgtgtcccttgcaatggcttgagaggccaytgtgtgccaggcctgggagcccaaagggtcccaatgcccctttggcccccagaggccgaccctggcccagagatgccaggtgtcggccaggtggagggag

SEQ ID NO: 74072 - DNA, 201 bp, Homo sapiens; identical to SEQ ID NO: 66248

SEQ ID NO: 74073 - DNA, 201 bp, Homo sapiens
gcacctgttggccaggacgcgtttttgccagcattgttctctgggccggattcctcctttcccagcttttctcatccatcccgcccccgtcagatcgggaygattgccctcctgtgtgagttcctgtccctccccaccctctgccaccacagacatcaaaagggaactgagtccgaccctgtgtagaatctgttctcctct

SEQ ID NO: 74074 - DNA, 201 bp, Homo sapiens; identical to SEQ ID NO: 66250

SEQ ID NO: 74075 - DNA, 201 bp, Homo sapiens
actgtggccagctcccggtcttccgtgttgtacgtgcaggaggtgatgagcacatctccctgaggaaaagccaatgtgaccatcagcacctgccacctggygttggcaggtgctggaggcctcgcccccataggaccacgccactgtgcatgccacggcacctctggggtacagtccctgtcgtccactacaaggagccca

SEQ ID NO: 74076 - DNA, 201 bp, Homo sapiens
ttcctcagatggctcaggctgaacactcgccctgggcaggtgcagggggaagcgggggtgacttaccactgtggccagctcccggtcttccgtgttgtacrtgcaggaggtgatgagcacatctccctgaggaaaagccaatgtgaccatcagcacctgccacctggcgttggcaggtgctggaggcctcgcccccatagg

SEQ ID NO: 74077 - DNA, 201 bp, Homo sapiens
tcccggtcttccgtgttgtacgtgcaggaggtgatgagcacatctccctgaggaaaagccaatgtgaccatcagcacctgccacctggcgttggcaggtgytggaggcctcgcccccataggaccacgccactgtgcatgccacggcacctctggggtacagtccctgtcgtccactacaaggagcccagcagattcatgt

SEQ ID NO: 74078 - DNA, 201 bp, Homo sapiens
ggtgctggaggcctcgcccccataggaccacgccactgtgcatgccacggcacctctggggtacagtccctgtcgtccactacaaggagcccagcagattmatgtgcgaaggtcacaggctgagtgttcccgagcaagttataaaccatcagctcctgtgacccagtgggtcacaacagggccagggcccaggccagtggg

SEQ ID NO: 74079 - DNA, 201 bp, Homo sapiens
gaggtggaggttgcagcaagctgagaacacacagcctgggtgacagagcgagactccgtctcaaaaaaaaataaaatataaaataaaataaaataaaccastggcagtctgggctcagtaaacatcaggtgaatccacattggattaaaacacaaagaatagggctgtgacatggacctgagttcctggcgctgagggatg

SEQ ID NO: 74080 - DNA, 201 bp, Homo sapiens
gtccccaccgaggcctgggcttggccctctgtgggatcagggctccactgcctgccttagtgccctcatctcccccaaacactctcgggtttgtggtcggyccatcagactgaggacacgcgtcccctgggagtgtcctgtctgctccactctttccaacgtctctccatgaactcctgagtgagtctccccatgaggtag

SEQ ID NO: 74081 - DNA, 201 bp, Homo sapiens
atggctcatgcctgtaatcccagcatgagggattacatgaggagtttgagaccagcctggccaacatggtgaaaatccatctctactaaaaatacaaaaaytagccaggcgtggtggtgggtgcctgtagtcccagctattcaggaggctgaggcaggagaatcggttgaactcgggaggtggaggttgcagcaagctgag

SEQ ID NO: 74082 - DNA, 201 bp, Homo sapiens; identical to SEQ ID NO: 66272

SEQ ID NO: 74083 - DNA, 201 bp, Homo sapiens
ggaggtgatgagcacatctccctgaggaaaagccaatgtgaccatcagcacctgccacctggcgttggcaggtgctggaggcctcgcccccataggaccaygccactgtgcatgccacggcacctctggggtacagtccctgtcgtccactacaaggagcccagcagattcatgtgcgaaggtcacaggctgagtgttccc

SEQ ID NO: 74084 - DNA, 201 bp, Homo sapiens
ctgtgaaaatacaaacactggctgggtgctatggctcatgcctgtaatcccagcatgagggattacatgaggagtttgagaccagcctggccaacatggtsaaaatccatctctactaaaaatacaaaaattagccaggcgtggtggtgggtgcctgtagtcccagctattcaggaggctgaggcaggagaatcggttgaa

SEQ ID NO: 74085 - DNA, 201 bp, Homo sapiens
accctgggcagtttgcttccctggaacacttgcattttctaggtctttctccccggccaggttagagccaccatcagaaacctcacggggaagagcgaggkggccgcaacagcccccagctcccaaagaagcagcccctagtcccactcaggagcgactttctttccgagtccttcatcctctcctgagcccctgaagcct

SEQ ID NO: 74086 - DNA, 201 bp, Homo sapiens
cacaacagggccagggcccaggccagtgggggtgcagctggtgggccatgacacatctcaaaggacttgggcaagtccccaccgaggcctgggcttggccytctgtgggatcagggctccactgcctgccttagtgccctcatctcccccaaacactctcgggtttgtggtcggcccatcagactgaggacacgcgtcccc

SEQ ID NO: 74087 - DNA, 201 bp, Homo sapiens
ctggtttttaaagttttgttttgtaattttgcttgttgttagcagcaggtgctccaggcctgtctccctggtgcaccttgagctccacggggcaaaggtcracctcttgtcctacagcttctccccacaccagccccgggtgctgagaagcttcttggtgtgagtgcttctcaaccttgagcaggggtcaacatccgctgg

SEQ ID NO: 74088 - DNA, 201 bp, Homo sapiens
gtttgtgatcaggaacctaggacacttgtcacctgaaatccaagggagacaggaagggtggggtaacagctgtgaggcacaagaccctgggtcaaatcccrgctcagccatctatcagctgtgtgactttggtcaagtgcctgccctctctgagcctttatgtctcacctgtgaaaatacaaacactggctgggtgctatg

SEQ ID NO: 74089 - DNA, 201 bp, Homo sapiens
gccgagctttttaggactcacttttgctccttccctctcgctcccaagcagcggccgccctgaccttgccgtcgcctatagctttgtgtcccttgcaatgrcttgagaggccattgtgtgccaggcctgggagcccaaagggtcccaatgcccctttggcccccagaggccgaccctggcccagagatgccaggtgtcggc

SEQ ID NO: 74090 - DNA, 201 bp, Homo sapiens
tgtagaatctgttctcctctttcacctggggaaggaaatcgaatttcaaaggccactgtgtcttggatcagcaggcgagggcttgtcagagtgtgagaagytcaggtccacctggggagctgccctcccctttgatcccacctggtgctgtgatgtggccactgccaagaggacgacatgggccagggaagccacagaact

SEQ ID NO: 74091 - DNA, 201 bp, Homo sapiens
gctgagtgttcccgagcaagttataaaccatcagctcctgtgacccagtgggtcacaacagggccagggcccaggccagtgggggtgcagctggtgggccwtgacacatctcaaaggacttgggcaagtccccaccgaggcctgggcttggccctctgtgggatcagggctccactgcctgccttagtgccctcatctccc

SEQ ID NO: 74092 - DNA, 201 bp, Homo sapiens; identical to SEQ ID NO: 66277

SEQ ID NO: 74093 - DNA, 201 bp, Homo sapiens; identical to SEQ ID NO: 66499

SEQ ID NO: 74094 - DNA, 201 bp, Homo sapiens
ggcgagggcttgtcagagtgtgagaagctcaggtccacctggggagctgccctcccctttgatcccacctggtgctgtgatgtggccactgccaagaggasgacatgggccagggaagccacagaactgcccacggggacgctggcaccgagggcctcaacctgcagaacggccatctgagatgtccgcggtgctcaccag

SEQ ID NO: 74095 - DNA, 201 bp, Homo sapiens; identical to SEQ ID NO: 66368

SEQ ID NO: 74096 - DNA, 201 bp, Homo sapiens; identical to SEQ ID NO: 66639

SEQ ID NO: 74097 - DNA, 201 bp, Homo sapiens; identical to SEQ ID NO: 66641

SEQ ID NO: 74098 - DNA, 201 bp, Homo sapiens
tcctcccgtgcagacaaagagcatgggacagttctgcccagagacgaaacctggcacctgttggccaggacgcgtttttgccagcattgttctctgggccrgattcctcctttcccagcttttctcatccatcccgcccccgtcagatcgggacgattgccctcctgtgtgagttcctgtccctccccaccctctgccacc

SEQ ID NO: 74099 - DNA, 201 bp, Homo sapiens
gaggcgggtctgtattcctgaggctggagagaggcgttctcacagtcagcggtcagcggggtcgaaggccccaaggccctgcaaggggcagtgagtgctgyctggccggaagccgctcttccccatgagccctggccaaggtgccttttacatgggcccacgcttcaccagtgggcgctttagggaagtgggagagagtgt

SEQ ID NO: 74100 - DNA, 201 bp, Homo sapiens; identical to SEQ ID NO: 66291

SEQ ID NO: 74101 - DNA, 201 bp, Homo sapiens; identical to SEQ ID NO: 66293

SEQ ID NO: 74102 - DNA, 201 bp, Homo sapiens; identical to SEQ ID NO: 66295

SEQ ID NO: 74103 - DNA, 201 bp, Homo sapiens; identical to SEQ ID NO: 66297

SEQ ID NO: 74104 - DNA, 201 bp, Homo sapiens
ggccctttccactgcagccccgcaccgtccaccagtcatttctccaacgtggctctgaggggagcagggactctataagacaggaccgtgactagaggccrcgacaacctccagcctctcacggcaaccctacggcctgccatcgcatgggaggggcagggcaggcaccctctgagtccccactgccagctttaagcccct

SEQ ID NO: 74105 - DNA, 201 bp, Homo sapiens
cttcagtacgtcgcggttgaaggagttccagggaacagaggtgaactgctgagacacggacgcctgagggcaggtgcagacatcctcgttgttgaacctgstggggacaaggaacagccaggctggggagcagctgacgggcagggagcccagtgggcaccagcaacacctccctgcaactcgagtcctgtccctggggca

SEQ ID NO: 74106 - DNA, 201 bp, Homo sapiens; identical to SEQ ID NO: 66538

SEQ ID NO: 74107 - DNA, 201 bp, Homo sapiens; identical to SEQ ID NO: 66663

SEQ ID NO: 74108 - DNA, 201 bp, Homo sapiens
cagctactaaggaggctaagacaggagaatcacttgaacccaggaggcggaggttgcaatgagctgacatcgcgccattgtactccagcatgggggacaakagcaagactgcgtctcaaagaaaaaaaaagtcaaaaagtaggccaggcatggtggctcacgcttataatcccagcactttgggaggccaaggcgggcaga

SEQ ID NO: 74109 - DNA, 201 bp, Homo sapiens
atattttttatttatttttgtagagacggggtgtccctatattgctctgcctggtcttaaatttccggactcaagcaatcctcctgccttggcctcccaargtgttgggattattgttggggccaggcgcagtggctcacacttgtaatcccagcactttgagaggctgatgtgggcggaacaccccgtctctactaaaaa

SEQ ID NO: 74110 - DNA, 201 bp, Homo sapiens
ctagaggcggcagctcttcttccggcgcccggcgctccgcggcatcgccggcttcgacttcggccccagacttagggctcagcgggggccggtgagtaacrgacacgtccgccgccatcttgggaaacccggcgccttctgggaccagcgagccggggcggagcggcatagagcggcaacgagggcgcgcccgtcgattgg

SEQ ID NO: 74111 - DNA, 201 bp, Homo sapiens
gaggttgcaatgagctgacatcgcgccattgtactccagcatgggggacaatagcaagactgcgtctcaaagaaaaaaaaagtcaaaaagtaggccaggcmtggtggctcacgcttataatcccagcactttgggaggccaaggcgggcagatcatttgaggccaggagtttgagaccagcctgggcaacatggtgaaatc

SEQ ID NO: 74112 - DNA, 201 bp, Homo sapiens
tgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggag

SEQ ID NO: 74113 - DNA, 201 bp, Homo sapiens
tgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcctgtctct

SEQ ID NO: 74114 - DNA, 201 bp, Homo sapiens
agaatcacttgaacccaggaggcggaggttgcaatgagctgacatcgcgccattgtactccagcatgggggacaatagcaagactgcgtctcaaagaaaaraaaagtcaaaaagtaggccaggcatggtggctcacgcttataatcccagcactttgggaggccaaggcgggcagatcatttgaggccaggagtttgagac

SEQ ID NO: 74115 - DNA, 201 bp, Homo sapiens
gagccattggccacttgcccacaccactacccaagaccagtcccacctccggacacgtcgactcactgtacacggtgatgttagaggagcctgttatctgrgagccattgcagtacactgagcagaggatccgactgttgccagtcacgttgctgagattgaaggctgcccagcccatgccactggccaccagctcctttg

SEQ ID NO: 74116 - DNA, 201 bp, Homo sapiens
ggaggcagaggttgcagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaac

SEQ ID NO: 74117 - DNA, 201 bp, Homo sapiens
gaggcagaggttgcagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacc

SEQ ID NO: 74118 - DNA, 201 bp, Homo sapiens
gttgcagtgagccaagattgcgccactgcactctagcctgggggacagagtgagactctgtctcaaaaaaaaaaaaaaagaaaagaaaagaaaaaaaaaartagccaggtacagtggctcaggcctgcaatcccagctactggagagactgaagtgggaggattgcctgagcccaggagtttgagaccaacctaggcaaca

SEQ ID NO: 74119 - DNA, 201 bp, Homo sapiens
ttgcagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacat

SEQ ID NO: 74120 - DNA, 201 bp, Homo sapiens
gcagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatag

SEQ ID NO: 74121 - DNA, 201 bp, Homo sapiens
tcaagcaatcctcctgccttggcctcccaaagtgttgggattattgttggggccaggcgcagtggctcacacttgtaatcccagcactttgagaggctgakgtgggcggaacaccccgtctctactaaaaatacaaaacttagctgggcattagctggacctgggaggcagaggtcgcagtgagccgagattgcaccactg

SEQ ID NO: 74122 - DNA, 201 bp, Homo sapiens
cagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagg

SEQ ID NO: 74123 - DNA, 201 bp, Homo sapiens
agtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacataggg

SEQ ID NO: 74124 - DNA, 201 bp, Homo sapiens
gccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatc

SEQ ID NO: 74125 - DNA, 201 bp, Homo sapiens
ccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcc

SEQ ID NO: 74126 - DNA, 201 bp, Homo sapiens
cagcagagagcacagggttctggggctccacccgcaaaaggaactcctgcccctggacaccttcaggaacatgaagaagtcctggtgtttgtttccttgtyccccaacccacgcatcaacaggccccaccatttaacacctctctccttgtgccgagacagaagggttcctgccttcatggtccagtgggaaaggtagaat

SEQ ID NO: 74127 - DNA, 201 bp, Homo sapiens
cttgcagtgagccgagattgcgccactgcagtccgcagtccagcctgggcgacagagcgagactccgtctcaaaaaaaaaaaaaaaaaaaaaaaaaaatamcaacaacaaaaaaaaaaaaaaaaaaagaggccgggctcacgcctgtaattccagcactttggaggctgaggcaggcgggtcacaagatcaagagatcgag

SEQ ID NO: 74128 - DNA, 201 bp, Homo sapiens
atgactatgatatgaatattaaaaattcctgtttatggccagacgtggtggctcacgcctgtaatcccagagctttgggaggccggggtgggtggatcaaraggtcaggattattcagttctctccaatcaggttcagacactcagggctttcctggttcaccagccctgtggcagcctctcaagatactccggcacagtc

SEQ ID NO: 74129 - DNA, 201 bp, Homo sapiens
gtttgtttccttgtcccccaacccacgcatcaacaggccccaccatttaacacctctctccttgtgccgagacagaagggttcctgccttcatggtccagkgggaaaggtagaatccatcagagaccggggagaactcagaaggaggccagaagaggctctgatccagcataggaggaggtgagtcagggaaggcttcctg

SEQ ID NO: 74130 - DNA, 201 bp, Homo sapiens
ggtcctaggaagcctaaaggcggggcattgcccaggagcttaatgaacaggaccttcctgtgggtcaagccgctccctccgccctcccctttcctctcggratatccgggccacgctttcggccgttcaagcctcgccctctttccgcgctgtgtccagcttcgggcactcaggcccaacccacgttgcaactgctattgg

SEQ ID NO: 74131 - DNA, 201 bp, Homo sapiens
tccagccctccccggcttgactggtctcacctggggtcagcagacagcagaccagcagagtccagcaggccctgggccacaacacggatggtaccatggtrgccattctgacagaggaaggtgccttcctgaggtgcccgaagggcaggcaggggaaaaggcggggcctcccactgcgacggaagcacagcggttaagatt

SEQ ID NO: 74132 - DNA, 201 bp, Homo sapiens
caggcccaacccacgttgcaactgctattggggcaagccaggccccaccttttcggctagtctccgccccctctgccacgcccccagactgctgaggccgygcccccttcccacgcctcctcttactaaagaccgtcaagttctcccgggcctcccgtctctcgccccctagggtcacgttgcagacgatctcccgggcac

SEQ ID NO: 74133 - DNA, 201 bp, Homo sapiens
cacgaagacggggacaaagtgggagctcccagctgtgcagagaaagcgctaagtcaatatgcgtcccttctgtctccaacccccccgccccccggcttacsggtccagacccgcagccccgtattagctcaccctcaatgtccatcaccacgaccagggtgtatttgcctcgtgagctggacgcttggcactgataagtac

SEQ ID NO: 74134 - DNA, 201 bp, Homo sapiens
ctgtcccaagatgacaggatgacaggcagattggggcaacctgccatgttggcctggggggcaatactgggcctgaagctcagagcagcagacagtgagcyaggccctcccatcttcagggatggtcactccctgccctggcccgccccatggccccacaaacctgtccctttgtatttgtccacaaaacagtatttgagc

SEQ ID NO: 74135 - DNA, 201 bp, Homo sapiens
cacagaggcagcgggagtggagaagggcaggcgtcagttgcccggcatccgtccagtgcacgtagagggtgcgtggtcccagcggcttgcccagcaggtcygacttggcacgggcagccgagtccttcttcatgtactcagcaaagccatagcccttggattggccagtgcgctcactgtagaccaggaagcagcgctcca

SEQ ID NO: 74136 - DNA, 201 bp, Homo sapiens
aagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcctg

SEQ ID NO: 74137 - DNA, 201 bp, Homo sapiens
agattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcctgt

SEQ ID NO: 74138 - DNA, 201 bp, Homo sapiens
gattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcctgtc

SEQ ID NO: 74139 - DNA, 201 bp, Homo sapiens
gagctcccagctgtgcagagaaagcgctaagtcaatatgcgtcccttctgtctccaacccccccgccccccggcttaccggtccagacccgcagccccgtrttagctcaccctcaatgtccatcaccacgaccagggtgtatttgcctcgtgagctggacgcttggcactgataagtaccattatgtgttacgttgacgaa

SEQ ID NO: 74140 - DNA, 201 bp, Homo sapiens
gctgaggccgcgcccccttcccacgcctcctcttactaaagaccgtcaagttctcccgggcctcccgtctctcgccccctagggtcacgttgcagacgatytcccgggcaccctcctgatccgcgcgcgccgtggctgtggctgtggccgttagcgtgtccccgtggttcatgactgtcgcattcagcatctggtccccca

SEQ ID NO: 74141 - DNA, 201 bp, Homo sapiens
aaatacaaaaattagccgggcatggtggcacatgcctgtaatcccagctactcgggaggctgaagcaggggaatgggctgaacccaggaggcggaggttgyagcgagccgagctcgcgccactgcactccagcctggcgacagagcaagactccatctcaaaaaaaaaaaaaaaaagaccacacaagcaggggtgactggc

SEQ ID NO: 74142 - DNA, 201 bp, Homo sapiens
tcccaaagtgttgggattattgttggggccaggcgcagtggctcacacttgtaatcccagcactttgagaggctgatgtgggcggaacaccccgtctctamtaaaaatacaaaacttagctgggcattagctggacctgggaggcagaggtcgcagtgagccgagattgcaccactgcactccagcctgggctacagagta

SEQ ID NO: 74143 - DNA, 201 bp, Homo sapiens
catcaacaggccccaccatttaacacctctctccttgtgccgagacagaagggttcctgccttcatggtccagtgggaaaggtagaatccatcagagaccrgggagaactcagaaggaggccagaagaggctctgatccagcataggaggaggtgagtcagggaaggcttcctggaagcggggaccattgcagcccgaaac

SEQ ID NO: 74144 - DNA, 201 bp, Homo sapiens
atgcccagctaatattttttatttatttttgtagagacggggtgtccctatattgctctgcctggtcttaaatttccggactcaagcaatcctcctgcctyggcctcccaaagtgttgggattattgttggggccaggcgcagtggctcacacttgtaatcccagcactttgagaggctgatgtgggcggaacaccccgtc

SEQ ID NO: 74145 - DNA, 201 bp, Homo sapiens
aactggcgctcggtgtgttccaggcgtttccggatctcttctggatctagaggcggcagctcttcttccggcgcccggcgctccgcggcatcgccggcttygacttcggccccagacttagggctcagcgggggccggtgagtaacggacacgtccgccgccatcttgggaaacccggcgccttctgggaccagcgagccg

SEQ ID NO: 74146 - DNA, 201 bp, Homo sapiens
gggctgctgttaacttccggatttatctctgagagcagtgaataaacgcgtgatatggaggggcgtactctccgcagtcctgaaacttctggatgtgaggycccgccaccctgtggtagagtgggtggagaaaagcatcatccaagcagggggcaactggtggtccaatgtaccagcccattcacaattccccaacaggac

SEQ ID NO: 74147 - DNA, 201 bp, Homo sapiens
catgttggcctggggggcaatactgggcctgaagctcagagcagcagacagtgagccaggccctcccatcttcagggatggtcactccctgccctggcccrccccatggccccacaaacctgtccctttgtatttgtccacaaaacagtatttgagctcatagtcactgagcaggtcatgtacttcctgtggagatacaag

SEQ ID NO: 74148 - DNA, 201 bp, Homo sapiens
tcggtcaattttgggaccatctgtggaaccaccatgtgtgatcagacacccaacacacccgaggcacagtggtgcagaggagcgtctaatctttccagggmaggggtggagggattaaaggtcagggtgaccgactcacacaggactcgcagctggacgctactgttcctgtgcaagaactcgccgtccacctcgagagtg

SEQ ID NO: 74149 - DNA, 201 bp, Homo sapiens
gcgcggtggctcacgcctgtaatcccagcactttgggaggccgaggcgggtggatcacgaggtcaggagatcgagaccatcctggctaacaaggtgaaacyccgtctctactaaaaatacaaaaaaattagccgggcgcggtggcaggcgcctgtattcccagctactcgggaggctgaggcaggagaatggcgtgaaccc

SEQ ID NO: 74150 - DNA, 201 bp, Homo sapiens
atctcaactaaaaatacaaaatttgctgggtgtggtggcgtgcatgtgtaatctcagccactcgggaggctgaggcaggagaatcacttgaacccaggagkcgaaggttgcagtgagccgacatcgtgccactgcactccagcctaggcaaaaagagcgaaactctgtctcaaaaaaaaaaaaaaaatgcttgttggggcc

SEQ ID NO: 74151 - DNA, 201 bp, Homo sapiens
gaagcgtttgctattatcattagcgcagtgattatcatttcctgtgttgtcagataccttgcaaggcgctaaacaaaactttctgttctcaaagatggcamaataaaaaaaaatgaggatggaagggatgaacgtttatgactatgatatgaatattaaaaattcctgtttatggccagacgtggtggctcacgcctgtaa

SEQ ID NO: 74152 - DNA, 201 bp, Homo sapiens
agggccgcaccagctcctcgaactgctgctgtgtgaggctggggggcaggttggccacacacagcagggcatccgtgggctgcagctgcaccgacagttcrcgctcccgcaggcggctctggtggaaagcattgattgcggcctcggcctgctccccattcagcagggtcacgaaggctgcggtgggaggagggcagtgcg

SEQ ID NO: 74153 - DNA, 201 bp, Homo sapiens
gagcttgcagtgagccgagattgcgccactgcagtccgcagtccagcctgggcgacagagcgagactccgtctcaaaaaaaaaaaaaaaaaaaaaaaaaawtaacaacaacaaaaaaaaaaaaaaaaaaagaggccgggctcacgcctgtaattccagcactttggaggctgaggcaggcgggtcacaagatcaagagatc

SEQ ID NO: 74154 - DNA, 201 bp, Homo sapiens
gagaaaggtgggcatagtacaacccccaggactgtgccttccccaggacaccctcatcccccccagtcaggatatcttgctgactgggtcacccttcttcrcaggacacacacacagggccatgaaaacggccttcttcaaagatcccacggctcgggcctcccttccggggccaccttgcccagtggccgggggctttcc

SEQ ID NO: 74155 - DNA, 201 bp, Homo sapiens
gtgagccgagattgcgccactgcagtccgcagtccagcctgggcgacagagcgagactccgtctcaaaaaaaaaaaaaaaaaaaaaaaaaaataacaacamcaaaaaaaaaaaaaaaaaaagaggccgggctcacgcctgtaattccagcactttggaggctgaggcaggcgggtcacaagatcaagagatcgagaccatc

SEQ ID NO: 74156 - DNA, 201 bp, Homo sapiens
tgatttggggacagctgagtccctgagccactgtctatccaggattctacttggtttttgtttgtttgttttgagacagagtctcactctgtcacccaggytggagtgcagtggcgggatctcggctcactgcagcctctgcctcccgggttcaaacgattttcctgcctcagcctcccgagtagctgggattacaggcat

SEQ ID NO: 74157 - DNA, 201 bp, Homo sapiens
cccaacatccctggggttccactagccacgtgcccacccggtgtgctggtgggccggagagcagggaatctcagcagcaggaagcgagaacctatttcacmgccatagggcagggcagtatagatgccatttccctgggtccaaagagcattgggaagcgctgccccatgctggccccatgagaagggcactcctagcagg

SEQ ID NO: 74158 - DNA, 201 bp, Homo sapiens
cacgtcccccgggaggccccggatcagtatcttgcggcggttacggaactggcgctcggtgtgttccaggcgtttccggatctcttctggatctagaggcrgcagctcttcttccggcgcccggcgctccgcggcatcgccggcttcgacttcggccccagacttagggctcagcgggggccggtgagtaacggacacgtc

SEQ ID NO: 74159 - DNA, 201 bp, Homo sapiens
aaaaaaaaaaaaagcttgttggggccgggcgcagtggcccatgcctgtaatcccagcactttgggaggctgaggtgggcggatcgcctgaggtcaggagtwcaagaccagactggccaacatggtgaaatgccatctcaactaaaaatacaaaatttgctgggtgtggtggcgtgcatgtgtaatctcagccactcgggag

SEQ ID NO: 74160 - DNA, 201 bp, Homo sapiens
ccattctttgcaaactgagggtccccactctcctgagccattggccacttgcccacaccactacccaagaccagtcccacctccggacacgtcgactcacygtacacggtgatgttagaggagcctgttatctgggagccattgcagtacactgagcagaggatccgactgttgccagtcacgttgctgagattgaaggct

SEQ ID NO: 74161 - DNA, 201 bp, Homo sapiens
agatgcgtctctatatctctgtctctgtctctgtgtctctgtctctgtctatctttgtatctcacacacaaatgtccaggtctgagctctgggtcagaacygtggtccattctttgcaaactgagggtccccactctcctgagccattggccacttgcccacaccactacccaagaccagtcccacctccggacacgtcga

SEQ ID NO: 74162 - DNA, 201 bp, Homo sapiens
tccacacgctccgggagccctgagagaggaggggaggatggcacttagcgggtcctgcaaacccacccactcaccccagggactggggaggagacagggtrgtcctgccgagaactgtgagctttgagttaataaacttagagggcttagagctgggccagtcgaagcgtttgctattatcattagcgcagtgattatcat

SEQ ID NO: 74163 - DNA, 201 bp, Homo sapiens
agtggcagtgacctccgctggctcctccactgcgggctgccggctcagctcctcctcccagcgaagcagcaccaccgtgaggctggtccggggcgacccaycctccacttggcagcgcagggtgaagttctggcccaccggctgccaaggaggcaggggtgccagctccacacgctccgggagccctgagagaggagggga

SEQ ID NO: 74164 - DNA, 201 bp, Homo sapiens
acctttgaagatcttgaggatacctccctatctttgaagatcttggggatcccccatcccctgcacaaagagctaaggtaggtgatttggggacagctgaktccctgagccactgtctatccaggattctacttggtttttgtttgtttgttttgagacagagtctcactctgtcacccaggctggagtgcagtggcggga

SEQ ID NO: 74165 - DNA, 201 bp, Homo sapiens
ttggggcccaagttaattgatttcacaactgctgccttggcatgagattgagatgcgtctctatatctctgtctctgtctctgtgtctctgtctctgtctrtctttgtatctcacacacaaatgtccaggtctgagctctgggtcagaactgtggtccattctttgcaaactgagggtccccactctcctgagccattggc

SEQ ID NO: 74166 - DNA, 201 bp, Homo sapiens
actgtggtccattctttgcaaactgagggtccccactctcctgagccattggccacttgcccacaccactacccaagaccagtcccacctccggacacgtygactcactgtacacggtgatgttagaggagcctgttatctgggagccattgcagtacactgagcagaggatccgactgttgccagtcacgttgctgagat

SEQ ID NO: 74167 - DNA, 201 bp, Homo sapiens
ctgtccctactaaaaatacaaaaattagctgggcgtgttggcatgcgcctgtaatcccagctactcaggaggctgaggcaggagaatcgcttgaacccggraggcagaggttgcagtgagccaagattgcgccactgcactctagcctgggggacagagtgagactctgtctcaaaaaaaaaaaaaaagaaaagaaaagaa

SEQ ID NO: 74168 - DNA, 201 bp, Homo sapiens
gcccggcatccgtccagtgcacgtagagggtgcgtggtcccagcggcttgcccagcaggtccgacttggcacgggcagccgagtccttcttcatgtactcrgcaaagccatagcccttggattggccagtgcgctcactgtagaccaggaagcagcgctccaggctgccgaagggccgcaccagctcctcgaactgctgct

SEQ ID NO: 74169 - DNA, 201 bp, Homo sapiens
acctggcagagatgggattcagaacctagctgcagactgtgctattacccaggcaacatgctcttagagggtatacctttagctggctgggcggggtggcycacgcttataatcccagcattttgggaggccgaggcgggtgaatcacctgaggtcaggagttcgagaccagcctggccaacatggtgaaaccttgtctct

SEQ ID NO: 74170 - DNA, 201 bp, Homo sapiens
aattagccaggcatggtagcacgtgcctgtaatcccagctactcaggaggctgaggcacaagaatcgcttgaacccaggaggcaaaatttgcagtgagctkagatagtgccactgcactccagcctggcgacagagagagactctatgtcaaaaaaaaaaaaaaaaaaaaaaaggctgggcaaggtgactcatgcctgtaa

SEQ ID NO: 74171 - DNA, 201 bp, Homo sapiens
ccgggaagcagagcttgcagtgagccgagattgcgccactgcagtccgcagtccagcctgggcgacagagcgagactccgtctcaaaaaaaaaaaaaaaawaaaaaaaaaataacaacaacaaaaaaaaaaaaaaaaaaagaggccgggctcacgcctgtaattccagcactttggaggctgaggcaggcgggtcacaaga

SEQ ID NO: 74172 - DNA, 201 bp, Homo sapiens
agcttgcagtgagccgagattgcgccactgcagtccgcagtccagcctgggcgacagagcgagactccgtctcaaaaaaaaaaaaaaaaaaaaaaaaaaayaacaacaacaaaaaaaaaaaaaaaaaaagaggccgggctcacgcctgtaattccagcactttggaggctgaggcaggcgggtcacaagatcaagagatcg

SEQ ID NO: 74173 - DNA, 201 bp, Homo sapiens
ccccgccaactttgatcccggatcccagcgtcactcagctctggacggttcttcccccattgcttctgtcggctgcatagacgtgaggggcagataggtgstctcctccctaacatggtaactgccgctccgttggtgctccctgaagacgtacattaaggccagtacgatagtcaccacgcccagggtcagtaacaccgc

SEQ ID NO: 74174 - DNA, 201 bp, Homo sapiens; identical to SEQ ID NO: 74108

SEQ ID NO: 74175 - DNA, 201 bp, Homo sapiens; identical to SEQ ID NO: 74109

SEQ ID NO: 74176 - DNA, 201 bp, Homo sapiens; identical to SEQ ID NO: 74110

SEQ ID NO: 74177 - DNA, 201 bp, Homo sapiens; identical to SEQ ID NO: 74111

SEQ ID NO: 74178 - DNA, 201 bp, Homo sapiens; identical to SEQ ID NO: 74112

SEQ ID NO: 74179 - DNA, 201 bp, Homo sapiens; identical to SEQ ID NO: 74113

SEQ ID NO: 74180 - DNA, 201 bp, Homo sapiens; identical to SEQ ID NO: 74114

SEQ ID NO: 74181 - DNA, 201 bp, Homo sapiens; identical to SEQ ID NO: 74115

SEQ ID NO: 74182 - DNA, 201 bp, Homo sapiens; identical to SEQ ID NO: 74116

SEQ ID NO: 74183 - DNA, 201 bp, Homo sapiens; identical to SEQ ID NO: 74117

SEQ ID NO: 74184 - DNA, 201 bp, Homo sapiens; identical to SEQ ID NO: 74118

SEQ ID NO: 74185 - DNA, 201 bp, Homo sapiens; identical to SEQ ID NO: 74119

SEQ ID NO: 74186 - DNA, 201 bp, Homo sapiens; identical to SEQ ID NO: 74120

SEQ ID NO: 74187 - DNA, 201 bp, Homo sapiens; identical to SEQ ID NO: 74121

SEQ ID NO: 74188 - DNA, 201 bp, Homo sapiens; identical to SEQ ID NO: 74122

SEQ ID NO: 74189 - DNA, 201 bp, Homo sapiens; identical to SEQ ID NO: 74123

SEQ ID NO: 74190 - DNA, 201 bp, Homo sapiens; identical to SEQ ID NO: 74124

SEQ ID NO: 74191 - DNA, 201 bp, Homo sapiens; identical to SEQ ID NO: 74125

SEQ ID NO: 74192 - DNA, 201 bp, Homo sapiens; identical to SEQ ID NO: 74126

SEQ ID NO: 74193 - DNA, 201 bp, Homo sapiens; identical to SEQ ID NO: 74127

SEQ ID NO: 74194 - DNA, 201 bp, Homo sapiens; identical to SEQ ID NO: 74128

SEQ ID NO: 74195 - DNA, 201 bp, Homo sapiens; identical to SEQ ID NO: 74129

SEQ ID NO: 74196 - DNA, 201 bp, Homo sapiens; identical to SEQ ID NO: 74130

SEQ ID NO: 74197 - DNA, 201 bp, Homo sapiens; identical to SEQ ID NO: 74131

SEQ ID NO: 74198 - DNA, 201 bp, Homo sapiens
aaaataaaaaagaaagaaatatttgtaaataagtcatatttcttttttgttttttgaaacagagtctcaccgtgtcgcctaggctggagtgcaggggcacratctcagctaactgcaatctcagcctcctgggttcaagtgatcctcccacctcagcctccctaggagctgagaccacaggtacacaccactgtgcctggc

SEQ ID NO: 74199 - DNA, 201 bp, Homo sapiens; identical to SEQ ID NO: 74132

SEQ ID NO: 74200 - DNA, 201 bp, Homo sapiens; identical to SEQ ID NO: 74133

SEQ ID NO: 74201 - DNA, 201 bp, Homo sapiens; identical to SEQ ID NO: 74134

SEQ ID NO: 74202 - DNA, 201 bp, Homo sapiens; identical to SEQ ID NO: 74136

SEQ ID NO: 74203 - DNA, 201 bp, Homo sapiens; identical to SEQ ID NO: 74137

SEQ ID NO: 74204 - DNA, 201 bp, Homo sapiens; identical to SEQ ID NO: 74138

SEQ ID NO: 74205 - DNA, 201 bp, Homo sapiens; identical to SEQ ID NO: 74139

SEQ ID NO: 74206 - DNA, 201 bp, Homo sapiens; identical to SEQ ID NO: 74140

SEQ ID NO: 74207 - DNA, 201 bp, Homo sapiens; identical to SEQ ID NO: 74142

SEQ ID NO: 74208 - DNA, 201 bp, Homo sapiens; identical to SEQ ID NO: 74143

SEQ ID NO: 74209 - DNA, 201 bp, Homo sapiens; identical to SEQ ID NO: 74144

SEQ ID NO: 74210 - DNA, 201 bp, Homo sapiens; identical to SEQ ID NO: 74145

SEQ ID NO: 74211 - DNA, 201 bp, Homo sapiens
ccactgcgcccggccttccaggattctacttgtaactggcctttaccccatcctgttgtccccttgcccacccttccaggcagctggtcactgcattccargggaaggcgccaaggggaccaggtgggacccccacctttgacctgcctctgacctcaggcctctgacctgccttctgggcttcacatctgagctccagag

SEQ ID NO: 74212 - DNA, 201 bp, Homo sapiens; identical to SEQ ID NO: 74146

SEQ ID NO: 74213 - DNA, 201 bp, Homo sapiens; identical to SEQ ID NO: 74147

SEQ ID NO: 74214 - DNA, 201 bp, Homo sapiens; identical to SEQ ID NO: 74148

SEQ ID NO: 74215 - DNA, 201 bp, Homo sapiens; identical to SEQ ID NO: 74149

SEQ ID NO: 74216 - DNA, 201 bp, Homo sapiens; identical to SEQ ID NO: 74150

SEQ ID NO: 74217 - DNA, 201 bp, Homo sapiens; identical to SEQ ID NO: 74151

SEQ ID NO: 74218 - DNA, 201 bp, Homo sapiens; identical to SEQ ID NO: 74153

SEQ ID NO: 74219 - DNA, 201 bp, Homo sapiens; identical to SEQ ID NO: 74154

SEQ ID NO: 74220 - DNA, 201 bp, Homo sapiens; identical to SEQ ID NO: 74155

SEQ ID NO: 74221 - DNA, 201 bp, Homo sapiens; identical to SEQ ID NO: 74156

SEQ ID NO: 74222 - DNA, 201 bp, Homo sapiens; identical to SEQ ID NO: 74157

SEQ ID NO: 74223 - DNA, 201 bp, Homo sapiens; identical to SEQ ID NO: 74158

SEQ ID NO: 74224 - DNA, 201 bp, Homo sapiens; identical to SEQ ID NO: 74159

SEQ ID NO: 74225 - DNA, 201 bp, Homo sapiens; identical to SEQ ID NO: 74160

SEQ ID NO: 74226 - DNA, 201 bp, Homo sapiens; identical to SEQ ID NO: 74161

SEQ ID NO: 74227 - DNA, 201 bp, Homo sapiens; identical to SEQ ID NO: 74162

SEQ ID NO: 74228 - DNA, 201 bp, Homo sapiens; identical to SEQ ID NO: 74163

SEQ ID NO: 74229 - DNA, 201 bp, Homo sapiens; identical to SEQ ID NO: 74164

SEQ ID NO: 74230 - DNA, 201 bp, Homo sapiens; identical to SEQ ID NO: 74165

SEQ ID NO: 74231 - DNA, 201 bp, Homo sapiens; identical to SEQ ID NO: 74166

SEQ ID NO: 74232 - DNA, 201 bp, Homo sapiens; identical to SEQ ID NO: 74167

SEQ ID NO: 74233 - DNA, 201 bp, Homo sapiens; identical to SEQ ID NO: 74169

SEQ ID NO: 74234 - DNA, 201 bp, Homo sapiens; identical to SEQ ID NO: 74170

SEQ ID NO: 74235 - DNA, 201 bp, Homo sapiens; identical to SEQ ID NO: 74171

SEQ ID NO: 74236 - DNA, 201 bp, Homo sapiens; identical to SEQ ID NO: 74172

SEQ ID NO: 74237 - DNA, 201 bp, Homo sapiens
accatattgcccaggttggtcttgaactcctaagcttaagggatctgcctgcctcgacctcccaaagtgctgggattataggcgtgccctgctacacccgycagtaatatttctgataaagaagtatttctgggccaggtgtggtagctcacgcctgtaatcctagcactttgggaggctgaggcgggcagatcacgaggt

SEQ ID NO: 74238 - DNA, 201 bp, Homo sapiens
atcacgaggtaaggagatcgagaccatcctggttaacacggtgaaaccccatctctactaaaaatacaaaaaaaaattagccccgtctctactaaaaatamaaaaaaaaatggtggcaggtgcctgtagtcccagctactcgggaggctgaggcaggagaatggcgtgaacccagaaggcggagcttgcagtgagccgaga

SEQ ID NO: 74239 - DNA, 201 bp, Homo sapiens; identical to SEQ ID NO: 74173

SEQ ID NO: 74240 - DNA, 201 bp, Homo sapiens
acaggcgtgagccaccgcgcctggccagaatcccagttttttaacacatctaatgctttaggaatagtaaatggaaacatcatttccccttctttcgaagyacttctaccttgatgagatgtatgtattggagtacaatatttgacctagccaagaatttcacaaaagaagcccaaaatatgattttcacgtttactggac

SEQ ID NO: 74241 - DNA, 201 bp, Homo sapiens
tagctatagctcgacccttaacagctaatcaggtaaactcttcaactcagttttgaacgtaacatagtatactacagactttttgtttttgtcctcagagstaaagagaaacaatggctatatggcatactatgaggattaattttatatgtctacttgactgggccatagggtgcccaatatatggtcaaacattatttt

SEQ ID NO: 74242 - DNA, 201 bp, Homo sapiens
atggcgggcacctgtaatcccaggtactcaggaggctgatatgagagaattgcttgtatgcaggaggcagaggttgcagtgagccaagattggacacagcmagacttcatctcaaaaaaaaaaatagatctcaaggcagcagctaccatgtaaaaaaaaaaaaagataatgaatcattcatatatacattaactaattact

SEQ ID NO: 74243 - DNA, 201 bp, Homo sapiens
atttctcaaaacacttttttttcttttgctgtatttataccaagtcactttttgtttgtttgttggttggttggttggttggttggttggttggttggttkgagtcggaatctcactctgttgccgaggctggagtgcagtagagtgatcttggctcactgcaacctctgcctcccaggttcaagcgattctcctgcctca

SEQ ID NO: 74244 - DNA, 201 bp, Homo sapiens
aggagttctagaccagcctgacaaacatggcgaaacctccgtctctataaaaatacaaaaattagccaggtgtggtagcgcgtgcctgtaatcccagctaytagggaggctgaggcaggagaactgcttgaactcagggggcagagtttgcagtgagccgagatagtgccactgcactccagcctgagcaacagagtgaga

SEQ ID NO: 74245 - DNA, 201 bp, Homo sapiens
gcaagggtagaacaggcagaggtcaagtggaatgcagaatattctcaggactcaggagccaaattacgtttcaagtaactctaggaccagggcagagagayggctgttagagagaagcacgagattgaagagaaaggaaaaatgtattagatttcacttagcgtatgataagactatggtatagtgggaaaagctatgagc

SEQ ID NO: 74246 - DNA, 201 bp, Homo sapiens
atattcttggtacattttctttcttgtattgcattttatttttcctacagttaataccttccttatattttcatacgtttaattttcagtgttcatttatyaaggtttttttcctgcctaaatctgtatcagatgatcctttagtctttaaaaatctcccattttttctctcccaaagtccttcattcccttgcttcagtc

SEQ ID NO: 74247 - DNA, 201 bp, Homo sapiens
ctgaggtgggtggatagctggaacccaggaatttgagatcagcctggacaacatggcaacaccccatctctacaaaaaatttaagaactagccaggcatgrtgcacacttgtagtcccagttactggggaggcttaggtgggaggatgggttgagcacgggaggtcgaggctgcagtgtgctgtgattgcaccactgcact

SEQ ID NO: 74248 - DNA, 201 bp, Homo sapiens
aggcacgtgccaccatgcctggctaattttgtatttttagtagagacagagtttctccatgttggtcaggctggtctcgagctcttgacctcaggtagtcygcctgcctcggcctcacaaagtgctgggattacaagcatgagtcactgtgccctgccagaatttaagctttataagagatttcctgtctgtttatactta

SEQ ID NO: 74249 - DNA, 201 bp, Homo sapiens
gaaagaaagagccagttcacagtgcgcctttgtattcggcgggaaacccggccgaagagggagctggaaaggactccggaatccggccgtaattccagccmatcagggagtagagttgcggggcggggttggggcggggcagtctcgcgggagatagtttcgcgggttcgggaggcgagtctccggtttccgcccagtctc

SEQ ID NO: 74250 - DNA, 201 bp, Homo sapiens
tgtcaaaaaagattgtaggtaccttgtttaaagaaaatatataagctagtttcaagaattccaaaatattttttaaaagcagctctgtacatgtcgataarttatttgctcattgtaattttttgaatctgtttgtcaaagcaaatgtagacgggctcgaactcctgacctcaaatgatccacccgcctcagtctcccaaa

SEQ ID NO: 74251 - DNA, 201 bp, Homo sapiens
atctgtttgtcaaagcaaatgtagacgggctcgaactcctgacctcaaatgatccacccgcctcagtctcccaaatgctggtattacaggcatgagccacygctcatggcctgttatcatttttaattgaaaattttactgagataattgtagattcacttgccattataagaaataattcagagatatcacttgtatact

SEQ ID NO: 74252 - DNA, 201 bp, Homo sapiens
aaaaagcagccagtgttacttcctgggagtaaagctggcaacgatacccactaattaagcattcagatgtcccgcaagggtagaacaggcagaggtcaagwggaatgcagaatattctcaggactcaggagccaaattacgtttcaagtaactctaggaccagggcagagagatggctgttagagagaagcacgagattga

SEQ ID NO: 74253 - DNA, 201 bp, Homo sapiens
tttcttttttttctttttcttttttattttttgaggcagagttttgctctgttgcccaggctagagtgcagtggcgcgatctcggctcactgcaacctccrcctcctgggttcaagcgattctcctgcctcagcctccctagtagcttgtttcttagagacagtgtgagtgaaactcattaagtaaagtcaatacagcaca

SEQ ID NO: 74254 - DNA, 201 bp, Homo sapiens
ttcacttcttactaaatgcagcatagcatactacatcttttgagtgtgtaaaaaataaagtagtcatgtacaaacctaaaatcacagaataatcatgtaayggtgctatattttatttttactttagattcctaatacatttttattgtatctttataaggttagtttgggagaatagcactatcatcatctatattagtt

SEQ ID NO: 74255 - DNA, 201 bp, Homo sapiens
agtagattggatttctgagttctgactaggggggctccaggaagccgcaactacccactctcccggcagaaagtcaccagcagctgcgcgtttgggagcayagtcggcacaggacttttccccgaagcacaggagccagcggctacagccactaggcagtccacttgcaaacgcaggttgtgcccgggttctctttctttg

SEQ ID NO: 74256 - DNA, 201 bp, Homo sapiens
tttattagtccgctgcccacgatggacaccaccaatatcgaggttccactccctccgcagccaagcaggacaacccaacccacgtgcttagggactggccrggggatcacactactgcgcctgcgcccctgcccgcttctccccctgcagacgcggtggcgcatgcgcagttcggaaggacccgagtcccttaactaaccg

SEQ ID NO: 74257 - DNA, 201 bp, Homo sapiens
ttttaaatgataaagacaggttaataaaatgtataatattatgttgctatatccaaaaaaaggccttctttgattacactatcaaaagttacctctccatytacatccccattactatctcattaacctgttttattcatagcacttactaccatctaaaatgactttatttctttatatttttgtttgctacctgtcttt

SEQ ID NO: 74258 - DNA, 201 bp, Homo sapiens
taagttcgatataactagtcaatatactgaacagttctaacatcacaagtatccttcaggtagcccttttgtatccacatccacttccttctcatccccarctattgacaaccactaatcccttttccatttctaaaatgtgatttcaaaaatgttacatacttggctgggggcggtggctcatgcctgtaatcccagcac

SEQ ID NO: 74259 - DNA, 201 bp, Homo sapiens
gaaaccccgtctctactaaaaatacctgggcaaagtagagcatgcctggccgggcgcagtggctcatgcctgtaatcccagcactttgggaggctgagacrggtggatcaggaggtcaggagatcgagaccatcctggccaacatggtgaaaccctgtctctactaaaaatacaagaattaactgggcatggtggcacatg

SEQ ID NO: 74260 - DNA, 201 bp, Homo sapiens
ctaatacattgaacatctcttcatgtgcttattggccatgtgtatatcttctttgtagaaatacctattcatatttgttgtcccttttaaaattgggttgkctttttattgctgagttgtaagtgttctttatattttctggatactggacttttattaagtgtataatttgtaaatattttctcccaatttgtgggtcat

SEQ ID NO: 74261 - DNA, 201 bp, Homo sapiens
ggtctgtatgtctgtccttataccagcaccacactgtcttgattaatgtagctttgtagtaagttttgaaatgggtaagtgtgaaaaattccaacttaatytcatttttttcaagatcattctggctattttgggtcccttgcttttccatatgtattttaagatcagcttttccatgaacatggaatatttttccattta

SEQ ID NO: 74262 - DNA, 201 bp, Homo sapiens
tttctcaaaacacttttttttcttttgctgtatttataccaagtcactttttgtttgtttgttggttggttggttggttggttggttggttggttggttgkagtcggaatctcactctgttgccgaggctggagtgcagtagagtgatcttggctcactgcaacctctgcctcccaggttcaagcgattctcctgcctcag

SEQ ID NO: 74263 - DNA, 201 bp, Homo sapiens
agaagaatagcttgagcccgggagacagaggttgcagtgggccaaaatcatgccacggcactccagcctggccgacagactctgtctcaaaaaaaaaaaaagatttatagttttggctgggcgtggtggctcatgcctataatcccagcattttgggaggccaaggcaggtggataactttaggccaggagtttgagacca

SEQ ID NO: 74264 - DNA, 201 bp, Homo sapiens
ctttactcagattgagatattagttaaacttaagggcctgaaacaaggaaaatggggtttgcttttttctggttgtgcagagagtgtatgaataaaaagawctcacaaagttcaagtgaaagactgattaaaagaaattcatcatccaaatatcttctcagtgttaagcaagcacatgaagttagctatagctcgaccctt

SEQ ID NO: 74265 - DNA, 201 bp, Homo sapiens
cgacctcccaaagtgctgggattacaggcgtgagccaccgcacccagcctagaatttttttaaccctttatacacacacacacacacacacacacacacamttttcaaaatcaaatataccaagagtcttttattgaaaaggagcagccctcttctgtacctctcttatttcccagagggaactctttaactcttttagct

SEQ ID NO: 74266 - DNA, 201 bp, Homo sapiens
tgcaatacaatttattttcaggagattctctattttactacctcttcatagaattgcctatcatagccgggcacagtggctcacacctataatcctagcaytttgggaggctgagacaggcggatcacgaggtcaggagattgagaccatcctggccaacatggtgaaactctgtctctactaaaaatacaataattagct

SEQ ID NO: 74267 - DNA, 201 bp, Homo sapiens
tcgacctcccaaagtgctgggattacaggcgtgagccaccgcacccagcctagaatttttttaaccctttatacacacacacacacacacacacacacacacttttcaaaatcaaatataccaagagtcttttattgaaaaggagcagccctcttctgtacctctcttatttcccagagggaactctttaactcttttagc

SEQ ID NO: 74268 - DNA, 201 bp, Homo sapiens
taggttgcaatacaatttattttcaggagattctctattttactacctcttcatagaattgcctatcatagccgggcacagtggctcacacctataatccyagcattttgggaggctgagacaggcggatcacgaggtcaggagattgagaccatcctggccaacatggtgaaactctgtctctactaaaaatacaataat

SEQ ID NO: 74269 - DNA, 201 bp, Homo sapiens
tgcctaggctggagtgcaatggcgcgatcttggctcactgcaatctctgcctcccgagctcaagcgattctcctgcctcagtctcctgagtagctgggatwacaggcatgcgccaccacacctgtctaattttgtatttttagtagtgacagtgtttctccatgttgttcaggctggtctcgaactcccgacctcagatga

SEQ ID NO: 74270 - DNA, 201 bp, Homo sapiens
ctcccgagagacagaggttgcagtgagccgagatcgcgccattgcactccagcccgggggaccagagcgagtcttcctctcaaaaaaaaaaaaaaaaaaaattgagatgatttaaagtgtacaggaggatgtgaataggttagatacaagcacaataccattttgtatcaaagacttgagtattcataaattttggcatct

SEQ ID NO: 74271 - DNA, 201 bp, Homo sapiens
ggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgattac

SEQ ID NO: 74272 - DNA, 201 bp, Homo sapiens
aggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgatta

SEQ ID NO: 74273 - DNA, 201 bp, Homo sapiens
gaggttgcaatgggccgacatctcaccactacactctagcccgggcaacaaatcaagactgtctctttttttttttttttttgagacgaagtctcgctcastcgcccaggctagagcgcagtggcgcaatctcggctcactgcaagctccgcctcccaggttcacgccattctcctgcctcagcctcccaagtagctggga

SEQ ID NO: 74274 - DNA, 201 bp, Homo sapiens
tggcggaaatgattggcggaaagaaagagccagttcacagtgcgcctttgtattcggcgggaaacccggccgaagagggagctggaaaggactccggaatscggccgtaattccagccaatcagggagtagagttgcggggcggggttggggcggggcagtctcgcgggagatagtttcgcgggttcgggaggcgagtctc

SEQ ID NO: 74275 - DNA, 201 bp, Homo sapiens
gcgaattcttcctgcctgatggccttcaaaatgggacatcagctctttttcctgcctttggactcaaaccattggctcttcctgggtcttgagcctgctgrcctttggactggagctacactatcagctctcttgattttcaggccttcaaacttagactcaaactacattattggctcccctgggtctcccagatcccag

SEQ ID NO: 74276 - DNA, 201 bp, Homo sapiens
gcgcccggcctatttcttcttctctttgtttagttattatctattactctcattcctatgaacataacttgtttctccccacttaatttttatcatacatrattgtagacagtgggcactgtcttcaattatagtgaatttagcagtaaattcacattagaccaacttgtatagctttaaaaaatatatttatgtctaggt

SEQ ID NO: 74277 - DNA, 201 bp, Homo sapiens
aggaggctgtgagagagaggatttgggaaattggtgcaaatgagaaatcttggaaatctgtaagtatatagatataaaagttattctttccagtttgattyttttatgatgtagattttaatatcagtcaatttaggaaactctgtggctctgaattatagttataattctagttttactattacagtgaaagaagagaag

SEQ ID NO: 74278 - DNA, 201 bp, Homo sapiens
gattacaggtgtgagccactgcgcccggcctatttcttcttctctttgtttagttattatctattactctcattcctatgaacataacttgtttctccccmcttaatttttatcatacataattgtagacagtgggcactgtcttcaattatagtgaatttagcagtaaattcacattagaccaacttgtatagctttaaa

SEQ ID NO: 74279 - DNA, 201 bp, Homo sapiens
gttgttgttttgagatggtgtcttgctctgtctcccaggctggagtgcaatggcgtgatctcagctcactgcaacctccgcctcccgggttcaagcgattytcctgcctcagcctcctgagtagctgggactacaggcgcctgccaccacgcccagctaatttttatacttttaatagagacagggtttcaccatattggc

SEQ ID NO: 74280 - DNA, 201 bp, Homo sapiens
tgagatgtatgtattggagtacaatatttgacctagccaagaatttcacaaaagaagcccaaaatatgattttcacgtttactggactgttcacttttggkgggatcactttcttaagattacttaaagtactaatgcttgatgaaaatcatttgtgttttcacttcattaattggagaaagagctacatgtttttgttgt

SEQ ID NO: 74281 - DNA, 201 bp, Homo sapiens
gaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgatt

SEQ ID NO: 74282 - DNA, 201 bp, Homo sapiens
tgcactccaacctaggcaacagagcaagaccctgtctcttaaaaggaaaggagagtccagtgtgttctaaggaaaaccccaagagcatcccaccttagaakacaagtgaggaggcctggcatggtgtctcatgcctgtaatcccagcactttgggaggccaaggtgggtggatcacttgaggtcaggagttctagaccagc

SEQ ID NO: 74283 - DNA, 201 bp, Homo sapiens
ggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgat

SEQ ID NO: 74284 - DNA, 201 bp, Homo sapiens
aggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatga

SEQ ID NO: 74285 - DNA, 201 bp, Homo sapiens
ctaacaatttgggaggccaaggcaggaggatcgcttgaggccaggagttcgagactagcctggggaacatagtgagaccctgtctctacaaaaaaaaaaaagaaaaaattagctgggtgtggtagtgcacacctgtggtcccagctactcaggaggccaagttgggaggattgcttgagcccaggaggtggaggctacagt

SEQ ID NO: 74286 - DNA, 201 bp, Homo sapiens
tcagctcccgaggttgaaggtggcaagaaggtggtaagaatcctagacaggctaggcctggtggctcacgcctataatcctaacaatttgggaggccaagrcaggaggatcgcttgaggccaggagttcgagactagcctggggaacatagtgagaccctgtctctacaaaaaaaaaaaagaaaaaattagctgggtgtgg

SEQ ID NO: 74287 - DNA, 201 bp, Homo sapiens
gaacctgggagacggaggttgcagtgagctgaggttgtgccattgcactccagcctgggagacagagcaagactccatctcaaaaaaaaaaaaaaaaaaawgtcactaatctctaagatctctgaataactctctcagaattagagtccatacagctctgatcttttcttcttttatgctgcttgtttttccaaggctttt

SEQ ID NO: 74288 - DNA, 201 bp, Homo sapiens
agaggcaggtggatcacctgaagtcaggagtttgagaccagcctggccaacatggcaaaaccccacctctactaaaaatacaaaaaaattagctgggcacrgtggcaggtgcctgtaatctcatctactagggaagctgaagcaggggaatcgcttgaacctgggagacggaggttgcagtgagctgaggttgtgccattg

SEQ ID NO: 74289 - DNA, 201 bp, Homo sapiens
agccactgcaccaggcccatttctctaccatttctgatctctctctagaaacacttggataactgcacagctcctttcataagaaatatattttagggccrggtgtggtggcttatgcctgtaatctcagcactttgggaggccgcggcaggtggatcaaccgaggtcaggagttcaagaccagcctggccaagatggtga

SEQ ID NO: 74290 - DNA, 201 bp, Homo sapiens
tgggcaataagggcgaaactccatctcaaaaaaaagaaagaaatccttagactataagtttgttatataatctgcatgtaaaacaaggtcctatatgactyaaataatgtgcagggttccctttaaaaagttcagcaactactttcctttttttttttttgagatggagtctcactctgtcacccaggctggagtgggttg

SEQ ID NO: 74291 - DNA, 201 bp, Homo sapiens
tctttctttttttttccttttttccgaggtggagtttctctctttttgcccaggctggagtgcactggtgcaatcttggctcaccacaacctctgtctccygggttcaagcaattctcctgcctcagcctcccgagtagctgggattacaggcatgcgccaccacgccaggctaattttgtatttttagtagagacggtgt

SEQ ID NO: 74292 - DNA, 201 bp, Homo sapiens
aaataggtaggttgcaatacaatttattttcaggagattctctattttactacctcttcatagaattgcctatcatagccgggcacagtggctcacacctrtaatcctagcattttgggaggctgagacaggcggatcacgaggtcaggagattgagaccatcctggccaacatggtgaaactctgtctctactaaaaata

SEQ ID NO: 74293 - DNA, 201 bp, Homo sapiens
gtatgggagaccagagttttattattactcaaatcagtatccacaagcattccgccttcagaatttttaaggacaacatgttgggtgggaggaagccagtragctgggagtgctgattggtcagagctgaaatcatagggaatggaagctgtcttcttgagctgagtcaattcctgggtggggactgcaagatcagatgag

SEQ ID NO: 74294 - DNA, 201 bp, Homo sapiens
agaaataggtaggttgcaatacaatttattttcaggagattctctattttactacctcttcatagaattgcctatcatagccgggcacagtggctcacacmtataatcctagcattttgggaggctgagacaggcggatcacgaggtcaggagattgagaccatcctggccaacatggtgaaactctgtctctactaaaaa

SEQ ID NO: 74295 - DNA, 201 bp, Homo sapiens
ctgggtgcggtggctcacatctgtaatcccagcactttgggaagccgaggcgggtggatcacctgaggtcaggagttcgagaccagcctgaccaacacggkgaaaccctgtctctactaaatacaaaaattagccaggtatggtggtgggcacctgtaattccagctacttaggaggctgaggaaggagaatcgcttgaac

SEQ ID NO: 74296 - DNA, 201 bp, Homo sapiens
tacagcatggcagactagaagcatttctgtttttttgttttgttttgtttgagatgaagtctcgctctgttgccgaggctggagtgcagtggagtgatctytgctcactgcaagctccgcctcctgggttcaagtgattctcctgcctcagcctccaaagtatctgggattacaggcatgtgccaccacgcccggctaatt

SEQ ID NO: 74297 - DNA, 201 bp, Homo sapiens
cagaatttttaaggacaacatgttgggtgggaggaagccagtaagctgggagtgctgattggtcagagctgaaatcatagggaatggaagctgtcttcttragctgagtcaattcctgggtggggactgcaagatcagatgagtcaggttatcaatctacgtggtgccagctgacccatcaaatgcagggtctgcaaaata

SEQ ID NO: 74298 - DNA, 201 bp, Homo sapiens
agagcgagattctgtctcaaaaaaaaaaaaaaaaattagagcatgcctataatctgagctactcaggaggctgagacacgagaatcacttgaacccagggmggcggaggtgcagtgagcagcgatcacaccactgcattccagcctgggcgacagagtgagactccctctcaaaaaacaaacaaacaaacaaacaaaaact

SEQ ID NO: 74299 - DNA, 201 bp, Homo sapiens
taaccctcccccaggtaagagcgaattcttcctgcctgatggccttcaaaatgggacatcagctctttttcctgcctttggactcaaaccattggctcttsctgggtcttgagcctgctggcctttggactggagctacactatcagctctcttgattttcaggccttcaaacttagactcaaactacattattggctccc

SEQ ID NO: 74300 - DNA, 201 bp, Homo sapiens
ggacttttattaagtgtataatttgtaaatattttctcccaatttgtgggtcatctttccactttcctaaaagtgtcatttcaagcaaaaattttaatttkgatggagttgtgtgtgtgtgtgtgtgtgtatgtgtatgtgtgtctttggtgtcatagctgagaaattattgtcaaatccaggatcatgaaagatttacat

SEQ ID NO: 74301 - DNA, 201 bp, Homo sapiens
ttcaaaatgggacatcagctctttttcctgcctttggactcaaaccattggctcttcctgggtcttgagcctgctggcctttggactggagctacactatyagctctcttgattttcaggccttcaaacttagactcaaactacattattggctcccctgggtctcccagatcccagcagatcttgggaattgccagcctt

SEQ ID NO: 74302 - DNA, 201 bp, Homo sapiens
aaatgctgggattacaggcgtgagccaccacgccaggccagaaacatatttttaaaaatcttgttttagaggaaaaacagagtatttctttttttttttttattagatggattctcactctattgcccaggctggagtacagtggcacaatcttggctcaccgcaacctcagcctcccgggttcaagcaattctcctgcct

SEQ ID NO: 74303 - DNA, 201 bp, Homo sapiens
ggaactgagggttccttctttttttagactgtatagggtaacttcctgatgttgccatggtatttataaactgtcatggccctagtgggagagtcttttarcatgctaatgcattataattagtgtataatgagcactgaggacaaccagaggtcacctttgtcaccatcttggttttggtaggtttgggctatctttatc

SEQ ID NO: 74304 - DNA, 201 bp, Homo sapiens
cgagtagctgggattacaggcaccacctaattagcccgccaccacgcccggctaatttttgtatttttagtagagacggggtttcaccatcttggctaggmtggtcttgaactcctgacctcgtgatccacccgcctcggcctcccagagtgctgggattacaggcgtgagccaccgcacctggcctaaaactgatttttt

SEQ ID NO: 74305 - DNA, 201 bp, Homo sapiens
gaggcagaggttgcagtgagccaagattggacacagcaagacttcatctcaaaaaaaaaaatagatctcaaggcagcagctaccatgtaaaaaaaaaaaaagataatgaatcattcatatatacattaactaattactgattattaatacaacatatatcgaatacttattatgtgccaggaagaattataaatgatcatc

SEQ ID NO: 74306 - DNA, 201 bp, Homo sapiens
ttgcttgaaccagggaatcaggttgcagtgagctgagatcatgccactgcattgcaatctggcgacagagcgagattctgtctcaaaaaaaaaaaaaaaaattagagcatgcctataatctgagctactcaggaggctgagacacgagaatcacttgaacccagggcggcggaggtgcagtgagcagcgatcacaccactg

SEQ ID NO: 74307 - DNA, 201 bp, Homo sapiens
ctctactaaaaatacctgggcaaagtagagcatgcctggccgggcgcagtggctcatgcctgtaatcccagcactttgggaggctgagacaggtggatcakgaggtcaggagatcgagaccatcctggccaacatggtgaaaccctgtctctactaaaaatacaagaattaactgggcatggtggcacatgcctgtaattc

SEQ ID NO: 74308 - DNA, 201 bp, Homo sapiens
ttgtgatctgcccacctcggcctcccaaagtgctgggattacaggtgtgagccactgcgcccggcctatttcttcttctctttgtttagttattatctatwactctcattcctatgaacataacttgtttctccccacttaatttttatcatacataattgtagacagtgggcactgtcttcaattatagtgaatttagca

SEQ ID NO: 74309 - DNA, 201 bp, Homo sapiens
agcttgcacgtgggaggcggaggttgcagtgagccgagatcctgtcactgcactccagcctgggcgacaaagcgagactctcaaaaaaaaaaaaaaaaaargcacgtaataaatcaaatatgcattatgtaatcacaaaatccagcttaacaactaaataataatttaaaagatattaaaaacttaatatggaagaaaaat

SEQ ID NO: 74310 - DNA, 201 bp, Homo sapiens
ttgcatttctcaaaacacttttttttcttttgctgtatttataccaagtcactttttgtttgtttgttggttggttggttggttggttggttggttggttkgttggagtcggaatctcactctgttgccgaggctggagtgcagtagagtgatcttggctcactgcaacctctgcctcccaggttcaagcgattctcctgc

SEQ ID NO: 74311 - DNA, 201 bp, Homo sapiens
gtctcactctgtcacccaggctggagtgggttggtgcaatcttggctcactgaaacctctgcctcctgggctcaagccatcttctcacctcagcatcctcrgtaatttagttgggactactggcgtgcgccaccatgcccggctaattttcctgtattttgtggagagacggggtttcaccatgttgcccaggcttgtctc

SEQ ID NO: 74312 - DNA, 201 bp, Homo sapiens
ctgggtgacagagcaactaactaactaactaactaaaactacagttagtttatatatagtttttagttaaaactatagttagtttgagccaggcgcggtgsctcacgcctgtaatcccagcactttgggaggccgaggcgggcggatcacgagaataaggagatcgagaccatcctggctaacaaggtgaaaccccgtctc

SEQ ID NO: 74313 - DNA, 201 bp, Homo sapiens
ggaactatgcacagaactttacagaacaggggcgatgctttaactgaaggctgactactgaccagagaatggaattctgagagggctcaaggaataaaagraaactaggcagggaaagggaaggcgcccatctgaagcaaacttcagcggccatcaggatatcttgtggtggtcacaagttgtaggctctgtttttggaag

SEQ ID NO: 74314 - DNA, 201 bp, Homo sapiens
gagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaacc

SEQ ID NO: 74315 - DNA, 201 bp, Homo sapiens
ttgggacagggtcttgctgtgttgcccaggctggtttctaactcctgggctcaagcgatccactggcctcagcctcctgaagtgctgggattacaggagtsagccactgcaccaggcccatttctctaccatttctgatctctctctagaaacacttggataactgcacagctcctttcataagaaatatattttagggcc

SEQ ID NO: 74316 - DNA, 201 bp, Homo sapiens
ggagaattgcttgaacccaggaggcagaggtggcagtgaattgagatcatgccactacacttcagcccgggtgatagaacgagactctgtctcaaaataayaataataataataataataataataataatagctggacatggtggtgcacacctgtagtcccagctacgtggaaggctgaagcaggagaattgcttgaac

SEQ ID NO: 74317 - DNA, 201 bp, Homo sapiens
gggagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaa

SEQ ID NO: 74318 - DNA, 201 bp, Homo sapiens
cacggcactccagcctggccgacagactctgtctcaaaaaaaaaaaaagatttatagttttggctgggcgtggtggctcatgcctataatcccagcatttkgggaggccaaggcaggtggataactttaggccaggagtttgagaccagccgggctgacataacaaaacctgatctctactaaaagtacaaaacttaggct

SEQ ID NO: 74319 - DNA, 201 bp, Homo sapiens
aggaggctgaggcaggagaatagcttaaatccaggaggcggaggttgtggtgagctgagatcatgccattgcactccagcctgagcagcaagagtgaaackctgtctcaaaaaaaaaaaaaaaaaaaaaaaaaagatttaatgattgacctgctggattttgaacttgcatggggcctatagcctctttcttttggccaaa

SEQ ID NO: 74320 - DNA, 201 bp, Homo sapiens
caggaggctgaggcaggagaatagcttaaatccaggaggcggaggttgtggtgagctgagatcatgccattgcactccagcctgagcagcaagagtgaaaytctgtctcaaaaaaaaaaaaaaaaaaaaaaaaaagatttaatgattgacctgctggattttgaacttgcatggggcctatagcctctttcttttggccaa

SEQ ID NO: 74321 - DNA, 201 bp, Homo sapiens
atgatacctttgagagatgtcttacatttgtcttttctttcagcaaaatgtgatgccagtccctgaaatgtgtagcaatttaattatgggtagcattcttytttccctgtacttactatagtattaacttactactaatgctaagaagtttataatttttgataattcagatttggattagattaagatttatgtctatgc

SEQ ID NO: 74322 - DNA, 201 bp, Homo sapiens
gactctgtctaaaaaaaaaaaatccaatttgagatataacttacatacctcaagattcagttaaagtgtacaattcaatggttgtacaatcatcaccactrtctaatttcagaacaatttcatcacacctccccaccccccactgcaaaaaaaaacccatgcccggctgggcacggtggctcatgcctgagatcccagcac

SEQ ID NO: 74323 - DNA, 201 bp, Homo sapiens
tgaacttatactggaggatttatatgttcatccttcttggtttatattttgtcccacacggtagcttgtttcttttttcttttttttctttttcttttttwttttttgaggcagagttttgctctgttgcccaggctagagtgcagtggcgcgatctcggctcactgcaacctccacctcctgggttcaagcgattctcct

SEQ ID NO: 74324 - DNA, 201 bp, Homo sapiens
tagcttaaacccaggagacgaaggttgcagtgagccaagattacaccattgcactccagcctgagcaacaaaagcgaaactccatctcaaaaaaacaaaarctaaaactaaacaaaacaaaaaaaccatgtgtaaaactgttaatcacaacactgatttcaatagcaaaaaacaaaatttctgtcaggatggatgcagttg

SEQ ID NO: 74325 - DNA, 201 bp, Homo sapiens
catctctactaaaaatacaaaaattagctgggcgtggtggccagcccctgtaatcccagctactcgggaggctgaggcaggaggatagcttaaacccaggrgacgaaggttgcagtgagccaagattacaccattgcactccagcctgagcaacaaaagcgaaactccatctcaaaaaaacaaaaactaaaactaaacaaa

SEQ ID NO: 74326 - DNA, 201 bp, Homo sapiens
ttctgagtagttgggactataggcacatgccaccacccctgattaattaaaaaattttcctgtagagatagtcttgctatgttgcccagactggtctccarctcctggcctcaaaccatcctcccaccttgaccttccaaaacgttgggattacaggcgtgagccacctctcccagtttaggaatttatcttaaagtaata

SEQ ID NO: 74327 - DNA, 201 bp, Homo sapiens
ggagtgcagtaacacaatcagctcactgcaaccctgaactcctgggctaaagtgatccttctgagtagttgggactataggcacatgccaccacccctgaytaattaaaaaattttcctgtagagatagtcttgctatgttgcccagactggtctccaactcctggcctcaaaccatcctcccaccttgaccttccaaaac

SEQ ID NO: 74328 - DNA, 201 bp, Homo sapiens
ttgaacctgggagacggaggttgcagtgagctgaggttgtgccattgcactccagcctgggagacagagcaagactccatctcaaaaaaaaaaaaaaaaawaagtcactaatctctaagatctctgaataactctctcagaattagagtccatacagctctgatcttttcttcttttatgctgcttgtttttccaaggctt

SEQ ID NO: 74329 - DNA, 201 bp, Homo sapiens
ccatacctggcccgaaaattttaaatttgtattttctttgacattgtaattccacttccaggattttttttttttggacaggattttactctgtcacccasgctggagtgcagtaacacaatcagctcactgcaaccctgaactcctgggctaaagtgatccttctgagtagttgggactataggcacatgccaccacccc

SEQ ID NO: 74330 - DNA, 201 bp, Homo sapiens
actacaggtgcatgccaccatgcctggctaatttttgtgctttttcgtgtataaagatgagatttcgccatgttgcccaggctggtctcaaactcctgggmtcaagagatctgtccacctcagcctcctaaagcgctgagattacaggcatgagccaccacgtccagcctagagatatttatactttaatagctgcctgca

SEQ ID NO: 74331 - DNA, 201 bp, Homo sapiens
tccagaccccaagagcaggttactggatcttgcacaggaaataattcaagggaagtcacacagcacagagaaaaagcaagttcatacaatgttactgagtwagttatcgccagaaagcaggaggaggaacacgccatccttgttagtgtctctatttataagaaacttatgagaagctataattaaacttggaacatgcag

SEQ ID NO: 74332 - DNA, 201 bp, Homo sapiens
acttgccattataagaaataattcagagatatcacttgtatacttagcccagtgtcccccaaaggtaaaattttgcaaaattatagtctaatgtaacagcrtgaatattgacattaatacaatccactgagtttattcagatttccccagttttacttgtattcaattgtgtgtttgtgtattaagttcgatataactagt

SEQ ID NO: 74333 - DNA, 201 bp, Homo sapiens
gtgacagagctagaccctgtctgaaaaaaaaaaaaaatgttagtagcagcagagcacagtggctcatgcctgtaatcccaacactatgggagtctgaggcrggaggatctcttgagcttaggagttcaagaccagcctgacaacatagtaagactccatctctacaaataatcattaaaaaaattagccgggcgtagtggc

SEQ ID NO: 74334 - DNA, 201 bp, Homo sapiens
ccagcaaacactcgcagcacctactcaaaccatctgcctcttcacaaccagtctctttagaaaggagacttaatcaagaaaaatgccaccaatggagagarcaggcttaattatagcaaactaagggaaggaaaaaccaaacaaatcatataaatgtagtaagcccccctttgaaaggcccacttatagaacaactatgct

SEQ ID NO: 74335 - DNA, 201 bp, Homo sapiens
tgcatgacccagtgatgcacagaggaggcagcaccgtgcttaggctctggagctaccatccacagcgagcttacaaatatacccaacttgccctgcacttsgccagcaaacactcgcagcacctactcaaaccatctgcctcttcacaaccagtctctttagaaaggagacttaatcaagaaaaatgccaccaatggagag

SEQ ID NO: 74336 - DNA, 201 bp, Homo sapiens
ttggaacatgcagatgtgctcactaaaggtaggggctattggtgttatagatgaccattaatctttcaacctaagcctgctcattaatggcatctttaatraagtgggctacactcttaggacatctggacattctgcaggattggtgggagatgttctgtatggccaccaatattctgtaattataattggtggtcagct

SEQ ID NO: 74337 - DNA, 201 bp, Homo sapiens
ccaccatgcccagctaattttgtatttttagtagagatggggtttcaccatgttagtcaggctggtctccaactcctgatctcaggtgatcctcctgcctsggcctcccaaagtcctaggattacaggcatgagccaccacgccctgcccagacaaatctttttaagcacaaaagggcctacatgtatttaatctacagga

SEQ ID NO: 74338 - DNA, 201 bp, Homo sapiens
tattttctcccaatttgtgggtcatctttccactttcctaaaagtgtcatttcaagcaaaaattttaattttgatggagttgtgtgtgtgtgtgtgtgtgkatgtgtatgtgtgtctttggtgtcatagctgagaaattattgtcaaatccaggatcatgaaagatttacatctatattttcttttaagagttatagtttt

SEQ ID NO: 74339 - DNA, 201 bp, Homo sapiens
gagtgagttaccatgagatctggttgtttaaaagtgtgtagcacctctcacctcactctattccttctgctctggccatgtaagatgtgcctgcttccccytcaccttctgccatgattgtaagtttcctgaggcttccctagccatgcttcccatgcagcctgtggaactgtgagccaattaaacctcttttctttgtaa

SEQ ID NO: 74340 - DNA, 201 bp, Homo sapiens
cgggaaacccggccgaagagggagctggaaaggactccggaatccggccgtaattccagccaatcagggagtagagttgcggggcggggttggggcggggmagtctcgcgggagatagtttcgcgggttcgggaggcgagtctccggtttccgcccagtctctggggacgcggtggcggggtctgaatcgcctggcttcca

SEQ ID NO: 74341 - DNA, 201 bp, Homo sapiens
caaagtgctgggattacaggcatgagccaccgtgcccagcccgaagttactaacttgttttggattttacgggctcacaggcagaagggacttgccttgtytcagatgagactttgttctttgggcttttgagttaatgctggaatgagttagaactttgggggaactgttgggaaggcagattgtattttgaaatgtgag

SEQ ID NO: 74342 - DNA, 201 bp, Homo sapiens
ccaacatggcgaaaccccatctctactaactacaggcaggtgcctgtaatcccagctactcaggaggctgaggcaggagaatagcttaaatccaggaggckgaggttgtggtgagctgagatcatgccattgcactccagcctgagcagcaagagtgaaactctgtctcaaaaaaaaaaaaaaaaaaaaaaaaaagattta

SEQ ID NO: 74343 - DNA, 201 bp, Homo sapiens
actccatctctacaaataatcattaaaaaaattagccgggcgtagtggcacctacctgtagtcccagctactggggaggctgagatgggaggatcacctgrgcctgggaggtcaaggctgcagtgagctgtgatcgccattgtactccaaactgggtgacaagagtgagaccatgcctcaaaaataataataataaatgta

SEQ ID NO: 74344 - DNA, 201 bp, Homo sapiens
cactaatcccttttccatttctaaaatgtgatttcaaaaatgttacatacttggctgggggcggtggctcatgcctgtaatcccagcactttggatatackgtctctactaaaaatacaaaaattagctgggagtggttgtgcacacctgtaatcccaggtgcttgggaagctgaggcaggagaattgcttgaacccagga

SEQ ID NO: 74345 - DNA, 201 bp, Homo sapiens
ctcatccccaactattgacaaccactaatcccttttccatttctaaaatgtgatttcaaaaatgttacatacttggctgggggcggtggctcatgcctgtwatcccagcactttggatatacggtctctactaaaaatacaaaaattagctgggagtggttgtgcacacctgtaatcccaggtgcttgggaagctgaggca

SEQ ID NO: 74346 - DNA, 201 bp, Homo sapiens
ctctactaaaaatacaaaaattagccggacggggtggcacacacctgtagtctcagctactcgggaggctgaggcaggagaatcgcttgaacctgggaggyggaggttgcagtgagccaagatcatgccattgcactccagcctgggcaacaagagtgaaactctgtctcaaacaaacaaacaaactagctggacatggtg

SEQ ID NO: 74347 - DNA, 201 bp, Homo sapiens
attttgggcctgtttgattttttgggagacaccacccagcagaaacacaccgcacttacatgcaacccctccattgcacagtttctaaatgcccccccccytttttttccattctctgatcctaaaaaaagaaatccagtggcacaatcacggatctctgcagccttgatctcttagcctcaagtgattctcctgcctcag

SEQ ID NO: 74348 - DNA, 201 bp, Homo sapiens
aataagaataatatttgagaaactcacacaatatgaaaagctattctattcagatgtgcacactactgtagcctatttctattttgtattggttagtatgyatcaggtcatctcataggttggggctcttctgagtcttgcatttctcaaaacacttttttttcttttgctgtatttataccaagtcactttttgtttgtt

SEQ ID NO: 74349 - DNA, 201 bp, Homo sapiens
tcttttgctgtatttataccaagtcactttttgtttgtttgttggttggttggttggttggttggttggttggttggttggagtcggaatctcactctgtygccgaggctggagtgcagtagagtgatcttggctcactgcaacctctgcctcccaggttcaagcgattctcctgcctcagcctcccaagtagctgggacg

SEQ ID NO: 74350 - DNA, 201 bp, Homo sapiens
agagaaatgtagggtagaataaggagtaaagaaagggtaaatagaaattaatactgacaattaatttttaaaaatcctatacaatttataatatatgaaaragtaaaacatatcagtagtacaagggcaagaaatggtaaatggagttaagctatcataagtgttttatttagggagtatcacaaaagtattaaagtagaa

SEQ ID NO: 74351 - DNA, 201 bp, Homo sapiens
tgcacgtgggaggcggaggttgcagtgagccgagatcctgtcactgcactccagcctgggcgacaaagcgagactctcaaaaaaaaaaaaaaaaaaagcaygtaataaatcaaatatgcattatgtaatcacaaaatccagcttaacaactaaataataatttaaaagatattaaaaacttaatatggaagaaaaatgaaa

SEQ ID NO: 74352 - DNA, 201 bp, Homo sapiens
ccactccctccgcagccaagcaggacaacccaacccacgtgcttagggactggccaggggatcacactactgcgcctgcgcccctgcccgcttctcccccygcagacgcggtggcgcatgcgcagttcggaaggacccgagtcccttaactaaccgagagctaacaggtcggggactgcgggacggaagagggaggggaag

SEQ ID NO: 74353 - DNA, 201 bp, Homo sapiens
tcttgtagcctccagctgcaagactcctaaaccataatttctaatcttgtggttaatgttagtcctaccaaggcaatctagtctccaggcaagaaggaggkctgctttgggaaagggctgtcatctttgttttaaactataaactataaagtaagtttctcccaaagttagttcagcctacacccaggaatgcacaaggac

SEQ ID NO: 74354 - DNA, 201 bp, Homo sapiens
ccacatccacttccttctcatccccaactattgacaaccactaatcccttttccatttctaaaatgtgatttcaaaaatgttacatacttggctgggggcrgtggctcatgcctgtaatcccagcactttggatatacggtctctactaaaaatacaaaaattagctgggagtggttgtgcacacctgtaatcccaggtgc

SEQ ID NO: 74355 - DNA, 201 bp, Homo sapiens
tttacatgataacctaaaattaattgccagtttgttttaatttactggtcaagtctatcaaatgattgaatcagcatgtttaagtggatatatctcatttrtgtccagatcattttagtatattcatgactcctcactttaaaattcaaatgataataggtacagttagtcctccatatctgtggattcaaccaagtaaaa

SEQ ID NO: 74356 - DNA, 201 bp, Homo sapiens
tttcaaaaatgctgatttttaaaatttctatcatttcttatacacttattagctcacatttttctgtaatgagtttacccttatcaagtgggactctttgkttagctgctcctctaagctaattttcttgtattctcaaagcagtttctccatactatcatttcaatacctcttgctgttctagtttgctgttttgagtat

SEQ ID NO: 74357 - DNA, 201 bp, Homo sapiens
gacgctagggacgcctgtatatggcttagattcagtgtgttagtgaaacctgctacacagtagcctgtttagagttccccatttttaaaaatactctgctyttttaaaattcattatacagccttatttctcagtactgactaaaatgtcttatttttatatatcgaagctttctatttattttttaaaccaatgtataca

SEQ ID NO: 74358 - DNA, 201 bp, Homo sapiens
atttcaaaaatgctgatttttaaaatttctatcatttcttatacacttattagctcacatttttctgtaatgagtttacccttatcaagtgggactctttkgttagctgctcctctaagctaattttcttgtattctcaaagcagtttctccatactatcatttcaatacctcttgctgttctagtttgctgttttgagta

SEQ ID NO: 74359 - DNA, 201 bp, Homo sapiens
gtccatacagctctgatcttttcttcttttatgctgcttgtttttccaaggcttttagtgatgcaaacttatcattactttaacaattccagctttccttytatgtcttggttttacacgacaagaagcccagaaactgaacttgcttactcagctcccgaggttgaaggtggcaagaaggtggtaagaatcctagacagg

SEQ ID NO: 74360 - DNA, 201 bp, Homo sapiens
ttctggtaaattgcagatagtgaatcttttgtcttatactatcaaataggtattgactattccagctttcttatttgttgaggaagatggcagaaatcccrttttacagagggatagactttgaaggataatacccaaagctgcatagctgtggctggtataggccccaaacctgatgtttcttctctaaatctactgcct

SEQ ID NO: 74361 - DNA, 201 bp, Homo sapiens
gaaactcattaagtaaagtcaatacagcacaagtttcataaaatggtaaagaaatagaaataaaagtaaaggatgaaattcttaagaactttgtcaggccrggcgtggtggctcatgcctgtaatcccagcactttgggaggccgaggtgggtggatcacctgaggtcaggagtttgagaccagcctggccaacatggcaa

SEQ ID NO: 74362 - DNA, 201 bp, Homo sapiens
tccattctctgatcctaaaaaaagaaatccagtggcacaatcacggatctctgcagccttgatctcttagcctcaagtgattctcctgcctcagcttcctragtagctgggaccacaggtgcttgccaccatgcccagctatttttttttctttgtttttttgtaaagatgtgtctcactatcttgcccaggctgatattg

SEQ ID NO: 74363 - DNA, 201 bp, Homo sapiens
gtgtcttgctctgtctcccaggctggagtgcaatggcgtgatctcagctcactgcaacctccgcctcccgggttcaagcgattctcctgcctcagcctccygagtagctgggactacaggcgcctgccaccacgcccagctaatttttatacttttaatagagacagggtttcaccatattggccaggatggtctcaatct

SEQ ID NO: 74364 - DNA, 201 bp, Homo sapiens
tcattttgggcctgtttgattttttgggagacaccacccagcagaaacacaccgcacttacatgcaacccctccattgcacagtttctaaatgcccccccscctttttttccattctctgatcctaaaaaaagaaatccagtggcacaatcacggatctctgcagccttgatctcttagcctcaagtgattctcctgcctc

SEQ ID NO: 74365 - DNA, 201 bp, Homo sapiens
aaattagccaggcatggtggcacgtgcctgtagtcccagctactcaagaggctgaggcaggagaatcctttgaacccgggaggcagaggttgcagtgagcygatattgcagcactgcactccagcctgggtgacagatcaaaactctgtctcagaaaaaaaaaaaaaaaaaaaaagaatttcctagaattagaatcgcagg

SEQ ID NO: 74366 - DNA, 201 bp, Homo sapiens
cttgaacccaggaggcggaggttgcagtgagccgagatcacatcattccactccagcctgggtgccaagagcaaaaaactccatcttgaaaaataaagaaytttgtctccagtatcattcttgttctaggactgagaaacagttcattcttcattttcgtctactaaaatttaagttctttgattttcttctttaggtctt

SEQ ID NO: 74367 - DNA, 201 bp, Homo sapiens
caaatttgggacatactttttctgctgtaaaaatattttcctaaggccaggcgcagtggctcacgcctgtaatcctagcactttgggagacggaggcggcrgatcacttgaggccaggagttcaagaccagtctggccaacatggtgaaacccagtctctactaaaaatagaaaaaattagccaggcatggtggcacgtgc

SEQ ID NO: 74368 - DNA, 201 bp, Homo sapiens
tcagcctcccgggttcaagcaattctcctgcctcagcctcccgagtagttggaactataggcgtgagccaccatgccctgctaatttttgtatttttagtrcagatggggtttcactatgttggccaggctggtctcgaactcctgaccttgtgatctgcccacctcggcctcccaaagtgctgggattacaggtgtgagc

SEQ ID NO: 74369 - DNA, 201 bp, Homo sapiens
cctgcctcagcctcccaagtagctgggattacaggcatgtgccaccatgcccagctaatttttgcatttttagtacagcagggtttcaccatgttggtcargctggtctcaaactcctgacctcaggagatccgtcagccttggcctcccaaagtgttgggattacaggcgtgagccacagcacccagccagaatttaaac

SEQ ID NO: 74370 - DNA, 201 bp, Homo sapiens
gggttcaatcaatcctcctgcctcagcctcccaagtagctgggattacaggcatgtgccaccatgcccagctaatttttgcatttttagtacagcagggtktcaccatgttggtcaggctggtctcaaactcctgacctcaggagatccgtcagccttggcctcccaaagtgttgggattacaggcgtgagccacagcacc

SEQ ID NO: 74371 - DNA, 201 bp, Homo sapiens
ctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcctc

SEQ ID NO: 74372 - DNA, 201 bp, Homo sapiens
tctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcct

SEQ ID NO: 74373 - DNA, 201 bp, Homo sapiens
atctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcc

SEQ ID NO: 74374 - DNA, 201 bp, Homo sapiens
tcttgctgtgttgcccaggctggtttctaactcctgggctcaagcgatccactggcctcagcctcctgaagtgctgggattacaggagtgagccactgcaycaggcccatttctctaccatttctgatctctctctagaaacacttggataactgcacagctcctttcataagaaatatattttagggccgggtgtggtgg

SEQ ID NO: 74375 - DNA, 201 bp, Homo sapiens
aaacaagatggggtcagttaagttagatctctttcactgtctcaggcataattttgcacaggcggtttcagtataatcatttcagtacaagacaagatttwaaaaaagaaaactaatgctaagcatttttcaagaaacatactgtaggccgggtgcagtggctcacgcctgtaattccagcaccttgggaggctgaggcgg

SEQ ID NO: 74376 - DNA, 201 bp, Homo sapiens
ggcgggcggatcacgaggtcaggagatcgagaccatcctggctaacatggtgaaaccccgtctctactaaaaacacaaaaaaattagccgggtgtggtggygggcacctgtagtcccagctactcgggaggctgaggcaggagaatgggtcaacccaggaggcagagcttgcagtgagccaagatcctgccactgcactcc

SEQ ID NO: 74377 - DNA, 201 bp, Homo sapiens
atcgagaccatcctggctaacatggtgaaaccccgtctctactaaaaacacaaaaaaattagccgggtgtggtggtgggcacctgtagtcccagctactcrggaggctgaggcaggagaatgggtcaacccaggaggcagagcttgcagtgagccaagatcctgccactgcactccagcctgggtgacagagcgagactct

SEQ ID NO: 74378 - DNA, 201 bp, Homo sapiens
ttgggtaatgtgaatattaccctaaagaaagctgcatctatgtggaactgttaccgggaatgggtcccaatctagaccccaagagagggttcttggacctyacgcaagaaagaattaggggcaaatccataaagtgaaagcaagtttattgggaaagtaaaggaataaagaatggctactccataggtagagtcacagtat

SEQ ID NO: 74379 - DNA, 201 bp, Homo sapiens
agtatgggctgcttaactgagtatactcagttatttcttgattatatgctaaacaaggggtggattattcatcagttttctggaaaaggggcaggcatttstcggaactgagggttccttctttttttagactgtatagggtaacttcctgatgttgccatggtatttataaactgtcatggccctagtgggagagtcttt

SEQ ID NO: 74380 - DNA, 201 bp, Homo sapiens
ccagtagcagcaggcagctattcacacccaaatttcaccttaaaaagaatggcttcaaaattgacctcccccatgggaaatattgcaggacttaacacagrattgtttttctcttcatttctctacgatttctttctttctttttttttccttttttccgaggtggagtttctctctttttgcccaggctggagtgcactg

SEQ ID NO: 74381 - DNA, 201 bp, Homo sapiens
gtgagccaagatcgcgccattgcactcctgcctgggcaataagggcgaaactccatctcaaaaaaaagaaagaaatccttagactataagtttgttatatratctgcatgtaaaacaaggtcctatatgactcaaataatgtgcagggttccctttaaaaagttcagcaactactttcctttttttttttttgagatggag

SEQ ID NO: 74382 - DNA, 201 bp, Homo sapiens
ggaaattggtgcaaatgagaaatcttggaaatctgtaagtatatagatataaaagttattctttccagtttgattcttttatgatgtagattttaatatcmgtcaatttaggaaactctgtggctctgaattatagttataattctagttttactattacagtgaaagaagagaagaggctgttcattattatattggaag

SEQ ID NO: 74383 - DNA, 201 bp, Homo sapiens
tggacatggtggcggacgcctgtaatcccagctacttgggaggctgaggcaggagaatcgcttgaacccaggaggcagaggttgcagtgagccgagatcaygccattgtactccagtctgggcgacgagtgaaactccatctcaaaaaaaaaaattagctaggcgtgatggcgggcacctgtaatcccaggtactcaggag

SEQ ID NO: 74384 - DNA, 201 bp, Homo sapiens
ttttgtagaaatggggtctttccatgttgctcaggctggtcttgaactccttgtggctcaaatgatccgcccatctctgcctcccaaagtactggaattayagcctttatttcttttagattttcaatttactgcccctaagttgcaaaatgttctcttagaattatttttatctttgcattctgtatccattctgtatgc

SEQ ID NO: 74385 - DNA, 201 bp, Homo sapiens
aacacggtgaaaccctgtctctactaaatacaaaaattagccaggtatggtggtgggcacctgtaattccagctacttaggaggctgaggaaggagaatcrcttgaaccccgggaggtggaggttgcattgagccgagatggcaccattgcactccagcctgggcaacaagagcaaaactgtctcaaaaaaaaaaaaaaaa

SEQ ID NO: 74386 - DNA, 201 bp, Homo sapiens
catctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgc

SEQ ID NO: 74387 - DNA, 201 bp, Homo sapiens
agtagagacggggtttcaccatgctggtcaggctggtcttgaactcctgacctcagaggatccacccgccttggccccacaaagtgctgggattccaggcrtgagccacagtgcctggccatgactaactcattccattgagggtcttttctcctgaagttttgtgctatgacttgatatttcaaaagaagggaaatagat

SEQ ID NO: 74388 - DNA, 201 bp, Homo sapiens
ctcccgagtagctgggattacaggcaccacctaattagcccgccaccacgcccggctaatttttgtatttttagtagagacggggtttcaccatcttggcyaggatggtcttgaactcctgacctcgtgatccacccgcctcggcctcccagagtgctgggattacaggcgtgagccaccgcacctggcctaaaactgatt

SEQ ID NO: 74389 - DNA, 201 bp, Homo sapiens
aggcttgcctgaggcatctattttatctttccaaagaaccagtggttctttttgagacagggtctggctctgtctattgtccaggctggagtgcagtggcrtgattatggctcactgaagcctcaaccttcagggctccagtgatcctcctgcctcagcctcccagatagctggaactataggtgcacgcctccacgcctg

SEQ ID NO: 74390 - DNA, 201 bp, Homo sapiens
ctttattttcacacacggacttcattgtcttctaatctctagggttgttattgaggaaaatatgccattctgattcttgttccttaatatgttatttcttktaatggattaaaacatttaccataacttttttgtaataacattttataactaatttttttctcataataaaattaattcagctgggcatagtggctcatg

SEQ ID NO: 74391 - DNA, 201 bp, Homo sapiens
aatccggccgtaattccagccaatcagggagtagagttgcggggcggggttggggcggggcagtctcgcgggagatagtttcgcgggttcgggaggcgagwctccggtttccgcccagtctctggggacgcggtggcggggtctgaatcgcctggcttccagggagttttgggcgggtccccgcacgggagcgtggcaggc

SEQ ID NO: 74392 - DNA, 201 bp, Homo sapiens
tcaaaaaagattgtaggtaccttgtttaaagaaaatatataagctagtttcaagaattccaaaatattttttaaaagcagctctgtacatgtcgataaatyatttgctcattgtaattttttgaatctgtttgtcaaagcaaatgtagacgggctcgaactcctgacctcaaatgatccacccgcctcagtctcccaaatg

SEQ ID NO: 74393 - DNA, 201 bp, Homo sapiens
caggatgactgaggccagttggagaccagtctgggcaacacagcaagacccctgtctctacaaaaaattcaaaaattaaaaattaaccaggcatggtagcrgtgtgcacctgtagtcctagcgactcaggaggctcagatggaaggatcacttgagcccaggagttccaggtcacagtgaactatgattgcatcaccgcac

SEQ ID NO: 74394 - DNA, 201 bp, Homo sapiens
tgaggcaggaggattgcttgaacccaggtgttcaaggctagcctgggcaatatagcaagattctgtctctaaaaaaaaaaatcatattatggtagatggaractagtatgtgataaaataaaaatgactttaaaaaaatttgtctaaagttctttaggattttttatttagcagaacattatgcaaacaccaaccttttaa

SEQ ID NO: 74395 - DNA, 201 bp, Homo sapiens
agtgggcggaagtagggaggaagaaacctttagacgcgaacccgagccaccctggtacattctcagatcccactcaccccaatcttcatccagcctgtgaragagtcccgggctaaaaggtgactccatggtgccggcaaccccagccggctcccccatttcacaagttccttctccctggaactccgtgattaatatctg

SEQ ID NO: 74396 - DNA, 201 bp, Homo sapiens
gacgaggggcctcactccccaggcagggttggtccacacctgtcaccacgagtgggcggaagtagggaggaagaaacctttagacgcgaacccgagccacmctggtacattctcagatcccactcaccccaatcttcatccagcctgtgaaagagtcccgggctaaaaggtgactccatggtgccggcaaccccagccggc

SEQ ID NO: 74397 - DNA, 201 bp, Homo sapiens
agtctgggcaacacagcaagacccctgtctctacaaaaaattcaaaaattaaaaattaaccaggcatggtagcggtgtgcacctgtagtcctagcgactcrggaggctcagatggaaggatcacttgagcccaggagttccaggtcacagtgaactatgattgcatcaccgcactccagcctgggcgacagagcaagaccc

SEQ ID NO: 74398 - DNA, 201 bp, Homo sapiens
gtggttacctgaccagaggtagggaagaggaaggaggaaaaaataggtagagcatagggcttttttagggcagtgaaactattctatataatactgtaatwatggatacatgtcattatacctttgtcaaaacccatagaacagtggttcccaaccctgttgggaaccaggccacacagcaggaggtgagcagcaggtggg

SEQ ID NO: 74399 - DNA, 201 bp, Homo sapiens
ccacgagatgctgacttactgacccccagtccccgttccaccagccatagctacagctttcattggacaactttttgttgatttcagtaactttctccagrtaagaagaccactggccatggactggttctggctggtctacagaggtcgcacatttgcatggcttcatgtcctgaaagaccttttgacgtatagggctcg

SEQ ID NO: 74400 - DNA, 201 bp, Homo sapiens
atttcacaagttccttctccctggaactccgtgattaatatctgggacggcggcggcaggcggacaaaatactccgtaacgctgacgagacggtggcctaktaaagacaaactacttttgccgcacgagggatttgtacgacacaggaaaacgtcagagactaagcaaatttgaatagacctctgagtaaatatttccctt

SEQ ID NO: 74401 - DNA, 201 bp, Homo sapiens
ggataagaatccatactgccaacgtgatgtgcccagctagaacagatgcccccttctagaagtgcatctaacacccaaatagcccaaatagctccaagcckgcttccagggcttgctctggcctcatacctcttacgagtgaaatgggctaatggtatacaccagggctgtagccagatcttatacatataggtgggggac

SEQ ID NO: 74402 - DNA, 201 bp, Homo sapiens
cattttcaacttaaacccttggaatagaaatacaatttgaaaaagaaccttatgtctagagacaataccactctttggtctaggtaagaggagcccctacsctggaccgacactttagaagactttactctgacctctggctctgccccacaggataagaatccatactgccaacgtgatgtgcccagctagaacagatgc

SEQ ID NO: 74403 - DNA, 201 bp, Homo sapiens
tttattagtgagttcagatttttttcctacgtcttaaactgtttagccccttgttttactgcaatggttaggccctctaatacgatacagaaggtaggggstagacatcttttaacttacttctaaattttaatgtgaatgtttgaaaagttttaccactaaataagattttttcccatatatttttcacagctgctctga

SEQ ID NO: 74404 - DNA, 201 bp, Homo sapiens
tgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgcca

SEQ ID NO: 74405 - DNA, 201 bp, Homo sapiens
aataaaattagcaaccgttcaccggggcattacgggaagttgtgtcatccaggagcaccagattttgatttagtgctagaaagccaagagaaccttcacasaagagactgaagacataaacgaaaccacagtggcagacgaaagcttctgatcttgatacacatatcttaagtacagctgacagaagaataaagagaagga

SEQ ID NO: 74406 - DNA, 201 bp, Homo sapiens
ctgtatctggagagcagtcaggattacaccataagtattaggtgtagctaagcagggacccgaggtcaggtgcttgggtgttttgcttttctgccaagacrgacatcaggcttaaaccaatagtaaaagctgtaagattagaatttcttgtatataaccacattctctcatatacaccaaacacacaaaaacccactccat

SEQ ID NO: 74407 - DNA, 201 bp, Homo sapiens
ccccaggggtctgaagatgcagtgagctgtgattgctccaccgcatactccagctccaacctgggcaagagaacaagaccccatctctaaaagaaaaaaaraaaagtgaaagagagtgatccaggaatcaggagaggtagaggatgggatattgtgacaaaatgagatttcaacttagatatttttagggaggaggaaagg

SEQ ID NO: 74408 - DNA, 201 bp, Homo sapiens
ttcatgaaaccagtccctggtgccaaaaggctggggatccctgccatagaatgtacaacagagtgaactttaaatgatgggcttagttaataataatgtaycaatactggctcatcaattgtaaccaatgtaccacactaatgcaagatgttaccaataggagaagctggggatgaaggggaagtatgtggactctttgta

SEQ ID NO: 74409 - DNA, 201 bp, Homo sapiens
tttaggaggtaattaaagttaaatgaggtcattaaagtggggcactaatctgataggactgtggccttataagaagaagaagattctctctctcagtgccrtgtgaggacacaagaagaaggcagccatgtgcatgcaagccaggaagagagccctaaccagaacctgaaggtgcggccatcttgatcttgaactctaacc

SEQ ID NO: 74410 - DNA, 201 bp, Homo sapiens
gtaagtggataagcaaactgtgaatttatggcctaaactgtgtcctccaaaattcgtatgttgaagccctaaccccaaatattactatatcgagagatacwgtctttaggaggtaattaaagttaaatgaggtcattaaagtggggcactaatctgataggactgtggccttataagaagaagaagattctctctctcagt

SEQ ID NO: 74411 - DNA, 201 bp, Homo sapiens
cacaaatgttttcagcagttttatatataattgccaaaagttggaagcaaccaagatgtgcttcaataggtaagtggataagcaaactgtgaatttatggmctaaactgtgtcctccaaaattcgtatgttgaagccctaaccccaaatattactatatcgagagatacagtctttaggaggtaattaaagttaaatgagg

SEQ ID NO: 74412 - DNA, 201 bp, Homo sapiens
cctggaaaacaatggaaatgggcacattcagggagggacagggcaggatacccgatagaagtgagtcggtgaactgactacaaagaactgaatgctctgtyagagaacattaagtcaagtgatcagataagtctggaaaatgcagcctgggtatcagaagacgacataaaattatgctaccaggaagtgtcccacagttat

SEQ ID NO: 74413 - DNA, 201 bp, Homo sapiens
atcaggagaggtagaggatgggatattgtgacaaaatgagatttcaacttagatatttttagggaggaggaaaggagaatagcagtgaaggacaatggagrcacctatcccaccaacagaggccctatggtgaaaaggttttgagaataaaattagcaaccgttcaccggggcattacgggaagttgtgtcatccaggagc

SEQ ID NO: 74414 - DNA, 201 bp, Homo sapiens
cacgaacaggagtgacgaggggcctcactccccaggcagggttggtccacacctgtcaccacgagtgggcggaagtagggaggaagaaacctttagacgcraacccgagccaccctggtacattctcagatcccactcaccccaatcttcatccagcctgtgaaagagtcccgggctaaaaggtgactccatggtgccggc

SEQ ID NO: 74415 - DNA, 201 bp, Homo sapiens
tgggaatagtgaaaaacgacagttaactccagttagacaatattctactctccctgtggccaggacagaagccgaacgatactcccagactcttccagggrcacgaacaggagtgacgaggggcctcactccccaggcagggttggtccacacctgtcaccacgagtgggcggaagtagggaggaagaaacctttagacgc

SEQ ID NO: 74416 - DNA, 201 bp, Homo sapiens
aatggtatagccactttggaagacagtttggcaatttcttacaaaacaaacaaaaaacatgttcttaccacacaatccagcaattgtgctccttgatattyacccaaacaattggaaaatgcatgtccacacaaaaacctgcacacaaatgttttcagcagttttatatataattgccaaaagttggaagcaaccaagatg

SEQ ID NO: 74417 - DNA, 201 bp, Homo sapiens
agcagacttgagtagttgcaacagtgaccatgtaatcacaaagcctaaaatatttactatctgaacctttacagaaaatgtttgaagactcttgctctaartttcattacctaagttaaaaagaaaaaggaaagcacatccctcacaggctgttctgagttaatcactttatttaaattatttagagttgttaaaatcaca

SEQ ID NO: 74418 - DNA, 201 bp, Homo sapiens
cacaaattcaagcaagagtaaaagagaagagagaaggagagaggagggtaaaacatacagacggcaaataagcatatgaaaagatgctcaacatcatatgycatcaggaaactgcaaattaaaacataccactacacacctattagaatgactaaaatccaaagtactggcaacaccaaatgttagcaaggatgtggagca

SEQ ID NO: 74419 - DNA, 201 bp, Homo sapiens
ggaactccgtgattaatatctgggacggcggcggcaggcggacaaaatactccgtaacgctgacgagacggtggcctagtaaagacaaactacttttgccrcacgagggatttgtacgacacaggaaaacgtcagagactaagcaaatttgaatagacctctgagtaaatatttcccttttggagttttcaggactttctg

SEQ ID NO: 74420 - DNA, 201 bp, Homo sapiens
agtatttagtcaaagtccaagcgagtctaccctaagacctacagtaatcgaagttcccaatatttgtattactaaagattcgggttttatttaaaggaaawtcacatacatcacgaactccaactgaaaatatgaactgagtttgataaagcagtttcaagaacgctacttaagagaatttctttttcatccattttaaat

SEQ ID NO: 74421 - DNA, 201 bp, Homo sapiens
tagaatttcttgtatataaccacattctctcatatacaccaaacacacaaaaacccactccattgtgctcaccgcccacatttcacactcaggaaatagcytgtagcctttttggcggtcccagccattttgctctaaacctcctaaagacgtccagtgttagccacacaaaaagatcacccggtacttccccagtgggaa

SEQ ID NO: 74422 - DNA, 201 bp, Homo sapiens
gggacaggttagacacaccttgttatactccctcccttttgtagtttaacacaacaactggccagcattaatgttaaaacagagatgataagactgacagracagactctggcaataagatgccaaattataaaaaagacctaaagccattccaggcaaggttttagtcccacacccctatacttaaagaataaactgtgt

SEQ ID NO: 74423 - DNA, 201 bp, Homo sapiens
gcaggaggatcctttgaccccaggggtctgaagatgcagtgagctgtgattgctccaccgcatactccagctccaacctgggcaagagaacaagaccccayctctaaaagaaaaaaagaaaagtgaaagagagtgatccaggaatcaggagaggtagaggatgggatattgtgacaaaatgagatttcaacttagatattt

SEQ ID NO: 74424 - DNA, 201 bp, Homo sapiens
gtctctactaaaaatacaaaattagccgggcgtggtggtgcatgcctgtaatcccagctactcgggaggctgaggcaggagaatcgctcaaacccgagtgrcggaggttgcggtgagccaagattgcgccattacactctagcctgggcaacaaaagcgaaactccatctcaaaaaaagaggtaaagaaaagaaatgtcat

SEQ ID NO: 74425 - DNA, 201 bp, Homo sapiens
ttcaaaaagccaaaaagaagccaggcatggtggcatgtgtctgtagtcccagctactcgggaggctgaggcaggaggatcctttgaccccaggggtctgargatgcagtgagctgtgattgctccaccgcatactccagctccaacctgggcaagagaacaagaccccatctctaaaagaaaaaaagaaaagtgaaagaga

SEQ ID NO: 74426 - DNA, 201 bp, Homo sapiens
gtaaatcagtgaagtacttgaacatccaaaacagcaactgtcacagaacgaaacactatcagacagtagtgtttcactctattgccaacaaaatctatcckacttactgaacacctaaggaattaaattaaagtcttcaaagaagagaagactgttaacagtttgaaaagggaaacctggaaaacaatggaaatgggcaca

SEQ ID NO: 74427 - DNA, 201 bp, Homo sapiens
tgataaagaggaggtccagaaaatgacaggtcagtgtatctgaaggatcttctctaaggatactgaaatcatccaagaatcatgatggaagtaatggtgargaaagtaacagtaagctagtggcaaaatgttttcaaaaagccaaaaagaagccaggcatggtggcatgtgtctgtagtcccagctactcgggaggctgag

SEQ ID NO: 74428 - DNA, 201 bp, Homo sapiens
tccctggaactccgtgattaatatctgggacggcggcggcaggcggacaaaatactccgtaacgctgacgagacggtggcctagtaaagacaaactacttytgccgcacgagggatttgtacgacacaggaaaacgtcagagactaagcaaatttgaatagacctctgagtaaatatttcccttttggagttttcaggact

SEQ ID NO: 74429 - DNA, 201 bp, Homo sapiens
atagcttgtagcctttttggcggtcccagccattttgctctaaacctcctaaagacgtccagtgttagccacacaaaaagatcacccggtacttccccagygggaatagtgaaaaacgacagttaactccagttagacaatattctactctccctgtggccaggacagaagccgaacgatactcccagactcttccagggg

SEQ ID NO: 74430 - DNA, 201 bp, Homo sapiens
tctgctccgcgattggccgctccggccacgggggcctatggggtggtcctcgcccagccaatcaggggccctggggagcccattcattcacaaaaactgakcaggaaaaggagcgcagtgcggcccggagctgcgtggaactttgaaacacgcgcgcgtcccgcggggccgaggcaagagtccgagagggccgtgtttcgg

SEQ ID NO: 74431 - DNA, 201 bp, Homo sapiens
cttgagtagctggggctacaggtgtgagccaccacgctcagctccggcactttcaagtttacaaaacaccaggacctccatgcttctttgggaaagtgggrcacagggagcaggcattattactctcatttttgctgcattcatctgttctccactcattcattcatcaatccagcatccgtccaaggaccaggcctaggc

SEQ ID NO: 74432 - DNA, 201 bp, Homo sapiens
ggtctcactatgttgttcaggctagattcaaactctgggctcaagcaatctccttgcttcagcttcttgagtagctggggctacaggtgtgagccaccacrctcagctccggcactttcaagtttacaaaacaccaggacctccatgcttctttgggaaagtgggacacagggagcaggcattattactctcatttttgct

SEQ ID NO: 74433 - DNA, 201 bp, Homo sapiens
cttgcttcagcttcttgagtagctggggctacaggtgtgagccaccacgctcagctccggcactttcaagtttacaaaacaccaggacctccatgcttctytgggaaagtgggacacagggagcaggcattattactctcatttttgctgcattcatctgttctccactcattcattcatcaatccagcatccgtccaagg

SEQ ID NO: 74434 - DNA, 201 bp, Homo sapiens
cttcccaggacttccaagttggtttttgttttgttttattttagagatgaggtctcactatgttgttcaggctagattcaaactctgggctcaagcaatcyccttgcttcagcttcttgagtagctggggctacaggtgtgagccaccacgctcagctccggcactttcaagtttacaaaacaccaggacctccatgcttc

SEQ ID NO: 74435 - DNA, 201 bp, Homo sapiens
aaacaagacaatcacagtggtgtgtgatgctgtggggccatggagtttcagagaaagggaggacgaaccctacctgcagggagatggaagtctttctggargagagtgagagagccttcaggcggacggaaccgtggaacaggtgcagaagttggaaagcatgtattgaagcaaggctggagacgtctcctcacttaagaa

SEQ ID NO: 74436 - DNA, 201 bp, Homo sapiens
ggaggcccccaatgccacatatttctccatctgttccctaccaatcatcctgtgaacttgggtgagtctctcaacctccccagcttcagcagcctcatctrggcaccacacaagctcactgcttgtggaagtgcctgacttgtgtatcaatgactagcacttgctgggcacctgctgggtgccacgctcttttctaggcac

SEQ ID NO: 74437 - DNA, 201 bp, Homo sapiens
tctgccccttcacccagcccctcaccagaacaggctccctggtggaggcccccaatgccacatatttctccatctgttccctaccaatcatcctgtgaacytgggtgagtctctcaacctccccagcttcagcagcctcatctaggcaccacacaagctcactgcttgtggaagtgcctgacttgtgtatcaatgactagc

SEQ ID NO: 74438 - DNA, 201 bp, Homo sapiens
accagaattatggtcccgtgaccacagccttctgctctaccagagatctgccccttcacccagcccctcaccagaacaggctccctggtggaggcccccartgccacatatttctccatctgttccctaccaatcatcctgtgaacttgggtgagtctctcaacctccccagcttcagcagcctcatctaggcaccacaca

SEQ ID NO: 74439 - DNA, 201 bp, Homo sapiens
tgtgtagtccctgatgcaccatctccggcccttacagtttatggctcctcactgggctgtgtccagcaacatctatcctgctgtttcccctactctgggcygtccctgctcttgccgctttcctggggagtgggtgaggactgagggacactcagccccagcctggggacccagggacgaggagacacctcgggagggctg

SEQ ID NO: 74440 - DNA, 201 bp, Homo sapiens
gccgggcatggtgtcgggcacctgtagtcccagctactcaggaagctgaggcaagagaatggcgtgaacccgggaggcggaggttgcagtgagccgagatsgcgccactgcactccagcctgggccacaggaccagactctgtctcaaaaaaaaaaaaagaaagaaagaaaaagaaagaaaggaaggaaggaaggaaggaa

SEQ ID NO: 74441 - DNA, 201 bp, Homo sapiens
atgcgggaagggctgaggaaagaacattttccagcacctggccccaacacagccacgtaagccccactccgtttcttcagtttccctttatggctaccagsagtccgtttctaaaggccgtggaggtgggaacactcatccatccgttcccttcttgccagccctgtgtgtctatgtgcacagccagcgttggagggacag

SEQ ID NO: 74442 - DNA, 201 bp, Homo sapiens
aacgcaccaggcctaacatttaaagcccgtctttccagctcctagatcacactcctggtgctttccgcaccacactccccacctcagcagacagtgccctsaactcgaggcaggcagagatcctgaccaagttctgtcatcctgagctgtgtgaccttgcataagtcactcaacttctctgaggaggcatccttatctaga

SEQ ID NO: 74443 - DNA, 201 bp, Homo sapiens
gctccgggtcgctaagagccacccggccccgagggaggcggtgcccaggcggtttcccggtcgcaggctccggcggcaagtcccgcgcaggtggcagcgcsgcggctgcagccacgtgcgcgccaagcatggtgccccccaccgttccttttctctccccgggtctgagctccctggcccgccactcacggcagtcgtcct

SEQ ID NO: 74444 - DNA, 201 bp, Homo sapiens
cgtcctcgtcgctgtggtctaagcagtcatcgtcctcgtcgcatctccacacagaggggatgcagcgctcgttccggcactggaattggtccttttcgcamtccttggccggccctgcgagggggagggagcgtgagctggatcagcggactcggccccactccccaccatgcagtccgggccacccggaaggacccgctg

SEQ ID NO: 74445 - DNA, 201 bp, Homo sapiens
tggtgtctccatctgtaaggtgagttgctacactgagagggcctgctggatgggtcagcgaggagggagggtgctgggttcagactgcagggctggaaggkagtggaggaggcccaaacccccaacccggaccagaattatggtcccgtgaccacagccttctgctctaccagagatctgccccttcacccagcccctcac

SEQ ID NO: 74446 - DNA, 201 bp, Homo sapiens
ccgagccccgcctgcacctaccaccctaaggatatgcgcgggggtgtggccggggcggggccggggcagggcagggcggtgcccccgcgcccagggaaccsgaatactacacatccgtctgctccgcgattggccgctccggccacgggggcctatggggtggtcctcgcccagccaatcaggggccctggggagcccatt

SEQ ID NO: 74447 - DNA, 201 bp, Homo sapiens
tcccagcctcaggccatagcccgcccagcccaccctgggactgactccagcacagacaccagatggcacctctgtgtgtgagcccactgtggggtgttgcrtgtttctgcatgactgtacatgtgtgtgcatatccatgtgtggagagggctatttcttcatgtggtcttgcatgggtagctgagtctgtgtgcgcttgga

SEQ ID NO: 74448 - DNA, 201 bp, Homo sapiens
tttggacttacccaggtctcggtctgaatcctgactctgaatccacccctagctgtgtgaacccgggaaagctgcttcccctctctgcgtttcagagtccycatgcatggaatgaggttgctgtcaggaatgaatggaatgatacatgcaaggctctgagccgggtgcctggggcagggtacacacttctgacgggtcata

SEQ ID NO: 74449 - DNA, 201 bp, Homo sapiens
ccaagtcccatgttggtctccagagccatgggagccccagcagcctactctttcacactgccccccaggaactggagcttcagaactttgccaggctgtgmcctctgctaggccatgccctctgcctagaacactcccgcatgggttggcttctgtttaccgtttgggcctcacctcaaatgcctcctcctctgggaagac

SEQ ID NO: 74450 - DNA, 201 bp, Homo sapiens
atcctgtggtggggctggagtgaggtggatggggagctgtctgggacaggaatccctgtgtcctgcatcctcattgctggctctgctgctgacatcataaygctggaggtaggagaagagcccatgtggatttcgggtccagcatgccccatcaggctggtgctctgcgctcatgagtagtgggtaaaaaaaacaaggact

SEQ ID NO: 74451 - DNA, 201 bp, Homo sapiens
ctgtacatgtgtgtgcatatccatgtgtggagagggctatttcttcatgtggtcttgcatgggtagctgagtctgtgtgcgcttggaagtatgctatgagwgtgtgtgtgtgtgtgtgtgtgtgtgtgtgtgtaaactcccagatgtcaacttgttgcttgtgtcaccattagcatgtatctgggtgtcctggttagaggg

SEQ ID NO: 74452 - DNA, 201 bp, Homo sapiens
ggccatgccctctgcctagaacactcccgcatgggttggcttctgtttaccgtttgggcctcacctcaaatgcctcctcctctgggaagacttctcgcctmctccacagagatcctccctgctcctctgggcccccacggcactgtgtgtcccaatctccctgatcacactggcctgtcgttgttggctcctccatccaat

SEQ ID NO: 74453 - DNA, 201 bp, Homo sapiens
gcctcggtttcttgcctcttggctgtgtgctttcaggagggtgggctcacaactgcctcctcctccactgtcttatgtaggagactgagtgggtccttctscctctctaggcctggggtgtccatccctaacctgaggggctgaactaggtcagtatatcccataactgcagccattctcatccacttgaatgagtttctc

SEQ ID NO: 74454 - DNA, 201 bp, Homo sapiens
ctgtcaggccaggtgagtcatatcaagtgaggtgagagtgaaattgggagagagaagcggaaagagacaaggcagcagagacattttattgttctgcttcrtcctggaaacccactccctgacagcctcctccccctgtcctgcacccaccacccccacacctatccatacacacactgcagagccggtaggggaggaata

SEQ ID NO: 74455 - DNA, 201 bp, Homo sapiens
aaaatgggcagaatgatccctaggtgtcagaggtatggagagcatcatgggagatgacatccctgaagtgaggcacactgtgatctgtgtgtcagcattgscaggctgggaatagggtgaacctgtgaggcacctggggtgcaagttctccctgggtctggccctgtgcttggtaaatgctgccttttactacataaggga

SEQ ID NO: 74456 - DNA, 201 bp, Homo sapiens
ctgttttgaagtctgacgggagtgagctgggtagggaaagtggggggaagagtgctccgggcagacaggacaaagtgcagacagtagggtaaggaggcacrgtgggggacgcagctcacatgttgctgtgagcagagcacagagcacagggcagtgcctggcagaagtgggtctggaaagggtgcctcctggagccatgaa

SEQ ID NO: 74457 - DNA, 201 bp, Homo sapiens
gcaggctgggaatagggtgaacctgtgaggcacctggggtgcaagttctccctgggtctggccctgtgcttggtaaatgctgccttttactacataagggrcaagtctgtcaagagtgcctgagcaatggcctgcagccgggcctggggacagggctttcctgggctggtgatggtctgaagcccaagtggcaagaagaaa

SEQ ID NO: 74458 - DNA, 201 bp, Homo sapiens
atttatcttatcatatttccaaaagccttttgtttgttctttgactattcctttttttagagtatctcgttcttttctcacggatgcaatattttctcttrtttctttgaggatgttagtaatgttttgttgttgtttctgttgaagtgtttctcaccatgcctaatctcttctttgtccaagttaatttttttttctgat

SEQ ID NO: 74459 - DNA, 201 bp, Homo sapiens
actcttcaacagttttttgttgtttttcaaaaatttatcttatcatatttccaaaagccttttgtttgttctttgactattcctttttttagagtatctcrttcttttctcacggatgcaatattttctcttatttctttgaggatgttagtaatgttttgttgttgtttctgttgaagtgtttctcaccatgcctaatct

SEQ ID NO: 74460 - DNA, 201 bp, Homo sapiens
gccctggttgtcacctggagactgtgctgcacttttctcctgggtcgaacccctcaattcctagatcccacgtcttccccttctgggttcactaccttatytgggggaacatatacccatagctttctttttgttttattttttgtttacctatttatttatcttattttattttttgagacggagtctccctctgttgcc

SEQ ID NO: 74461 - DNA, 201 bp, Homo sapiens
aactaatcatcttcattttggagaaaatttaaaagaagtacctctataatgattttattttttctttcaggaactccttaattattcaaatactggccctyctggagcagttctctatatttcttatatcctttttccacctatttttcatcccattttgctcttcattctggaaatgttcttcaactcttcaacagtttt

SEQ ID NO: 74462 - DNA, 201 bp, Homo sapiens
tgggcaaatcacctaacttgtgctttcagtttctctgtgcctcagtttcctgatctataatcaggggatgataatagcattgatgcccgtcaatagtatcratgtgcagattaaactagtaatatgttaaaaatgcttataatagcaccttttccaataaccaaaagtgatggaaacattagctactatggtattattatt

SEQ ID NO: 74463 - DNA, 201 bp, Homo sapiens
tctgtgtttgtgtctctgtctctttccctctctccctctgagcaggcaaagtgtcctgattcctgtaaaagagagattctaatttattactgaactttacrtagatccaaactgccatggtttaaacgacttgttacctgtgtgacctggggcaagttacttttatgcctcaattccctcatctgcaaaacattgttagca

SEQ ID NO: 74464 - DNA, 201 bp, Homo sapiens
cttagtgtgtcttgaagtgaatcgatttccattcactgtgctgggtacccagtgagtcctcacggacaaactaatcatcttcattttggagaaaatttaaragaagtacctctataatgattttattttttctttcaggaactccttaattattcaaatactggccctcctggagcagttctctatatttcttatatcctt

SEQ ID NO: 74465 - DNA, 201 bp, Homo sapiens
acctgtgtgtgatgagtgcttagtaatgatggaaaagccattaaatttgtgggtgcaagacacggacagaaacgttctgattgacggcaatcaggttccaytgggggtattggaacacatccctgaggataatgggggactactgtattctaccaacttattcctcttgaagaattccctttcggatttctgactgctgag

SEQ ID NO: 74466 - DNA, 201 bp, Homo sapiens
accttttccctggaggagctctggtctggaggcagagagagcctgggacagagagtgtcagcacagggggacaagagccagggaggggtctgctcaggggygccagattccacccccaggtaccttaggctgtgtcaccagcccagccagggtcggagaccagcagccccaagccaaacacagccaggctgcaagggcaag

SEQ ID NO: 74467 - DNA, 201 bp, Homo sapiens
gtttctgcctttattgaaggatttgtacccctaggaggactatgtcttcctcatctttgtcttcagaggataaatacaaggcctgacacataacaagcatkaggtaagttatatttacttgaaaaagttaaaagaaaaccacataaaataacaacaatagccaatatttattgtatacttgctgggggtcaggcaccattc

SEQ ID NO: 74468 - DNA, 201 bp, Homo sapiens
ttcacccagcccctcaccagaacaggctccctggtggaggcccccaatgccacatatttctccatctgttccctaccaatcatcctgtgaacttgggtgartctctcaacctccccagcttcagcagcctcatctaggcaccacacaagctcactgcttgtggaagtgcctgacttgtgtatcaatgactagcacttgctg

SEQ ID NO: 74469 - DNA, 201 bp, Homo sapiens
ctgcggaaacgcattgtcaagcggagaagccgcccggctctgctcattaccgccgcggagcgcgcgtgtcaaataaaccccaacggcgagaatcacacagytcatccggaaccatgaatggccgcccctccggcaaagttccccgctggccaagcccccctgcacccctcccccaagatccgctgcccagagggcagagcc

SEQ ID NO: 74470 - DNA, 201 bp, Homo sapiens
cccaacggcgagaatcacacagctcatccggaaccatgaatggccgcccctccggcaaagttccccgctggccaagcccccctgcacccctcccccaagakccgctgcccagagggcagagccctcaacaccgaggcccgcgggggcggggggccgagggcaaattcaggaatagccgcttcgcgtggagcctgtccgccc

SEQ ID NO: 74471 - DNA, 201 bp, Homo sapiens
ggctgtgacactgcagaggagagggcttagcccaacctggggcccagggaaggctgcctggagctgttttgaagtctgacgggagtgagctgggtagggaragtggggggaagagtgctccgggcagacaggacaaagtgcagacagtagggtaaggaggcacggtgggggacgcagctcacatgttgctgtgagcagagc

SEQ ID NO: 74472 - DNA, 201 bp, Homo sapiens
taagatgtcatctcaagacagggaaatgaaggcctgggaaggacctacctaagtcaccagccagtacttgagacagtacaagttccatagctggtcacccrcattcacaccccagcagttctacacccttgggccagttacgtaacccgtctgtgcctcgatgagataggactatttcaggtacttcatagtgttgcccca

SEQ ID NO: 74473 - DNA, 201 bp, Homo sapiens
gttggtggctagggcggagcagagccgagtcagagaccttttgcacgcaccttggccgccgagcagcggatcagccgctgccgccgcaagatgctggagcygcagcagcagcagcagcagcagcagcagcagcagcgccagaagccggagagggcccggctcggggaggcccatggcgggcccggggctccggccgccgcg

SEQ ID NO: 74474 - DNA, 201 bp, Homo sapiens
ggcacatttgaccaatgcttgtttctgcctttattgaaggatttgtacccctaggaggactatgtcttcctcatctttgtcttcagaggataaatacaagrcctgacacataacaagcatgaggtaagttatatttacttgaaaaagttaaaagaaaaccacataaaataacaacaatagccaatatttattgtatacttg

SEQ ID NO: 74475 - DNA, 201 bp, Homo sapiens
ggagcacacgtccaggccgcacactgagggccagatgcgggctacagcacaggcagggagctgtggccgagctttaattatttatgaggctgtttcccagyaagactcagcactcctgcagcctggccttgcccagctaatgaactctcagccatgggagacctccctgtggccactctttattaaacctgggatggaggg

SEQ ID NO: 74476 - DNA, 201 bp, Homo sapiens
gagcaatggcctgcagccgggcctggggacagggctttcctgggctggtgatggtctgaagcccaagtggcaagaagaaaactggagccaagaggcccctyccactcaggaccagcctctccccacccctcaccccatactccccaggagcccaatagacacatcatttctcttcccctccatgagtgagctccggcgggg

SEQ ID NO: 74477 - DNA, 201 bp, Homo sapiens
gtatctgggtgtcctggttagagggtcatgtgtatgtgcctgtgcctttgtgtaattggcccttggggtgtctgggtgtatctagatgaagagagctttgytatacatctgtgtggttgcatacttctgagtgtgttgctgtgcatttggaggggtttgtgtaaaattactaggtgcctagtctaggacttgagacaaaca

SEQ ID NO: 74478 - DNA, 201 bp, Homo sapiens
tgtgcatttggaggggtttgtgtaaaattactaggtgcctagtctaggacttgagacaaacaagacaatcacagtggtgtgtgatgctgtggggccatggrgtttcagagaaagggaggacgaaccctacctgcagggagatggaagtctttctggaggagagtgagagagccttcaggcggacggaaccgtggaacaggt

SEQ ID NO: 74479 - DNA, 201 bp, Homo sapiens
gggccatggagtttcagagaaagggaggacgaaccctacctgcagggagatggaagtctttctggaggagagtgagagagccttcaggcggacggaaccgyggaacaggtgcagaagttggaaagcatgtattgaagcaaggctggagacgtctcctcacttaagaagacctggaatggcgggatataggacaggagaagt

SEQ ID NO: 74480 - DNA, 201 bp, Homo sapiens
agtgagagagccttcaggcggacggaaccgtggaacaggtgcagaagttggaaagcatgtattgaagcaaggctggagacgtctcctcacttaagaagacytggaatggcgggatataggacaggagaagtcaaaaagtatgttcagtatggtcatggcttccgtggggcctgctgtgggatcccagatctaggctctgga

SEQ ID NO: 74481 - DNA, 201 bp, Homo sapiens
aggctaggggcttctagttttgctcaggggcagaaagcccacaggccttcaggggctggggagtgagacccactccagtgggtggttgcctggcagggatrgggacccggtgagaccagctcttctgattcttcaagaaaagctttcaagaaaatagatctagatttttgtgtaaaatatcttgatcttttatcttttaaa

SEQ ID NO: 74482 - DNA, 201 bp, Homo sapiens
caggtgcagaagttggaaagcatgtattgaagcaaggctggagacgtctcctcacttaagaagacctggaatggcgggatataggacaggagaagtcaaaragtatgttcagtatggtcatggcttccgtggggcctgctgtgggatcccagatctaggctctggaaactgagagaaagggacagccctggtgaggatgga

SEQ ID NO: 74483 - DNA, 201 bp, Homo sapiens
gaagcaaggctggagacgtctcctcacttaagaagacctggaatggcgggatataggacaggagaagtcaaaaagtatgttcagtatggtcatggcttccrtggggcctgctgtgggatcccagatctaggctctggaaactgagagaaagggacagccctggtgaggatggagaacaggcagcattagctggaccagccc

SEQ ID NO: 74484 - DNA, 201 bp, Homo sapiens
gagagagccttcaggcggacggaaccgtggaacaggtgcagaagttggaaagcatgtattgaagcaaggctggagacgtctcctcacttaagaagacctgraatggcgggatataggacaggagaagtcaaaaagtatgttcagtatggtcatggcttccgtggggcctgctgtgggatcccagatctaggctctggaaac

SEQ ID NO: 74485 - DNA, 201 bp, Homo sapiens
caggtgactttggttctcccctaccctgcctctccatcctgggctgactcaagcttacagaccctgcctaccctgagtttccaaagaaaactcccaaaccyaacccaaaatgtaatgaattccccatgagacagatgtaggtgatatttcacctgctgtcaatatggcaccctgccactcccaagtcccatgttggtctcc

SEQ ID NO: 74486 - DNA, 201 bp, Homo sapiens
aaagttacaacacctgtgtgtgatgagtgcttagtaatgatggaaaagccattaaatttgtgggtgcaagacacggacagaaacgttctgattgacggcartcaggttccattgggggtattggaacacatccctgaggataatgggggactactgtattctaccaacttattcctcttgaagaattccctttcggatttc

SEQ ID NO: 74487 - DNA, 201 bp, Homo sapiens
cgtgctgtccggcttcgtcccacctgggatgtgaatcatccctttgtccagtggatccgcgctatagacactactctcccatcagtcactcagcagctgcytcagttcccagatcaactgtcgcaggatcgcagtgcttctgttcaagtaatccttattttacttcattatgggctccaaagcacaagaggagtgttgctg

SEQ ID NO: 74488 - DNA, 201 bp, Homo sapiens
gttttcagttgcatgctattctgagtagcaggatgaaatctcgtgctgtccggcttcgtcccacctgggatgtgaatcatccctttgtccagtggatccgygctatagacactactctcccatcagtcactcagcagctgcttcagttcccagatcaactgtcgcaggatcgcagtgcttctgttcaagtaatccttattt

SEQ ID NO: 74489 - DNA, 201 bp, Homo sapiens
tctcactgcggttttcatttgcatttccttgataattagtgatactgagcctcttttcatgtacttattggccatttgtatatcttcttcggagaaatgtmtattaaattcctttgcccatttttcaattgggttgtttagtgttttgttgttgagttgtaggaattcttatatattttagctattaaccccttatcagat

SEQ ID NO: 74490 - DNA, 201 bp, Homo sapiens
gactgccgcgtccccgcccacagctccggttcagtctccccagcatggtgcgccttcctcctccggcacactgcccggggctccgccccggccccaccagracacgccagctttcctgcccgctccgggtcgctaagagccacccggccccgagggaggcggtgcccaggcggtttcccggtcgcaggctccggcggcaag

SEQ ID NO: 74491 - DNA, 201 bp, Homo sapiens
aaaagcctgtacatgttcagtacagatgcaattattttttcctgaatatttctgatctgcagttgattgaatccaggattcggaacccatggatagagcgrgccaactatgtatacacttatatagtgtgtactatgtactaaaaacccttctaagaacttaagtacacactatataagtcattgctattattattgcctt

SEQ ID NO: 74492 - DNA, 201 bp, Homo sapiens
taaaaagcctgtacatgttcagtacagatgcaattattttttcctgaatatttctgatctgcagttgattgaatccaggattcggaacccatggatagagmgagccaactatgtatacacttatatagtgtgtactatgtactaaaaacccttctaagaacttaagtacacactatataagtcattgctattattattgcc

SEQ ID NO: 74493 - DNA, 201 bp, Homo sapiens
agggaatagtgaccaggataaaaagcctgtacatgttcagtacagatgcaattattttttcctgaatatttctgatctgcagttgattgaatccaggattyggaacccatggatagagcgagccaactatgtatacacttatatagtgtgtactatgtactaaaaacccttctaagaacttaagtacacactatataagtc

SEQ ID NO: 74494 - DNA, 201 bp, Homo sapiens
catcctcccgtatactttacatcatctctagattatttataatacctatacaatgtaaatgctatgtaaatagttgttacgatgtattgtttagggaatartgaccaggataaaaagcctgtacatgttcagtacagatgcaattattttttcctgaatatttctgatctgcagttgattgaatccaggattcggaaccca

SEQ ID NO: 74495 - DNA, 201 bp, Homo sapiens
cgcagccctgaccaccctgtgttgccacagtctgcttatgcaactgtctccctcgtcactctgtgagctgctggaggacaggagcccgctctcctgcattyctggattcttggcacagggcacatttgaccaatgcttgtttctgcctttattgaaggatttgtacccctaggaggactatgtcttcctcatctttgtctt

SEQ ID NO: 74496 - DNA, 201 bp, Homo sapiens
cccgctctcctgcattcctggattcttggcacagggcacatttgaccaatgcttgtttctgcctttattgaaggatttgtacccctaggaggactatgtcytcctcatctttgtcttcagaggataaatacaaggcctgacacataacaagcatgaggtaagttatatttacttgaaaaagttaaaagaaaaccacataaa

SEQ ID NO: 74497 - DNA, 201 bp, Homo sapiens
cctgaggagctctgtgactttgggggagtcacttcacctctccaagcctatgtcctctataatataggaacaataccacctgtttttaaatggtaaactcygggggaatgctattagttaccatctttcaggcctagttcagcagtctcctcctccaggaagcctttcttggcttccttaaaagttccctccttccagcct

SEQ ID NO: 74498 - DNA, 201 bp, Homo sapiens
caaagggagggcacgatggcaggggttccgtggatgtcgggccgctcggtggcacggcgagaccaggcacctacttaaagtgtcacacgacctgggtatamcctccattcagacgcactcacccgcacacgcgacccatagtcagagatctgctcagatacagcccatagggagtccccgcgcccgcgcgccaggcgcagt

SEQ ID NO: 74499 - DNA, 201 bp, Homo sapiens
cacctacttaaagtgtcacacgacctgggtataccctccattcagacgcactcacccgcacacgcgacccatagtcagagatctgctcagatacagcccayagggagtccccgcgcccgcgcgccaggcgcagtgggagccgcaggcacatcaccctggcaggcagccccctctctctccgccgcgcgcaggggtctgcgg

SEQ ID NO: 74500 - DNA, 201 bp, Homo sapiens; identical to SEQ ID NO: 44567

SEQ ID NO: 74501 - DNA, 201 bp, Homo sapiens; identical to SEQ ID NO: 39549

SEQ ID NO: 74502 - DNA, 201 bp, Homo sapiens; identical to SEQ ID NO: 44357

SEQ ID NO: 74503 - DNA, 201 bp, Homo sapiens; identical to SEQ ID NO: 44301
  misc_feature (1)...(201): n = A,T,C or G, or insertion/deletion polymorphism (see Tables 1-2)

SEQ ID NO: 74504 - DNA, 201 bp, Homo sapiens; identical to SEQ ID NO: 40307

SEQ ID NO: 74505 - DNA, 201 bp, Homo sapiens; identical to SEQ ID NO: 39550

SEQ ID NO: 74506 - DNA, 201 bp, Homo sapiens; identical to SEQ ID NO: 40309

SEQ ID NO: 74507 - DNA, 201 bp, Homo sapiens; identical to SEQ ID NO: 39637

SEQ ID NO: 74508 - DNA, 201 bp, Homo sapiens; identical to SEQ ID NO: 39551

SEQ ID NO: 74509 - DNA, 201 bp, Homo sapiens; identical to SEQ ID NO: 39638

SEQ ID NO: 74510 - DNA, 201 bp, Homo sapiens; identical to SEQ ID NO: 40311

SEQ ID NO: 74511 - DNA, 201 bp, Homo sapiens; identical to SEQ ID NO: 40312

SEQ ID NO: 74512 - DNA, 201 bp, Homo sapiens; identical to SEQ ID NO: 39639

SEQ ID NO: 74513 - DNA, 201 bp, Homo sapiens; identical to SEQ ID NO: 40313

SEQ ID NO: 74514 - DNA, 201 bp, Homo sapiens; identical to SEQ ID NO: 39641

SEQ ID NO: 74515 - DNA, 201 bp, Homo sapiens; identical to SEQ ID NO: 40315

SEQ ID NO: 74516 - DNA, 201 bp, Homo sapiens; identical to SEQ ID NO: 39642

SEQ ID NO: 74517 - DNA, 201 bp, Homo sapiens; identical to SEQ ID NO: 40318

SEQ ID NO: 74518 - DNA, 201 bp, Homo sapiens; identical to SEQ ID NO: 39643

SEQ ID NO: 74519 - DNA, 201 bp, Homo sapiens; identical to SEQ ID NO: 44924

SEQ ID NO: 74520 - DNA, 201 bp, Homo sapiens; identical to SEQ ID NO: 40322

SEQ ID NO: 74521 - DNA, 201 bp, Homo sapiens; identical to SEQ ID NO: 39800

SEQ ID NO: 74522 - DNA, 201 bp, Homo sapiens; identical to SEQ ID NO: 39801

SEQ ID NO: 74523 - DNA, 201 bp, Homo sapiens; identical to SEQ ID NO: 39561

SEQ ID NO: 74524 - DNA, 201 bp, Homo sapiens; identical to SEQ ID NO: 40117

SEQ ID NO: 74525 - DNA, 201 bp, Homo sapiens; identical to SEQ ID NO: 44587

SEQ ID NO: 74526 - DNA, 201 bp, Homo sapiens; identical to SEQ ID NO: 40118

SEQ ID NO: 74527 - DNA, 201 bp, Homo sapiens; identical to SEQ ID NO: 44589

SEQ ID NO: 74528 - DNA, 201 bp, Homo sapiens; identical to SEQ ID NO: 39328

SEQ ID NO: 74529 - DNA, 201 bp, Homo sapiens; identical to SEQ ID NO: 44590

SEQ ID NO: 74530 - DNA, 201 bp, Homo sapiens; identical to SEQ ID NO: 39330

SEQ ID NO: 74531 - DNA, 201 bp, Homo sapiens; identical to SEQ ID NO: 44591

SEQ ID NO: 74532 - DNA, 201 bp, Homo sapiens; identical to SEQ ID NO: 39572

SEQ ID NO: 74533 - DNA, 201 bp, Homo sapiens; identical to SEQ ID NO: 39331

SEQ ID NO: 74534 - DNA, 201 bp, Homo sapiens; identical to SEQ ID NO: 44592

SEQ ID NO: 74535 - DNA, 201 bp, Homo sapiens; identical to SEQ ID NO: 39577

SEQ ID NO: 74536 - DNA, 201 bp, Homo sapiens; identical to SEQ ID NO: 44593

SEQ ID NO: 74537 - DNA, 201 bp, Homo sapiens; identical to SEQ ID NO: 39580

SEQ ID NO: 74538 - DNA, 201 bp, Homo sapiens; identical to SEQ ID NO: 44594

SEQ ID NO: 74539 - DNA, 201 bp, Homo sapiens; identical to SEQ ID NO: 44325

SEQ ID NO: 74540 - DNA, 201 bp, Homo sapiens; identical to SEQ ID NO: 39582

SEQ ID NO: 74541 - DNA, 201 bp, Homo sapiens; identical to SEQ ID NO: 39583

SEQ ID NO: 74542 - DNA, 201 bp, Homo sapiens; identical to SEQ ID NO: 39585

SEQ ID NO: 74543 - DNA, 201 bp, Homo sapiens; identical to SEQ ID NO: 39586

SEQ ID NO: 74544 - DNA, 201 bp, Homo sapiens; identical to SEQ ID NO: 40340

SEQ ID NO: 74545 - DNA, 201 bp, Homo sapiens; identical to SEQ ID NO: 44051

SEQ ID NO: 74546 - DNA, 201 bp, Homo sapiens; identical to SEQ ID NO: 44329

SEQ ID NO: 74547 - DNA, 201 bp, Homo sapiens; identical to SEQ ID NO: 39588

SEQ ID NO: 74548 - DNA, 201 bp, Homo sapiens; identical to SEQ ID NO: 39589

SEQ ID NO: 74549 - DNA, 201 bp, Homo sapiens; identical to SEQ ID NO: 41137

SEQ ID NO: 74550 - DNA, 201 bp, Homo sapiens; identical to SEQ ID NO: 39959

SEQ ID NO: 74551 - DNA, 201 bp, Homo sapiens; identical to SEQ ID NO: 39345

SEQ ID NO: 74552 - DNA, 201 bp, Homo sapiens; identical to SEQ ID NO: 40503

SEQ ID NO: 74553 - DNA, 201 bp, Homo sapiens; identical to SEQ ID NO: 39346

SEQ ID NO: 74554 - DNA, 201 bp, Homo sapiens; identical to SEQ ID NO: 39347

SEQ ID NO: 74555 - DNA, 201 bp, Homo sapiens; identical to SEQ ID NO: 40709

SEQ ID NO: 74556 - DNA, 201 bp, Homo sapiens; identical to SEQ ID NO: 39348

SEQ ID NO: 74557 - DNA, 201 bp, Homo sapiens; identical to SEQ ID NO: 39349

SEQ ID NO: 74558 - DNA, 201 bp, Homo sapiens; identical to SEQ ID NO: 43565

SEQ ID NO: 74559 - DNA, 201 bp, Homo sapiens; identical to SEQ ID NO: 44344

SEQ ID NO: 74560 - DNA, 201 bp, Homo sapiens; identical to SEQ ID NO: 39592

SEQ ID NO: 74561 - DNA, 201 bp, Homo sapiens; identical to SEQ ID NO: 39594

SEQ ID NO: 74562 - DNA, 201 bp, Homo sapiens; identical to SEQ ID NO: 39597

SEQ ID NO: 74563 - DNA, 201 bp, Homo sapiens; identical to SEQ ID NO: 39599

SEQ ID NO: 74564 - DNA, 201 bp, Homo sapiens; identical to SEQ ID NO: 44954

SEQ ID NO: 74565 - DNA, 201 bp, Homo sapiens; identical to SEQ ID NO: 44345

SEQ ID NO: 74566 - DNA, 201 bp, Homo sapiens; identical to SEQ ID NO: 39763

SEQ ID NO: 74567 - DNA, 201 bp, Homo sapiens; identical to SEQ ID NO: 44956

SEQ ID NO: 74568 - DNA, 201 bp, Homo sapiens; identical to SEQ ID NO: 39601

SEQ ID NO: 74569 - DNA, 201 bp, Homo sapiens; identical to SEQ ID NO: 42532

SEQ ID NO: 74570 - DNA, 201 bp, Homo sapiens; identical to SEQ ID NO: 39602

SEQ ID NO: 74571 - DNA, 201 bp, Homo sapiens; identical to SEQ ID NO: 42534

SEQ ID NO: 74572 - DNA, 201 bp, Homo sapiens; identical to SEQ ID NO: 39603

SEQ ID NO: 74573 - DNA, 201 bp, Homo sapiens; identical to SEQ ID NO: 42537

SEQ ID NO: 74574 - DNA, 201 bp, Homo sapiens; identical to SEQ ID NO: 39605

SEQ ID NO: 74575 - DNA, 201 bp, Homo sapiens; identical to SEQ ID NO: 41019

SEQ ID NO: 74576 - DNA, 201 bp, Homo sapiens; identical to SEQ ID NO: 41020

SEQ ID NO: 74577 - DNA, 201 bp, Homo sapiens; identical to SEQ ID NO: 41021

SEQ ID NO: 74578 - DNA, 201 bp, Homo sapiens; identical to SEQ ID NO: 42422

SEQ ID NO: 74579 - DNA, 201 bp, Homo sapiens; identical to SEQ ID NO: 39622

SEQ ID NO: 74580 - DNA, 201 bp, Homo sapiens; identical to SEQ ID NO: 39624

SEQ ID NO: 74581 - DNA, 201 bp, Homo sapiens; identical to SEQ ID NO: 44354

SEQ ID NO: 74582 - DNA, 201 bp, Homo sapiens; identical to SEQ ID NO: 39625

SEQ ID NO: 74583 - DNA, 201 bp, Homo sapiens; identical to SEQ ID NO: 40281

SEQ ID NO: 74584 - DNA, 201 bp, Homo sapiens; identical to SEQ ID NO: 39626

SEQ ID NO: 74585 - DNA, 201 bp, Homo sapiens; identical to SEQ ID NO: 40283

SEQ ID NO: 74586 - DNA, 201 bp, Homo sapiens; identical to SEQ ID NO: 39627

SEQ ID NO: 74587 - DNA, 201 bp, Homo sapiens; identical to SEQ ID NO: 40286

SEQ ID NO: 74588 - DNA, 201 bp, Homo sapiens; identical to SEQ ID NO: 39628

SEQ ID NO: 74589 - DNA, 201 bp, Homo sapiens; identical to SEQ ID NO: 40288

SEQ ID NO: 74590 - DNA, 201 bp, Homo sapiens; identical to SEQ ID NO: 39629

SEQ ID NO: 74591 - DNA, 201 bp, Homo sapiens; identical to SEQ ID NO: 40289

SEQ ID NO: 74592 - DNA, 201 bp, Homo sapiens; identical to SEQ ID NO: 40290

SEQ ID NO: 74593 - DNA, 201 bp, Homo sapiens; identical to SEQ ID NO: 39630

SEQ ID NO: 74594 - DNA, 201 bp, Homo sapiens; identical to SEQ ID NO: 39631

SEQ ID NO: 74595 - DNA, 201 bp, Homo sapiens; identical to SEQ ID NO: 41046

SEQ ID NO: 74596 - DNA, 201 bp, Homo sapiens; identical to SEQ ID NO: 41047

SEQ ID NO: 74597 - DNA, 201 bp, Homo sapiens; identical to SEQ ID NO: 44556

SEQ ID NO: 74598 - DNA, 201 bp, Homo sapiens; identical to SEQ ID NO: 44897

SEQ ID NO: 74599 - DNA, 201 bp, Homo sapiens; identical to SEQ ID NO: 39532

SEQ ID NO: 74600 - DNA, 201 bp, Homo sapiens; identical to SEQ ID NO: 39535

SEQ ID NO: 74601 - DNA, 201 bp, Homo sapiens; identical to SEQ ID NO: 39540

SEQ ID NO: 74602 - DNA, 201 bp, Homo sapiens; identical to SEQ ID NO: 39546

SEQ ID NO: 74603 - DNA, 201 bp, Homo sapiens; identical to SEQ ID NO: 44565

SEQ ID NO: 74604 - DNA, 201 bp, Homo sapiens; identical to SEQ ID NO: 41996

SEQ ID NO: 74605 - DNA, 201 bp, Homo sapiens; identical to SEQ ID NO: 45015

SEQ ID NO: 74606 - DNA, 201 bp, Homo sapiens; identical to SEQ ID NO: 43239

SEQ ID NO: 74607 - DNA, 201 bp, Homo sapiens; identical to SEQ ID NO: 40832

SEQ ID NO: 74608 - DNA, 201 bp, Homo sapiens; identical to SEQ ID NO: 40833

SEQ ID NO: 74609 - DNA, 201 bp, Homo sapiens; identical to SEQ ID NO: 43246

SEQ ID NO: 74610 - DNA, 201 bp, Homo sapiens; identical to SEQ ID NO: 40834

SEQ ID NO: 74611 - DNA, 201 bp, Homo sapiens; identical to SEQ ID NO: 43250

SEQ ID NO: 74612 - DNA, 201 bp, Homo sapiens; identical to SEQ ID NO: 42127

SEQ ID NO: 74613 - DNA, 201 bp, Homo sapiens; identical to SEQ ID NO: 42128

SEQ ID NO: 74614 - DNA, 201 bp, Homo sapiens; identical to SEQ ID NO: 43256

SEQ ID NO: 74615 - DNA, 201 bp, Homo sapiens; identical to SEQ ID NO: 42130

SEQ ID NO: 74616 - DNA, 201 bp, Homo sapiens; identical to SEQ ID NO: 42131

SEQ ID NO: 74617 - DNA, 201 bp, Homo sapiens; identical to SEQ ID NO: 42134

SEQ ID NO: 74618 - DNA, 201 bp, Homo sapiens; identical to SEQ ID NO: 42139

SEQ ID NO: 74619 - DNA, 201 bp, Homo sapiens; identical to SEQ ID NO: 42143

SEQ ID NO: 74620 - DNA, 201 bp, Homo sapiens; identical to SEQ ID NO: 44129

SEQ ID NO: 74621 - DNA, 201 bp, Homo sapiens; identical to SEQ ID NO: 42146

SEQ ID NO: 74622 - DNA, 201 bp, Homo sapiens; identical to SEQ ID NO: 42147

SEQ ID NO: 74623 - DNA, 201 bp, Homo sapiens; identical to SEQ ID NO: 42150

SEQ ID NO: 74624 - DNA, 201 bp, Homo sapiens; identical to SEQ ID NO: 42151

SEQ ID NO: 74625 - DNA, 201 bp, Homo sapiens; identical to SEQ ID NO: 42154

SEQ ID NO: 74626 - DNA, 201 bp, Homo sapiens; identical to SEQ ID NO: 42156

SEQ ID NO: 74627 - DNA, 201 bp, Homo sapiens; identical to SEQ ID NO: 42159

SEQ ID NO: 74628 - DNA, 201 bp, Homo sapiens; identical to SEQ ID NO: 43545

SEQ ID NO: 74629 - DNA, 201 bp, Homo sapiens; identical to SEQ ID NO: 41815

SEQ ID NO: 74630 - DNA, 201 bp, Homo sapiens; identical to SEQ ID NO: 40491

SEQ ID NO: 74631 - DNA, 201 bp, Homo sapiens; identical to SEQ ID NO: 43291

SEQ ID NO: 74632 - DNA, 201 bp, Homo sapiens; identical to SEQ ID NO: 45090

SEQ ID NO: 74633 - DNA, 201 bp, Homo sapiens; identical to SEQ ID NO: 43293

SEQ ID NO: 74634 - DNA, 201 bp, Homo sapiens; identical to SEQ ID NO: 45092

SEQ ID NO: 74635 - DNA, 201 bp, Homo sapiens; identical to SEQ ID NO: 43296

SEQ ID NO: 74636 - DNA, 201 bp, Homo sapiens; identical to SEQ ID NO: 45093

SEQ ID NO: 74637 - DNA, 201 bp, Homo sapiens; identical to SEQ ID NO: 43299

SEQ ID NO: 74638 - DNA, 201 bp, Homo sapiens; identical to SEQ ID NO: 45094

SEQ ID NO: 74639 - DNA, 201 bp, Homo sapiens; identical to SEQ ID NO: 43302

SEQ ID NO: 74640 - DNA, 201 bp, Homo sapiens; identical to SEQ ID NO: 44138

SEQ ID NO: 74641 - DNA, 201 bp, Homo sapiens; identical to SEQ ID NO: 44139

SEQ ID NO: 74642 - DNA, 201 bp, Homo sapiens; identical to SEQ ID NO: 42185

SEQ ID NO: 74643 - DNA, 201 bp, Homo sapiens; identical to SEQ ID NO: 42186

SEQ ID NO: 74644 - DNA, 201 bp, Homo sapiens; identical to SEQ ID NO: 42187

SEQ ID NO: 74645 - DNA, 201 bp, Homo sapiens; identical to SEQ ID NO: 39888

SEQ ID NO: 74646 - DNA, 201 bp, Homo sapiens; identical to SEQ ID NO: 42189

SEQ ID NO: 74647 - DNA, 201 bp, Homo sapiens; identical to SEQ ID NO: 44071

SEQ ID NO: 74648 - DNA, 201 bp, Homo sapiens; identical to SEQ ID NO: 42191

SEQ ID NO: 74649 - DNA, 201 bp, Homo sapiens; identical to SEQ ID NO: 42193

SEQ ID NO: 74650 - DNA, 201 bp, Homo sapiens; identical to SEQ ID NO: 42196

SEQ ID NO: 74651 - DNA, 201 bp, Homo sapiens; identical to SEQ ID NO: 44072

SEQ ID NO: 74652 - DNA, 201 bp, Homo sapiens; identical to SEQ ID NO: 42199

SEQ ID NO: 74653 - DNA, 201 bp, Homo sapiens; identical to SEQ ID NO: 44073

SEQ ID NO: 74654 - DNA, 201 bp, Homo sapiens; identical to SEQ ID NO: 42204

SEQ ID NO: 74655 - DNA, 201 bp, Homo sapiens; identical to SEQ ID NO: 42780

SEQ ID NO: 74656 - DNA, 201 bp, Homo sapiens; identical to SEQ ID NO: 41744

SEQ ID NO: 74657 - DNA, 201 bp, Homo sapiens; identical to SEQ ID NO: 42784

SEQ ID NO: 74658 - DNA, 201 bp, Homo sapiens; identical to SEQ ID NO: 45099

SEQ ID NO: 74659 - DNA, 201 bp, Homo sapiens; identical to SEQ ID NO: 45100

SEQ ID NO: 74660 - DNA, 201 bp, Homo sapiens; identical to SEQ ID NO: 45101

SEQ ID NO: 74661 - DNA, 201 bp, Homo sapiens; identical to SEQ ID NO: 45102

SEQ ID NO: 74662 - DNA, 201 bp, Homo sapiens; identical to SEQ ID NO: 45103

SEQ ID NO: 74663 - DNA, 201 bp, Homo sapiens; identical to SEQ ID NO: 45104

SEQ ID NO: 74664 - DNA, 201 bp, Homo sapiens; identical to SEQ ID NO: 45105

SEQ ID NO: 74665 - DNA, 201 bp, Homo sapiens; identical to SEQ ID NO: 45106

SEQ ID NO: 74666 - DNA, 201 bp, Homo sapiens; identical to SEQ ID NO: 45107

SEQ ID NO: 74667 - DNA, 201 bp, Homo sapiens; identical to SEQ ID NO: 39905

SEQ ID NO: 74668 - DNA, 201 bp, Homo sapiens; identical to SEQ ID NO: 42240

SEQ ID NO: 74669 - DNA, 201 bp, Homo sapiens; identical to SEQ ID NO: 42241

SEQ ID NO: 74670 - DNA, 201 bp, Homo sapiens; identical to SEQ ID NO: 44089

SEQ ID NO: 74671 - DNA, 201 bp, Homo sapiens; identical to SEQ ID NO: 42242

SEQ ID NO: 74672 - DNA, 201 bp, Homo sapiens; identical to SEQ ID NO: 42243

SEQ ID NO: 74673 - DNA, 201 bp, Homo sapiens; identical to SEQ ID NO: 42244

SEQ ID NO: 74674 - DNA, 201 bp, Homo sapiens; identical to SEQ ID NO: 43510

SEQ ID NO: 74675 - DNA, 201 bp, Homo sapiens; identical to SEQ ID NO: 44093

SEQ ID NO: 74676 - DNA, 201 bp, Homo sapiens; identical to SEQ ID NO: 44099

SEQ ID NO: 74677 - DNA, 201 bp, Homo sapiens; identical to SEQ ID NO: 41500

SEQ ID NO: 74678 - DNA, 201 bp, Homo sapiens; identical to SEQ ID NO: 41501

SEQ ID NO: 74679 - DNA, 201 bp, Homo sapiens; identical to SEQ ID NO: 41503

SEQ ID NO: 74680 - DNA, 201 bp, Homo sapiens; identical to SEQ ID NO: 40664

SEQ ID NO: 74681 - DNA, 201 bp, Homo sapiens; identical to SEQ ID NO: 41505

SEQ ID NO: 74682 - DNA, 201 bp, Homo sapiens; identical to SEQ ID NO: 40666

SEQ ID NO: 74683 - DNA, 201 bp, Homo sapiens; identical to SEQ ID NO: 45111

SEQ ID NO: 74684 - DNA, 201 bp, Homo sapiens; identical to SEQ ID NO: 39915

SEQ ID NO: 74685 - DNA, 201 bp, Homo sapiens
ctacttcacatgtatttaactttcgccctaacactgaactgaagtgcaaagccttggaaacaaatttaaataaattgaaaatactgcaattcacaaataaragtgagaacaacatttttagttacgtaagactatattatattaaattaggtggcagcagtatttataataatctaaattgcctgtgagaaaattaaactg

SEQ ID NO: 74686 - DNA, 201 bp, Homo sapiens
cccagctactggggaggctgaggcaggagaatggcttgaacctaggaggcggaggttgtagtgagccaagattgtagtgagccaaggttgtatagtgagcmactacactccagcctgggtgacagagcaagacttggtctcaaaaagaaaaaaaaaagaaagaaatagaaaatagtctgggtgcggtggctcatacctgta

SEQ ID NO: 74687 - DNA, 201 bp, Homo sapiens
gggggagtttgagaagcaagggctttccttcgttgattctcctttcaccagtcttcctggaaagaatattctgcagttacaaaataggttccttggctgcmagtctgatacttgtgctaaaaccaaatagatgaaaaagtatcaacatgaattttaaaaaatatattgtgtgagcttgtatagctaagaattcccagcccc

SEQ ID NO: 74688 - DNA, 201 bp, Homo sapiens
taaatagttcttgcctttaagaagtccaaagtttagagatgcagaatatgcacaaagtgccacaggagcacagaaaatacccaattcagacaggggccagragcgcccagtcttaaaataagggtaggggttcctagatagagaaaatagcacacatatgaactctacatcatctttgactctaattgtcaagtgaagatt

SEQ ID NO: 74689 - DNA, 201 bp, Homo sapiens
tggttccaagtctttgctattgtgaatagtgctgcaataaacatacgtgtgcatgtatgtctttatagcagcatgatttataatcctttgggtatatgccmagtaatgggatgaatgcccacacactttttaaaaagtcacaaggacttaccatttttccctatctacaaacaactcatcctcttcaactgcctaagtcaa

SEQ ID NO: 74690 - DNA, 201 bp, Homo sapiens
cctcatgagaactgaagcagagaacccagctaaactgtgcctagactcctgaccacagaaactgagataataaatgtgtgttgttttaagctgccaagtaygtgataatttgttatgtagtggagaactaatacaacagggaaaagttaaaagctattcacataaatatttataatggatactatttctacacatttaaat

SEQ ID NO: 74691 - DNA, 201 bp, Homo sapiens
gtagtttttttcgtataagtttgtcaatccaattattataaactctttgaaggtcctgattacatctcctgcacctttgtgagttcgtacagcaggtagtrattgcttagtatttgctgtgtaaaataataaagcacaataggaacctcaactctgatcattctgcctttgcaatcaaagaaacggagaagctgtgagaac

SEQ ID NO: 74692 - DNA, 201 bp, Homo sapiens
atatataatataatatatataatatatactatataatataatataggatatataatatatataataattatattatatagtatatattatatatattatawtatatactatataatataattatataattatataattaaattatataattaaattatgatttatataattatatattccttatatattataaatgtatat

SEQ ID NO: 74693 - DNA, 201 bp, Homo sapiens
aggcattaggatcacaaggtcaggagattgagaccatcctggccaacatggtgaagcccggtctctactaaaaatacaaaaactttgctgggcgtggtggsgcacaccagtagtcccagctactcaggaggctaaggcaggagaattgcttgaacccaggaggcagaggttgcagtgagctgagattgcgccactgcacgc

SEQ ID NO: 74694 - DNA, 201 bp, Homo sapiens
tatatataatatatactatataatataatataggatatataatatatataataattatattatatagtatatattatatatattataatatatactatatwatataattatataattatataattaaattatataattaaattatgatttatataattatatattccttatatattataaatgtatatattatatatttta

SEQ ID NO: 74695 - DNA, 201 bp, Homo sapiens
gccagggcgcctgcggcctctcttcgcggccttccccgagggactcagagccgcgagggaccgcctagctcccttggggatggggaaggcgtgggagcctmttggggaaagtgaagagctcggtggccgtgactccgcacgagactgcggcagattgtggcggcggcttctctccaagacttacgtaaacgagccttgcca

SEQ ID NO: 74696 - DNA, 201 bp, Homo sapiens
aggatatataatatatataataattatattatatagtatatattatatatattataatatatactatataatataattatataattatataattaaattawataattaaattatgatttatataattatatattccttatatattataaatgtatatattatatattttattgtatataaatattatatatataaagaaac

SEQ ID NO: 74697 - DNA, 201 bp, Homo sapiens
gaaaatggacctcaaggctcatgatgtttgtttctccccaaaggaagatgagaatcttgagttaaaagataaggcatgtgcgtgcgtgcgtgtggggtgtktgcgtgggtgtctgtaaaagtaaacacccaaaggtagaggtttttgtggaagaatgagaggatataggaaggaaataatggtttaatgaacttaaattat

SEQ ID NO: 74698 - DNA, 201 bp, Homo sapiens
tgcagcctcaaactcttaagctcaagtgatcctccggcctcagcctcctaagtagctgggactacaggtgtgtgccattacgcccagctaattaaaaaaawtttttgtagagatgaggtctccctatgttgcccaagctggtgtcaaactcctggcctcaagcaatcctcttgccttggcctcctaaattgctggaactac

SEQ ID NO: 74699 - DNA, 201 bp, Homo sapiens
ttgggaggctgaggcaggcggatcacttgaggccaggaattcaagaccagcctggtgaaaccccaactctattaaaaatacaaagattagccaggcatggyggtgggtgcctgtaatcccagttacttgggaggctgaggcacgagaatcacttgaacccaggaggcagaggttgcagtgagctgagatcctgccactgca

SEQ ID NO: 74700 - DNA, 201 bp, Homo sapiens
aagaccagcctggtgaaaccccaactctattaaaaatacaaagattagccaggcatggtggtgggtgcctgtaatcccagttacttgggaggctgaggcaygagaatcacttgaacccaggaggcagaggttgcagtgagctgagatcctgccactgcactccagcctgggtgacagagcaaaactccttctcaaaaaaaa

SEQ ID NO: 74701 - DNA, 201 bp, Homo sapiens
tcatctatatcaagaaacagaaggcctggcacggtggctcacaccagtaatcccagcacttccggaggccaaggcgggcagatcacgaggtcaggagttcragaccagcctggccaacgtggtgaaacctcatctctactaaaaatacaaaaattagctgggcttggtggtgcattcctgtaatcccagctactggggagg

SEQ ID NO: 74702 - DNA, 201 bp, Homo sapiens
ttttttttttttcagtttcggattatgaaataaaatgctgttcatccactgaagaacagacccttgcttcctgcactatcttcaaaagtttaggtcggagraggtaaaattttaaaaactgatttgttctccttgggatacagtgagatgtggaattcgttaggaatgataattattaatagaaaagatcaaaagaaggaa

SEQ ID NO: 74703 - DNA, 201 bp, Homo sapiens
tttttaaaaagtcacaaggacttaccatttttccctatctacaaacaactcatcctcttcaactgcctaagtcaatggagtccatcgtttctctcatctaygcagtacattttagcttttctcagttacaaatcttatcctgtcttctctcccataatatctttcccacccatctcttctttttactctctaccacaaact

SEQ ID NO: 74704 - DNA, 201 bp, Homo sapiens
agaaaatagcacacatatgaactctacatcatctttgactctaattgtcaagtgaagattaccaatgacaaaatcccagagcatgccagtctaaccagagytatgctatctgaaacatagctctgattaactcactttgcactagggggtggggttgggggtaatacataaaacagaacatccaaacaaaaaaagactgag

SEQ ID NO: 74705 - DNA, 201 bp, Homo sapiens
actatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatt

SEQ ID NO: 74706 - DNA, 201 bp, Homo sapiens
ctatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaattt

SEQ ID NO: 74707 - DNA, 201 bp, Homo sapiens
tttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatat

SEQ ID NO: 74708 - DNA, 201 bp, Homo sapiens
cctatagattgtgaccagattctgttctagctttgccatttagaggggtgtttattttaaaacaaatttttataaaaatttgttaaattgaaaattttgtrtagatccaggaaacttgatttttttgttgttgttcacagtctcactctgtcacccaggctggagtgcagtggctggatcatgctcaccgcacgttcaaat

SEQ ID NO: 74709 - DNA, 201 bp, Homo sapiens
gatatatcaaatatataatatacgatatataatatataatatatgatatcatatattatatattatatatattatatattatatattatattttatatatkatatatgatatatcatatatcatatataatatatatgatatatcatatatcatatataatatatatattttatatattatatatgatataatatatataa

SEQ ID NO: 74710 - DNA, 201 bp, Homo sapiens
caaaaagaaaaaaaaaagaaagaaatagaaaatagtctgggtgcggtggctcatacctgtaatcccagcactttgggaggccagaggctaaagcgggtagrtcacaaggtcaaaagtttgagactatcctggccaacgtggtgaaacccagtctctactaaaaatacaaaaattagccaggcgtggtggcacacgcctgta

SEQ ID NO: 74711 - DNA, 201 bp, Homo sapiens
gtgttatcaatcagacgaattcctgggaattgcggatatagcttgccacagtatcttatcagttaattgcattcttggatgtgctgggagtcagcttgcayaagttaagtccttgaggaaggggctgccagtgaaagagtcaagatggagtctgtctggctctcttagctaagggagagtcaattcaggtggaaacaagcc

SEQ ID NO: 74712 - DNA, 201 bp, Homo sapiens
gaattgcttgaacccaggaggcagaggttgcagtgagctgagattgcgccactgcacgccagcctggtgacagaacgagactccatctcaaaaaaagaaasaaagaaaaagaaaagaaagaaaaggaattgaggaagagatttctagaccacagagcaaaaagggaatgggggaacccagataaaatggcagactgaaaaa

SEQ ID NO: 74713 - DNA, 201 bp, Homo sapiens
tgtgttcagctcttgctcctccctgtcatcctatatctaacctatagattgtgaccagattctgttctagctttgccatttagaggggtgtttattttaaracaaatttttataaaaatttgttaaattgaaaattttgtatagatccaggaaacttgatttttttgttgttgttcacagtctcactctgtcacccaggct

SEQ ID NO: 74714 - DNA, 201 bp, Homo sapiens
atgtccctacaaaggacatgaactcatccttttttacggctgcatagtattccatggtgtatatgtgccacattttcttaatccagtctatcattgatggrcatttgaattggttccaagtctttgctattgtgaatagtgctgcaataaacatacgtgtgcatgtatgtctttatagcagcatgatttataatcctttgg

SEQ ID NO: 74715 - DNA, 201 bp, Homo sapiens
atacaaaaattagccaggcgtggtggcacacgcctgtagtctcagccactcgggaggttgagatatgagaatcgcttgaacccgggaggcagaggttgcartgagctgagatcacgccactgcactccagcctggtgacaaagtgagactctgtcttaaaaaaaaaaagaaacagaaaatgaccagtaccccaaaagggcc

SEQ ID NO: 74716 - DNA, 201 bp, Homo sapiens
tacaaaggacatgaactcatccttttttacggctgcatagtattccatggtgtatatgtgccacattttcttaatccagtctatcattgatggacatttgrattggttccaagtctttgctattgtgaatagtgctgcaataaacatacgtgtgcatgtatgtctttatagcagcatgatttataatcctttgggtatatg

SEQ ID NO: 74717 - DNA, 201 bp, Homo sapiens
ctacaaaagaatctgaaacttcttaggcttaatattaggttggtgcaaaagtaatttctgccattacttttaatggtgaaaaccacaattttacaccaacstaatatatttacttattttattttaatgaatatactaaaccaagagagtttaaaatgaaataagtactgctctgtggccgggcgtagtggctcacgcctg

SEQ ID NO: 74718 - DNA, 201 bp, Homo sapiens
gaatatactaaaccaagagagtttaaaatgaaataagtactgctctgtggccgggcgtagtggctcacgcctgtaatcccagcactttgggaggccgagaygggcggatcacaaggtcaggagatcgagaccatcctggctaacacggtgaaaccccatctctactaaaaaatacaaaaaattagctgggcgtggtggtgg

SEQ ID NO: 74719 - DNA, 201 bp, Homo sapiens
gatatcatatattatatattatatatattatatattatatattatattttatatatgatatatgatatatcatatatcatatataatatatatgatatatsatatatcatatataatatatatattttatatattatatatgatataatatatataatatatgatacatgatatataatattatatattatataatatatt

SEQ ID NO: 74720 - DNA, 201 bp, Homo sapiens
cttaatgtattagacaattggtaattctttgttgtttatgatgataggtttgataggaatctctggacatggagatagaaaaccaggtggctctaccattyattagttctataactatagacagattacttgtctcacctgaacctccatttccttatctgtaaaatggaaatacaatctctttcaataagttgttatgaa

SEQ ID NO: 74721 - DNA, 201 bp, Homo sapiens
ttcccagtgacattaaaggaagcccatactctattgtgtaagaaaagagaaaaactaaacaagctgccaggtgttgaacttctccttgtgtccagttctckttctgccttgtggagctgtaggagagggtcaccaatgcccagacatgccattacaccttcccttcttttgcccaccttcttacctcttaacatcattctc

SEQ ID NO: 74722 - DNA, 201 bp, Homo sapiens
agtgaattttttttccaagtaggaatatgttaagctgttttctctaatcagagacaaattttcaatgcctggataacaagtattatcctaagtgctacccytttttgtgtgccagctatgtgacagaaactcactataccagacactttatatcccaattaatctttgcaacaaacagggcaggaaatagcagttgttcac

SEQ ID NO: 74723 - DNA, 201 bp, Homo sapiens
tacaaaataggttccttggctgcaagtctgatacttgtgctaaaaccaaatagatgaaaaagtatcaacatgaattttaaaaaatatattgtgtgagcttrtatagctaagaattcccagccccctacataggatctgaagaaagatctagtactaattgtattaaataatggtttaggcaaatgtgtatctgtctcctta

SEQ ID NO: 74724 - DNA, 201 bp, Homo sapiens
atataatatatattatatattatacaatatatacattatatattatatattatacaatatatacattatatattatatactatatattatatatcatatayactatatataatatataatatatgatatactatataatatataatatatgatataatatactatgatatataatatatgatatatgatatatcaaatata

SEQ ID NO: 74725 - DNA, 201 bp, Homo sapiens
ataatatatattatatattatacaatatatacattatatattatatattatacaatatatacattatatattatatactatatattatatatcatatataytatatataatatataatatatgatatactatataatatataatatatgatataatatactatgatatataatatatgatatatgatatatcaaatatata

SEQ ID NO: 74726 - DNA, 201 bp, Homo sapiens
atattatacaatatatacattatatattatatattatacaatatatacattatatattatatactatatattatatatcatatatactatatataatatayaatatatgatatactatataatatataatatatgatataatatactatgatatataatatatgatatatgatatatcaaatatataatatacgatatata

SEQ ID NO: 74727 - DNA, 201 bp, Homo sapiens
tattatacaatatatacattatatattatatattatacaatatatacattatatattatatactatatattatatatcatatatactatatataatatatwatatatgatatactatataatatataatatatgatataatatactatgatatataatatatgatatatgatatatcaaatatataatatacgatatataa

SEQ ID NO: 74728 - DNA, 201 bp, Homo sapiens
attattaatgggctgtcttcatttttccctttatccaaatcctacccaggtttcaaggccaacttctggtaaatcctttgctcattccaatccttaaatgytcactccaatccttaaacgatcattccctaattttaatatctacaggattttctgcatcactctgcatttaattaaaactgctttgcatccttgtagttt

SEQ ID NO: 74729 - DNA, 201 bp, Homo sapiens
caaaaactttgctgggcgtggtggcgcacaccagtagtcccagctactcaggaggctaaggcaggagaattgcttgaacccaggaggcagaggttgcagtragctgagattgcgccactgcacgccagcctggtgacagaacgagactccatctcaaaaaaagaaagaaagaaaaagaaaagaaagaaaaggaattgagga

SEQ ID NO: 74730 - DNA, 201 bp, Homo sapiens
agcaagtatctccccaaatctttctgtcttactactaaggcttttgaatttgagagtccaagagtttggcaccttcattctctgctagtcagtgggttttygttgtttgtctttctaatgcaatcagggagagttgttaagtgaagagtgtagagagaaaaaaattctggaacaaataccttacttaaatatcttgatatg

SEQ ID NO: 74731 - DNA, 201 bp, Homo sapiens
tttttttttttttcagtttcggattatgaaataaaatgctgttcatccactgaagaacagacccttgcttcctgcactatcttcaaaagtttaggtcggargaggtaaaattttaaaaactgatttgttctccttgggatacagtgagatgtggaattcgttaggaatgataattattaatagaaaagatcaaaagaagga

SEQ ID NO: 74732 - DNA, 201 bp, Homo sapiens
attatttatatatttaatatatatcatatataatatatattatatattatacaatatatacattatatattatatattatacaatatatacattatatatyatatactatatattatatatcatatatactatatataatatataatatatgatatactatataatatataatatatgatataatatactatgatatataa

SEQ ID NO: 74733 - DNA, 201 bp, Homo sapiens
aggcggaggttgtagtgagccaagattgtagtgagccaaggttgtatagtgagccactacactccagcctgggtgacagagcaagacttggtctcaaaaakaaaaaaaaaagaaagaaatagaaaatagtctgggtgcggtggctcatacctgtaatcccagcactttgggaggccagaggctaaagcgggtaggtcacaa

SEQ ID NO: 74734 - DNA, 201 bp, Homo sapiens
ctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcc

SEQ ID NO: 74735 - DNA, 201 bp, Homo sapiens
tataatatactatgatatataatatatgatatatgatatatcaaatatataatatacgatatataatatataatatatgatatcatatattatatattatrtatattatatattatatattatattttatatatgatatatgatatatcatatatcatatataatatatatgatatatcatatatcatatataatatatat

SEQ ID NO: 74736 - DNA, 201 bp, Homo sapiens
tctcaaaaaaaaaaaagaaagaaataagcactgctctgtaaaggtaaacacagaggaagggatctagctcagagatctccatactgtggacttccagggawaaccctggtcaaatagccatgggctggtcaatgattttgagttactctttgagagggaagcttggcttcagagaaggaaaggccagtgcaagacatgtga

SEQ ID NO: 74737 - DNA, 201 bp, Homo sapiens
acaaaggacatgaactcatccttttttacggctgcatagtattccatggtgtatatgtgccacattttcttaatccagtctatcattgatggacatttgarttggttccaagtctttgctattgtgaatagtgctgcaataaacatacgtgtgcatgtatgtctttatagcagcatgatttataatcctttgggtatatgc

SEQ ID NO: 74738 - DNA, 201 bp, Homo sapiens
agttggccaggctgatctcaactcctaaaagtgatgggattacaggggtgagccaccgccccccaagaacccttttatcaaccattttaactgcactattmtcttcagttcccttgaccttcagctatgtttaccttatcaggctatttcctaactatttcctttttccttgagctatcagccccaccgtaacatttattc

SEQ ID NO: 74739 - DNA, 201 bp, Homo sapiens
atgtatggacagatctgtgatcaaagcctgggttaatcattgcggataagctgtatattcttaagtaatttcttccccctcccctcccctcccctcccctyccctcctctgtcctcccctcccctgttctctcctctccttttttttttctttgagacagggtctggctttattgcccaggctggagtgcagtgatgggat

SEQ ID NO: 74740 - DNA, 201 bp, Homo sapiens
agcaggtagtaattgcttagtatttgctgtgtaaaataataaagcacaataggaacctcaactctgatcattctgcctttgcaatcaaagaaacggagaarctgtgagaacattccatgcttctctaggagccaagctgcaaatgtattagggccagagaattctgactcccattaaaatgagcagctctgaaaggaggga

SEQ ID NO: 74741 - DNA, 201 bp, Homo sapiens
taggcaaatgtgtatctgtctccttaagagaggaaggcagtccctactgtaaagtaaaaatgaaatggatatacttcctgagagggctggaattttctgawaattgtcccctctgatttttcacaggatttacggaatggccatcttccataattaacaaataaataaatgaaatttaatgtcagggtcaaatgaaactgg

SEQ ID NO: 74742 - DNA, 201 bp, Homo sapiens
ggcgggcgttaagaggggtgcgtgcgtgcgcctgggtgaagtttgtactcagggctgcgataatcgaggtgacaaagttgtggaagtagaattcggaggtscgggagcaggaaggggaaggaatgtggggatttccaggctgggctgacaagttccgggcgctgctctcagggggaagggaggtctcctcgagtgccagat

SEQ ID NO: 74743 - DNA, 201 bp, Homo sapiens
taagttcccaaaccaaattgtggcactggggtttttatgagaaacgtgtcaacatgacaaaatgattcagagcacaggatttggagtcacacagatctagktttcagcgagactcctgtttccttctctataaaggggacattttaacacctacttcacatgtatttaactttcgccctaacactgaactgaagtgcaaag

SEQ ID NO: 74744 - DNA, 201 bp, Homo sapiens
tgaagcaagttcatgaaagatgagtaggaactcactaagggagataatggagggaagcagttcttggcagagggaacagcaagaggaagcagtgggaatgygaaaggacaaggtattaccaagaggtctggtgagagtagatcagggagtgcggggtgagaaataaattgagacgagaaggtggaggccttccttaaaagc

SEQ ID NO: 74745 - DNA, 201 bp, Homo sapiens
ccaaaccaaattgtggcactggggtttttatgagaaacgtgtcaacatgacaaaatgattcagagcacaggatttggagtcacacagatctagttttcagmgagactcctgtttccttctctataaaggggacattttaacacctacttcacatgtatttaactttcgccctaacactgaactgaagtgcaaagccttgga

SEQ ID NO: 74746 - DNA, 201 bp, Homo sapiens
ctgaaacagctcgctattcactcctattttcttctttagatttcaattaaaaggcagctctgctagttactgtgttttggctggaatggaaagcctttggratagcagtgttccagtgtgtgaacgtaagtaataggagtaacatttcaggccaatctctcctcttcatctgttcagtatttgacccatgacctcccctaa

SEQ ID NO: 74747 - DNA, 201 bp, Homo sapiens
ctgttgaaagcattaagaatgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaa

SEQ ID NO: 74748 - DNA, 201 bp, Homo sapiens
aaccagggaggcggggttgcagtgagccaagatcgtgccactgcattccagcctggacaacaaaagcaaaattccctctcaaaaaaaaaaaaaaaaaaaaraaagaaagaaagaaagaaaaaagaaactaaaataagacagaaatagaagtaattcacacacagaaatcatctcaccttctttaaaatgctcctcaaggag

SEQ ID NO: 74749 - DNA, 201 bp, Homo sapiens
ttgaaaaaccttatttctgagactgctacaatgtgaagcatctcaagaacaggcactgagcactcggtaatagcctttgttctgcaggacttttaaagtcmtagatattggggatactggacatttaagtgaaatgtgcttttagagagtaaatgtaattttcatagattttctattgctataacacaatacgtgagacta

SEQ ID NO: 74750 - DNA, 201 bp, Homo sapiens
tagcaggctgatgtatatctcaaacactggagacaattcagaaactgcataaacagtctgaagacttactaagaaactaaaatgaggctgggcgcggtggytcaggcctgtaatccctgcatttagggaggcctaggcgggtggaccacctgaggtccggagttggagaccagcctggactacatgataaaaccccatctc

SEQ ID NO: 74751 - DNA, 201 bp, Homo sapiens
gtgaactaagtgtcctcttggctgaaacagctcgctattcactcctattttcttctttagatttcaattaaaaggcagctctgctagttactgtgttttgkctggaatggaaagcctttggaatagcagtgttccagtgtgtgaacgtaagtaataggagtaacatttcaggccaatctctcctcttcatctgttcagtat

SEQ ID NO: 74752 - DNA, 201 bp, Homo sapiens
gaaaaaccttatttctgagactgctacaatgtgaagcatctcaagaacaggcactgagcactcggtaatagcctttgttctgcaggacttttaaagtcatrgatattggggatactggacatttaagtgaaatgtgcttttagagagtaaatgtaattttcatagattttctattgctataacacaatacgtgagactaga

SEQ ID NO: 74753 - DNA, 201 bp, Homo sapiens
acagtgaaacccccatctctactaaaaatacaaaaagttagctgggcatggtggcgtgtgcctgtagtcccagctactcgggaggctgaagcaggagaatygcttgaacctagaaggcggaggttgtggtgagctgagatcgcaacactgcactccagtctgggcaacagagcagactctgtctaaaaaataaaaataaaa

SEQ ID NO: 74754 - DNA, 201 bp, Homo sapiens
tgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttggctggaatggaaagcctttggaatagcagtgttc

SEQ ID NO: 74755 - DNA, 201 bp, Homo sapiens
tcagaagttcgagaccagcctggccaacacagtgaaacccccatctctactaaaaatacaaaaagttagctgggcatggtggcgtgtgcctgtagtcccarctactcgggaggctgaagcaggagaatcgcttgaacctagaaggcggaggttgtggtgagctgagatcgcaacactgcactccagtctgggcaacagagc

SEQ ID NO: 74756 - DNA, 201 bp, Homo sapiens
acatgaagtccttgcctatgcctatgtcctgaatggtaatgcctaggttttcttctagggtttttatggttttaggtctaatgtttaagtctttaatccaycttgaattgatttttgtataaggtgtgaggaagggatccagtttcagctttctacatatggctagccagttttcccagcaccatttattaaatagggaat

SEQ ID NO: 74757 - DNA, 201 bp, Homo sapiens
gtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttga

SEQ ID NO: 74758 - DNA, 201 bp, Homo sapiens
tggcactttgcattaccatataaaatttagaatcagcttgtcaatttccacaaaaagaatcctacttgaatttgtattgagtttctattgacttagtacawcaatttgtagacattaacaaatttagttttgaagtttaaatttatgaacatgatatatcctcccatttttgaagtcttctttaatttcttttaaaaatat

SEQ ID NO: 74759 - DNA, 201 bp, Homo sapiens
gtggatgtcattccagggaggttctgttccactggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttact

SEQ ID NO: 74760 - DNA, 201 bp, Homo sapiens
tggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattacta

SEQ ID NO: 74761 - DNA, 201 bp, Homo sapiens
ccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctctttttt

SEQ ID NO: 74762 - DNA, 201 bp, Homo sapiens
tgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtg

SEQ ID NO: 74763 - DNA, 201 bp, Homo sapiens
ttactaactatgaggccttcagcaggcataggatatagcaaaagaaattcccccataactaacaagtactctggaactgtcctttctacaatgtgtcagcygcctccagaaatcctgcatggtgagcataccctaagccatcaggacaactttttacctgggcaggaagtgttctacagctgtgagcccagctatgacctc

SEQ ID NO: 74764 - DNA, 201 bp, Homo sapiens
gaattttcttggaaatattaaaaaaaattagtaaaatagaaaaaacaaacaatataataatacacctatacctatatctatatttttatctctgtttctasttctgtaaactctctatacccaaatcctggtaaatggctgtaagtcttcttggagaagactaggggaagatttacaatacatgcttttgactgcgtagca

SEQ ID NO: 74765 - DNA, 201 bp, Homo sapiens
tagagtaacctaaatattttaaactatggtttggaaataatctactagtaggaaaaagatgtgttcaaatgaccattacaaagaattccctaagaaacatraaatagctatgcagaatgaaaataagtatatccatacactggcatggtattcagccataaaaaatgatagcataaagaagcacttaatgactagaaagag

SEQ ID NO: 74766 - DNA, 201 bp, Homo sapiens
atttcaaaaccttcctcagagcaaggggtaattgccaggtaccctttaaagccagaattaatacatataacccatatttatgctgtctcaagactaattarcatggtgttgcatgctagacaaataagttcaactccagaaaacatgtaaaaactaacagaagtttcaacttgaatatcttaagagaggcttaaagaaaaa

SEQ ID NO: 74767 - DNA, 201 bp, Homo sapiens
ttatttatattagttaaaatgttagagtaacctaaatattttaaactatggtttggaaataatctactagtaggaaaaagatgtgttcaaatgaccattayaaagaattccctaagaaacatgaaatagctatgcagaatgaaaataagtatatccatacactggcatggtattcagccataaaaaatgatagcataaaga

SEQ ID NO: 74768 - DNA, 201 bp, Homo sapiens
cataggtgggaattgaacaatgagatcacatggacacaggaaggggaatatcacactctggggactgtggtggggtcgggggaggggggagggatagcatygggagatatacctaatgctagatgacacgttagtgggtgcagcgcaccagcatggcacatgtatacatatgtaactaacctgcacaatgtgcacatgtac

SEQ ID NO: 74769 - DNA, 201 bp, Homo sapiens
tcttgaaaggccccatgcactataaacctcagaagtgggcatgtattttaacctacttcttagaatttatacttaggaaataatcacacactttttaaagyagtttggtataaacttttcattgcagcattatttatattagttaaaatgttagagtaacctaaatattttaaactatggtttggaaataatctactagta

SEQ ID NO: 74770 - DNA, 201 bp, Homo sapiens
atcacttgaacctgggacgcggaggttgcagtgagctaagatcacacgactgtgctccagcctggatgacagagtgagatatcacctcaaaaaaaaaaaaacacaaaaaacaagaaacaaaaataatttacatgtaattgaagcgggcttacaggagtataaatacagttgcctgccaggagctcatatgttgctgactct

SEQ ID NO: 74771 - DNA, 201 bp, Homo sapiens
accaaacaccgcatattctcactcataggtgggaattgaacaatgagatcacatggacacaggaaggggaatatcacactctggggactgtggtggggtcsggggaggggggagggatagcatcgggagatatacctaatgctagatgacacgttagtgggtgcagcgcaccagcatggcacatgtatacatatgtaacta

SEQ ID NO: 74772 - DNA, 201 bp, Homo sapiens
ggactctcatgtaccacgagatcaacacatcctcttgaaaggccccatgcactataaacctcagaagtgggcatgtattttaacctacttcttagaatttrtacttaggaaataatcacacactttttaaagcagtttggtataaacttttcattgcagcattatttatattagttaaaatgttagagtaacctaaatatt

SEQ ID NO: 74773 - DNA, 201 bp, Homo sapiens
aatcacttgaacctgggacgcggaggttgcagtgagctaagatcacacgactgtgctccagcctggatgacagagtgagatatcacctcaaaaaaaaaaamacacaaaaaacaagaaacaaaaataatttacatgtaattgaagcgggcttacaggagtataaatacagttgcctgccaggagctcatatgttgctgactc

SEQ ID NO: 74774 - DNA, 201 bp, Homo sapiens
ttccttcagttctgctctgatcttagttatttcttgccttctgctagcttttgaatgtgtttgctcttgcttctctagttcttttaattgtgatgttaggktgtcaattttagatctttcctgctttcttttgtgggcatttagtgctataaatttccctttacacactgctttaaatgtgtcccagagattctggtatgt

SEQ ID NO: 74775 - DNA, 201 bp, Homo sapiens
gaacctggactctcatgtaccacgagatcaacacatcctcttgaaaggccccatgcactataaacctcagaagtgggcatgtattttaacctacttcttaraatttatacttaggaaataatcacacactttttaaagcagtttggtataaacttttcattgcagcattatttatattagttaaaatgttagagtaaccta

SEQ ID NO: 74776 - DNA, 201 bp, Homo sapiens
aatctcatgaggctgaggcaggagaatcacttgaacctgggacgcggaggttgcagtgagctaagatcacacgactgtgctccagcctggatgacagagtragatatcacctcaaaaaaaaaaaaacacaaaaaacaagaaacaaaaataatttacatgtaattgaagcgggcttacaggagtataaatacagttgcctgc

SEQ ID NO: 74777 - DNA, 201 bp, Homo sapiens
ttcgttgcttatgtgtatccattattcttggtgatacagtatgagtctgggggataactagattgagcaattaaggagttatttttaataatttccaaggmttctttggcatttacaaagtccaccacctaataatgatttccaatttcagaacgattttagatttcagaagggaagcagtactcaatagtaagttgagca

SEQ ID NO: 74778 - DNA, 201 bp, Homo sapiens
aagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctga

SEQ ID NO: 74779 - DNA, 201 bp, Homo sapiens
agttcttgtcccgcatccaagaagaacaagcttatgctgacaatagaagggtgaggagggtggagaagagttttattgagtgacaaaacagcttctcagcrgagaagagacacaagggtggaccccagatgaagtcagggggtcattctctcagtgtggctggttctggagcctttatggactcagaattggaagtgtgtg

SEQ ID NO: 74780 - DNA, 201 bp, Homo sapiens
atgagtatttgtttagggggagggatgtatgttgaggagggtgggaaagtaagttttgggggaagaagcatgaaattaagaatctggggtgtgcatgcacycatgcatatgtgtcttcattttgaaaagcaagaccttaattagccaagaaaactggtattttggactcacctattaatcaattgtcagggcaaagtacca

SEQ ID NO: 74781 - DNA, 201 bp, Homo sapiens
cagagggggtgtaacagcatggtaatagctcttagcatttgataatgcctgcagcccaacagatggcggtgtgttaacaactctgtcagttccatcgcccygctcaggcctgcatctccaaggctgacttggcctgcatctccaaggctgacttggcctgcatctccagggctgactggacctgctggtgcttcctgttgc

SEQ ID NO: 74782 - DNA, 201 bp, Homo sapiens
aggagatgagtatttgtttagggggagggatgtatgttgaggagggtgggaaagtaagttttgggggaagaagcatgaaattaagaatctggggtgtgcawgcacccatgcatatgtgtcttcattttgaaaagcaagaccttaattagccaagaaaactggtattttggactcacctattaatcaattgtcagggcaaag

SEQ ID NO: 74783 - DNA, 201 bp, Homo sapiens
cttctccgagaagccgggagcctgttgggcagccggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctg

SEQ ID NO: 74784 - DNA, 201 bp, Homo sapiens
agcatggccaacatgaccaaaccccaactccaccagaaatacaaaaataaaccagatacggtggtgcgtgcctgtaatcccagctactcgggaggttgagrggggaggattgcttgacctgggaagttgagattgcagtgagccatgatcgtgccactgcactccagcctgggcgacagagcaagactctgtcccaaggtt

SEQ ID NO: 74785 - DNA, 201 bp, Homo sapiens
gttcagtttccatgtagttgagctgttttgagtgagtttcttaatcctgagttctagtttgattgcactgtggtctgagagacagtttgttataatttctkttcttttacatttgctgtggagcgctttacttccaactatgtggtcaattttggaataagtgtggtgtggtgctgaaaagaatgtatattctgttgattt

SEQ ID NO: 74786 - DNA, 201 bp, Homo sapiens
agcaaagaggaatgagcaattgcaagctaataaggaatataaaatgtgtataatcctgggtttagtgatggtgtgaggaaatcagcaatttcaaacccatytggtgggagaataagtgggaacaaactttgtagaagggcaatatactggctgggcactgccctacagtagagtaggacacagtattcagttcttccaaga

SEQ ID NO: 74787 - DNA, 201 bp, Homo sapiens
aatggcagaaataatatgggaaaagacagaacttaagaaagaaattgtcaagcaggtctacaaaatgattgttttattttggtgccaggtacagtccacartgaagtcaagatattaagaagtaaagtggaccaggagaagttagagcagaaatatctcttttcaatagtgagagcagaaaaagaagtagaaaagctggga

SEQ ID NO: 74788 - DNA, 201 bp, Homo sapiens; identical to SEQ ID NO: 38021

SEQ ID NO: 74789 - DNA, 201 bp, Homo sapiens
aaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttc

SEQ ID NO: 74790 - DNA, 201 bp, Homo sapiens
atgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctc

SEQ ID NO: 74791 - DNA, 201 bp, Homo sapiens
tgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaaggg

SEQ ID NO: 74792 - DNA, 201 bp, Homo sapiens
aatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtg

SEQ ID NO: 74793 - DNA, 201 bp, Homo sapiens
tcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccgactcattggttcctcgtctgccacatgcatcatctc

SEQ ID NO: 74794 - DNA, 201 bp, Homo sapiens; identical to SEQ ID NO: 8306

SEQ ID NO: 74795 - DNA, 201 bp, Homo sapiens
ttgatcgtctgaagccttcttctctcaactcatcaaagtcattctccatccagctttgttcctttgctggtgaggagctgcgttcctttggaggaggagargcgctctgatttttagagtttccagtttttctgctctgttttttccccatctttgtagttttatctacctttggtctttgatgatggtgacatacagata

SEQ ID NO: 74796 - DNA, 201 bp, Homo sapiens
tgtggaagaacctggactctcatgtaccacgagatcaacacatcctcttgaaaggccccatgcactataaacctcagaagtgggcatgtattttaacctayttcttagaatttatacttaggaaataatcacacactttttaaagcagtttggtataaacttttcattgcagcattatttatattagttaaaatgttagag

SEQ ID NO: 74797 - DNA, 201 bp, Homo sapiens
tgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgt

SEQ ID NO: 74798 - DNA, 201 bp, Homo sapiens
ggagtcttgccatattgcccaggctggtctcaaactcctgggctcaagctatcctcccaccttggcctccaaaagtgttaggattacaagtgtgagccacygtacccagccaaatttttatgttcttttatcccctcacttatcataaacaatttagtcagcttgttttttagcctgcagtattgaatgacatagggcttc

SEQ ID NO: 74799 - DNA, 201 bp, Homo sapiens
cactgtgaatggcctactttgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactc

SEQ ID NO: 74800 - DNA, 201 bp, Homo sapiens
taatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgca

SEQ ID NO: 74801 - DNA, 201 bp, Homo sapiens
tgcagcctcaatctcccaggctcaagcgatcttcctgcctcagccttctgagtagctaggactacaggaatgtgccaccatgcgtggctttttaataaaawttttgttgagacagggtctcactatgttgcccaggcttctctcgaactcctgagctcaagcagtcctcctacctcagcctccaaacgtgctgggattaca

SEQ ID NO: 74802 - DNA, 201 bp, Homo sapiens
ggtcagcttggattgcctttggttctagttataaatcattttctttctttctttctttctttctttctttttttctttctttttctttctttctttctttytctttctttccttccttccttccttccctccttccttccttctttctttctttctctttctttctttctctctttctctttctctctctctctccctctg

SEQ ID NO: 74803 - DNA, 201 bp, Homo sapiens
aatgagcaattgcaagctaataaggaatataaaatgtgtataatcctgggtttagtgatggtgtgaggaaatcagcaatttcaaacccatctggtgggagrataagtgggaacaaactttgtagaagggcaatatactggctgggcactgccctacagtagagtaggacacagtattcagttcttccaagatcagatgaaa

SEQ ID NO: 74804 - DNA, 201 bp, Homo sapiens
ataaaataagtgttcagttctttttggtcagcttggattgcctttggttctagttataaatcattttctttctttctttctttctttctttctttttttctttctttttctttctttctttctttttctttctttccttccttccttccttccctccttccttccttctttctttctttctctttctttctttctctcttt

SEQ ID NO: 74805 - DNA, 201 bp, Homo sapiens
ttaaacttcttgtcaaaaaaccaagtctactagacaggatcaaaagcaacaaatcttgtatttataaaaaacatgcctcaagttaaatggcatagtattakacacacacacacacacacacacacacacacacacatattaagggaatacgcaaacaaaaaatggcagaaataatatgggaaaagacagaacttaagaaag

SEQ ID NO: 74806 - DNA, 201 bp, Homo sapiens
taacattttaagtataaaataagtgttcagttctttttggtcagcttggattgcctttggttctagttataaatcattttctttctttctttctttctttytttctttttttctttctttttctttctttctttctttttctttctttccttccttccttccttccctccttccttccttctttctttctttctctttctt

SEQ ID NO: 74807 - DNA, 201 bp, Homo sapiens
acaataggtaaagtttaggctaggccttagacttctcctatattgtaatccctctggtttgccacatatgcatgctgtcaggaagttgatgaggtatgtamagcacaattattttccattttttgcctttaggcaccgactcattggtcactcatctgctgaatgtatcctctcgggcaatactgcccattggagcatgaa

SEQ ID NO: 74808 - DNA, 201 bp, Homo sapiens
gaaatctccaagaaatctttttcttggcaatagattgcctgggtgaacatgaaactgaaatttgcccttataataggtaaagaaagaaaataatatgcccwtgcattcaaaaccgcaatgcagaattttgaccttgattccaatctgtttagaaactggattgaaaaaatctcaaaattattttcttttaggaaaaacatg

SEQ ID NO: 74809 - DNA, 201 bp, Homo sapiens
gtatatatatatatatatatatatatatatataaaacactgaatattgcagaaaattaaagcaaagagtaagaagagttaaccaaattttccctcaatgcrgtgggaaaagatgaaaaggagaagataggtgggcacagtggctcacacctgtaatcccaacactgagaggccgaagcaagagaatcacttgaccccagga

SEQ ID NO: 74810 - DNA, 201 bp, Homo sapiens
ccagctacttgagaggctgaggcaggagaatcacttgaatctgggaggtggaggttgcagtgacattgcactccagcctgggcgacaagagtgaaactctmtctcaaaaataataataataataaataaccaaaatgatatcgaagtcactaataattacaacataatagctactataatgtaacaatgtgtcaagtgtct

SEQ ID NO: 74811 - DNA, 201 bp, Homo sapiens
gaacaataggtaaagtttaggctaggccttagacttctcctatattgtaatccctctggtttgccacatatgcatgctgtcaggaagttgatgaggtatgkacagcacaattattttccattttttgcctttaggcaccgactcattggtcactcatctgctgaatgtatcctctcgggcaatactgcccattggagcatg

SEQ ID NO: 74812 - DNA, 201 bp, Homo sapiens
gggagacacaattcaacctataacagagtccctttgaaaatgtcaagtgtcaggtgctcacagcgcatggtccagctgttggtgctcacccttgctcagcrcacagtggaggctctgcctcaatctcactcttcacgggaacagctaagccaggtagtgagtaggggctatgtttgtgccaccgcaacaaacacagaaagg

SEQ ID NO: 74813 - DNA, 201 bp, Homo sapiens
catagtggcgtgcacctgtaatcccagctacttgagaggctgaggcaggagaatcacttgaatctgggaggtggaggttgcagtgacattgcactccagcytgggcgacaagagtgaaactctatctcaaaaataataataataataaataaccaaaatgatatcgaagtcactaataattacaacataatagctactata

SEQ ID NO: 74814 - DNA, 201 bp, Homo sapiens
gtgagagcagaaaaagaagtagaaaagctgggaacaataggtaaagtttaggctaggccttagacttctcctatattgtaatccctctggtttgccacatrtgcatgctgtcaggaagttgatgaggtatgtacagcacaattattttccattttttgcctttaggcaccgactcattggtcactcatctgctgaatgtat

SEQ ID NO: 74815 - DNA, 201 bp, Homo sapiens
ttctctttttataaggacaccgggcatattggattagggcctaccttaatgacctcagcttaactggattgcatctgcaaagattgtatttccaaataagrtcacatccacagggactgggggttaagacttcccaacatatttgggggagacacaattcaacctataacagagtccctttgaaaatgtcaagtgtcaggt

SEQ ID NO: 74816 - DNA, 201 bp, Homo sapiens
cattacttttatgatttattactggttatcttctaggatttccattataaaatatgaaacgtagtgagcatttttttggtttttttttgagacggagtctygctctgttgcccaggctggagtgcagtggcatgatctcggctcactgcaagctctgcctcccgggttcccgccattctcctgcctcagcctcccgagtag

SEQ ID NO: 74817 - DNA, 201 bp, Homo sapiens
catcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaatttt

SEQ ID NO: 74818 - DNA, 201 bp, Homo sapiens
ggatcaaaagcaacaaatcttgtatttataaaaaacatgcctcaagttaaatggcatagtattacacacacacacacacacacacacacacacacacacayattaagggaatacgcaaacaaaaaatggcagaaataatatgggaaaagacagaacttaagaaagaaattgtcaagcaggtctacaaaatgattgttttat

SEQ ID NO: 74819 - DNA, 201 bp, Homo sapiens
tcaaaaaattcatatgacttggtttgttgtgatatttgttttattgtggtgttctggaactgaacctgcaatatctttgaggaatgtctgtaacacaaaaygggtggcttaatacaacagaagtttttggagttctgttctatagactggaagtccaaaatcaaggtgttgggaagaccatgctccctctgaatcctgtag

SEQ ID NO: 74820 - DNA, 201 bp, Homo sapiens
caggatcaaaagcaacaaatcttgtatttataaaaaacatgcctcaagttaaatggcatagtattacacacacacacacacacacacacacacacacacayatattaagggaatacgcaaacaaaaaatggcagaaataatatgggaaaagacagaacttaagaaagaaattgtcaagcaggtctacaaaatgattgtttt

SEQ ID NO: 74821 - DNA, 201 bp, Homo sapiens
aggaaagaattaatcattctacatactgttaagaacactcatgattcatgggaagaggttaaaatatcaacattaacaggagtttggtagaagttgattcygaccctcatggatgactttgagaggttcaagacttcagcggaggaaataattgcagatgtgacagaagtagcaagaacactacaattagaagcagagcct

SEQ ID NO: 74822 - DNA, 201 bp, Homo sapiens
aagttttagtatttaagaaatatattttgtgccaggcatggtgtaatcccagcatattgggagaccaaggtgggcggatcatgaggtcaggatttcaagascagcctggccaacatagtgaaaccccgtctctattaaaaatacaaaaattggccagcatggcagaatgtgcctgtagtcccaactactcaggaggctgag

SEQ ID NO: 74823 - DNA, 201 bp, Homo sapiens
gcactccagcctgagcgacagagccagactccgtctaaaaaaacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattacacac

SEQ ID NO: 74824 - DNA, 201 bp, Homo sapiens
tgttgaaagccaagacaggccaaaagtcaggcctcatgtgccaaacagctagcgagttgcaaaggcaaagcaaaagtacttgaaggaaacttaaagtgctmttccagtgaacacatgaatgataagaaggtgaaacagccttattgctgatatggaagaagttttagtggtctagatacaagatcaaactagacatatttc

SEQ ID NO: 74825 - DNA, 201 bp, Homo sapiens
acatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggat

SEQ ID NO: 74826 - DNA, 201 bp, Homo sapiens
gcttgctagggctgccatcaaaaagtacaggccttcctcattttattgtacttcacagatgttatgctttttacaaattgaaggcttgtggcaacgctgcracaagcatgtcagttggcatcatttatccaacagtgtgtgttgacttcgtgtctctgtgtagcattttggttattctcacaatatcccagatgttttcat

SEQ ID NO: 74827 - DNA, 201 bp, Homo sapiens
tcttggaaaaaccttgattaccctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacat

SEQ ID NO: 74828 - DNA, 201 bp, Homo sapiens
tagaaatgaggaagagactattataaacaaatcagtagatgctagaaaggagtaacaacttgaaacctgacccagaaagtaaaaaaagaaaataaatcatsaacagaccttgacattttcaaaagcaaagcaatctgaatccatttggagttttttataatggcctgaatatgtttcaattcactgtggcagggctattgt

SEQ ID NO: 74829 - DNA, 201 bp, Homo sapiens
tattacactaagagtccagaaggaggagagattcctgtgaatttaaatcagggaagatttcactgagtataggtgtatactcaatgaaagtattcctataytcaatgagctactcctagaaagacattctgttctaaataatattaataggagctaaaactcgtgtagcactcactatgtgccaaatgctaacttatctaa

SEQ ID NO: 74830 - DNA, 201 bp, Homo sapiens
gaattctataagagtgtaatctctggaagtagtaatctaattgggtagttgacctgtgtatttagaatgtaacattccttattttttgcctctagataccractcattggttcctcgtctgccacatgcatcatctcaggcaacactgtcatttgggataataaaacacctgtttgtgacagtgagttgaaatatgcattc

SEQ ID NO: 74831 - DNA, 201 bp, Homo sapiens; identical to SEQ ID NO: 38041

SEQ ID NO: 74832 - DNA, 201 bp, Homo sapiens; identical to SEQ ID NO: 38042

SEQ ID NO: 74833 - DNA, 201 bp, Homo sapiens; identical to SEQ ID NO: 38043

SEQ ID NO: 74834 - DNA, 201 bp, Homo sapiens
ctgtatgtggtttctggaaacgaaatgatcatggcatttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttc

SEQ ID NO: 74835 - DNA, 201 bp, Homo sapiens
tcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatc

SEQ ID NO: 74836 - DNA, 201 bp, Homo sapiens; identical to SEQ ID NO: 38044

SEQ ID NO: 74837 - DNA, 201 bp, Homo sapiens; identical to SEQ ID NO: 38045

SEQ ID NO: 74838 - DNA, 201 bp, Homo sapiens
gaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcat

SEQ ID NO: 74839 - DNA, 201 bp, Homo sapiens
ctgggggtctcccactttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaag

SEQ ID NO: 74840 - DNA, 201 bp, Homo sapiens
tcaggagaattgcttgaactcgggaggcagaggttgcagtgagcagatattgcaccattgcactccagcctgagcgacagagccagactccgtctaaaaamacaaacaaacaaacaaagcaaatcaaatatataatttatttcaatccatttggtttaaacttcttgtcaaaaaaccaagtctactagacaggatcaaaag

SEQ ID NO: 74841 - DNA, 201 bp, Homo sapiens
tcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctcca

SEQ ID NO: 74842 - DNA, 201 bp, Homo sapiens
gctttgagttcctggcaccttcattacaagtttatttcatgagaaaccgtcattgcaggacatgattgagggaaaacccccattcactgggggtctcccaytttcatgactaaaattaagtaatgaatgacttgggacaagaaagagaagtggattaaataactaaaagatgcgacaatcttgggctttgagatctttgga

SEQ ID NO: 74843 - DNA, 201 bp, Homo sapiens
tggcaatgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgc

SEQ ID NO: 74844 - DNA, 201 bp, Homo sapiens
tcttgtagatcataccttgttactgctttgagttcctggcaccttcattacaagtttatttcatgagaaaccgtcattgcaggacatgattgagggaaaayccccattcactgggggtctcccactttcatgactaaaattaagtaatgaatgacttgggacaagaaagagaagtggattaaataactaaaagatgcgaca

SEQ ID NO: 74845 - DNA, 201 bp, Homo sapiens
aaaaaggagaatgatgaattcctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttacagaaa

SEQ ID NO: 74846 - DNA, 201 bp, Homo sapiens
actcaagttggactgcagaggtgagatcatggcttactgcaaccgccacctccctggctcaagcaattctcctgcctgagcctcccaagcagctgggactrcaggtgcatgctaccacacctggttaaattttttatattttttttatagagatcgaatctcaccatgtttcccaggcttgtctcgaacacctgagctgaa

SEQ ID NO: 74847 - DNA, 201 bp, Homo sapiens
gagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgt

SEQ ID NO: 74848 - DNA, 201 bp, Homo sapiens
atacacattaaagaataagcaaagacacaaaaattgtaccatttaagtatgtttcccaggcaattaataagcaaatttttaaaaaggagaatgatgaattsctaaagaaatctcaatgagatagaaaagtggtaaaaacaaacaacaacaacaaaaaaccataaacacaaaaactggcaatgtaatcataatttagtaata

SEQ ID NO: 74849 - DNA, 201 bp, Homo sapiens
catttttctaattgtggttcctttgaaggttattgtctatgtttcctgctgcttttatggattacactttaaaatagattttttacaatattactatgttktgtctaggtaagtatttctttgtattgcttgggtttatcttgttgcacaactggagtgcagtggcgcgatctcggctgactgcaatctccacctcccaga

SEQ ID NO: 74850 - DNA, 201 bp, Homo sapiens
agatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccataga

SEQ ID NO: 74851 - DNA, 201 bp, Homo sapiens
cttctgttgagccaagctaatattcacatctagaggctccagatacacattaaagaataagcaaagacacaaaaattgtaccatttaagtatgtttcccargcaattaataagcaaatttttaaaaaggagaatgatgaattcctaaagaaatctcaatgagatagaaaagtggtaaaaacaaacaacaacaacaaaaaac

SEQ ID NO: 74852 - DNA, 201 bp, Homo sapiens
attggccgatggatccccttctctctctctctctacgttcctcgcactgaccaacctctttgtgatcttcaggcgtgccatacccccagcccgtaataaamtctttactgccatcttgtgtttcttgtaatgactgaagaggttttctctatcataaagatcctaaatgaaaacatacccgcatatgagctctttctggtg

SEQ ID NO: 74853 - DNA, 201 bp, Homo sapiens
tagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatag

SEQ ID NO: 74854 - DNA, 201 bp, Homo sapiens
aggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcaccc

SEQ ID NO: 74855 - DNA, 201 bp, Homo sapiens
gttagccacatttgattggccaaaactcggtgattggcataagagtaacctacggtctgtttacatcttcactcgttataattcgcagtttacagagaaayctttaggctgagcttaaactatgtaaggctttaggctaaacttgatttaacaatttacatatgttatatatttcaaagacgtaattgttgttgttgtctt

SEQ ID NO: 74856 - DNA, 201 bp, Homo sapiens
atagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccata

SEQ ID NO: 74857 - DNA, 201 bp, Homo sapiens
tatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggca

SEQ ID NO: 74858 - DNA, 201 bp, Homo sapiens
caatgaagcaatctggacctgagggtttgttgttgttgttgttaggttttaaattagtgattcaatttctttaatagctataaaagtattattttatatcrtattgaattagtttgggtaagttatatttttcaaggaatttactcattttatttaaattttctaggttattagcataatgctatttattatatcctcaga

SEQ ID NO: 74859 - DNA, 201 bp, Homo sapiens
atatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagataggtgggc

SEQ ID NO: 74860 - DNA, 201 bp, Homo sapiens
tggtgattcttggcactttgcattaccatataaaatttagaatcagcttgtcaatttccacaaaaagaatcctacttgaatttgtattgagtttctattgrcttagtacatcaatttgtagacattaacaaatttagttttgaagtttaaatttatgaacatgatatatcctcccatttttgaagtcttctttaatttctt

SEQ ID NO: 74861 - DNA, 201 bp, Homo sapiens
tgaatatatgtagtcagtgtgtttatatatttcatttcatatatgtgtcatatatatgtgtgtgtgtatgtatatatatatatatatatatatatatatawaaaacactgaatattgcagaaaattaaagcaaagagtaagaagagttaaccaaattttccctcaatgcagtgggaaaagatgaaaaggagaagataggtg

SEQ ID NO: 74862 - DNA, 201 bp, Homo sapiens
gttatttactggtttgtctatgattttattgttttgtagaagttgtttaaatattctcttgttttctaataaatgtaacacaaatgttgtctttcaggctrtggcttttctttttctttttcccttcttaatgatgtcttctgttgtagtaagttctacattttaataatattcaatttatgggtctttttttccagttac

SEQ ID NO: 74863 - DNA, 201 bp, Homo sapiens
aatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagatagg

SEQ ID NO: 74864 - DNA, 201 bp, Homo sapiens
gaaatctttttcttggcaatagattgcctgggtgaacatgaaactgaaatttgcccttataataggtaaagaaagaaaataatatgcccatgcattcaaarccgcaatgcagaattttgaccttgattccaatctgtttagaaactggattgaaaaaatctcaaaattattttcttttaggaaaaacatgtccatgtatag

SEQ ID NO: 74865 - DNA, 201 bp, Homo sapiens
ttctgcctgcctgcttgccttccttctttgcttgcttccttcctttctccctcccttcctccctcctttccttccttcctccctccctccctcccttcctycctcccttccttccttccttccttccttccttccttccttccttccttccctccttccctccttccctcctttccttctccttattttctttcttcttta

SEQ ID NO: 74866 - DNA, 201 bp, Homo sapiens
aaatctttttcttggcaatagattgcctgggtgaacatgaaactgaaatttgcccttataataggtaaagaaagaaaataatatgcccatgcattcaaaaycgcaatgcagaattttgaccttgattccaatctgtttagaaactggattgaaaaaatctcaaaattattttcttttaggaaaaacatgtccatgtatagg

SEQ ID NO: 74867 - DNA, 201 bp, Homo sapiens
tccttcccttctgcctgcctgcttgccttccttctttgcttgcttccttcctttctccctcccttcctccctcctttccttccttcctccctccctccctyccttcctccctcccttccttccttccttccttccttccttccttccttccttccttccctccttccctccttccctcctttccttctccttattttcttt

SEQ ID NO: 74868 - DNA, 201 bp, Homo sapiens
gatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttggttatgtcgtggtaatccaga

SEQ ID NO: 74869 - DNA, 201 bp, Homo sapiens
tctttccttccctccttcccttctgcctgcctgcttgccttccttctttgcttgcttccttcctttctccctcccttcctccctcctttccttccttcctycctccctccctcccttcctccctcccttccttccttccttccttccttccttccttccttccttccttccctccttccctccttccctcctttccttctc

SEQ ID NO: 74870 - DNA, 201 bp, Homo sapiens
tgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacatt

SEQ ID NO: 74871 - DNA, 201 bp, Homo sapiens
ggtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcg

SEQ ID NO: 74872 - DNA, 201 bp, Homo sapiens
tctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccggtggcctggggtgaaacgctggggggcgtgggg

SEQ ID NO: 74873 - DNA, 201 bp, Homo sapiens
agctccacctcccgggttcctgccattctcctgcctcagcctcttgagtaggctgggacaacaggtgcccaccaccatttttttttttttttttttttttktatttttagtagagacaggatttcaccatgttagccaggatggtctcgatctcctgatctcatgatccgcccacctcacggcctcccaaagtgctgggat

SEQ ID NO: 74874 - DNA, 201 bp, Homo sapiens
aatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatc

SEQ ID NO: 74875 - DNA, 201 bp, Homo sapiens
catgtcagttggcatcatttatccaacagtgtgtgttgacttcgtgtctctgtgtagcattttggttattctcacaatatcccagatgttttcattattaycatgtctgtgatagtgatctgtcttcagtgatctttgatgttactattttcattgtttggagtccctacgaactgcacccatataagacagaaaacttaa

SEQ ID NO: 74876 - DNA, 201 bp, Homo sapiens
acacatatcaaaattgtatttcatcccacatatcaactagaggaaaggtgaatgcataacactgaaagtcacggaactgttttattcgtttttttttttttatacagtggttctcaaagtgctgttatctatccaaatcagctgtgaaacttttaaaaaatatagactcctgggctctaacccagacccactaaatcagag

SEQ ID NO: 74877 - DNA, 201 bp, Homo sapiens
caatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagaccca

SEQ ID NO: 74878 - DNA, 201 bp, Homo sapiens
aacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacata

SEQ ID NO: 74879 - DNA, 201 bp, Homo sapiens
cgaatgaatatatgtagtcagtgtgtttatatatttcatttcatatatgtgtcatatatatgtgtgtgtgtatgtatatatatatatatatatatatatatatataaaacactgaatattgcagaaaattaaagcaaagagtaagaagagttaaccaaattttccctcaatgcagtgggaaaagatgaaaaggagaagata

SEQ ID NO: 74880 - DNA, 201 bp, Homo sapiens
aagagggaaaggaaactacatcaagcattctttgttgaaggctcatatgttccttttttgggctactatgcaaatttatattattacctatactatgcatwtactactataaaggtaagaatattaggtaattaaggggaaggaacttctttctttccaagaatggttcattatatttgctttgttgctttgatctagttc

SEQ ID NO: 74881 - DNA, 201 bp, Homo sapiens
cacgaatgaatatatgtagtcagtgtgtttatatatttcatttcatatatgtgtcatatatatgtgtgtgtgtatgtatatatatatatatatatatatayatatataaaacactgaatattgcagaaaattaaagcaaagagtaagaagagttaaccaaattttccctcaatgcagtgggaaaagatgaaaaggagaaga

SEQ ID NO: 74882 - DNA, 201 bp, Homo sapiens
agaaccagccacaaattgagggattggtaataaagagggaaaggaaactacatcaagcattctttgttgaaggctcatatgttccttttttgggctactaygcaaatttatattattacctatactatgcatatactactataaaggtaagaatattaggtaattaaggggaaggaacttctttctttccaagaatggttc

SEQ ID NO: 74883 - DNA, 201 bp, Homo sapiens
tgcacacgaatgaatatatgtagtcagtgtgtttatatatttcatttcatatatgtgtcatatatatgtgtgtgtgtatgtatatatatatatatatatayatatatatataaaacactgaatattgcagaaaattaaagcaaagagtaagaagagttaaccaaattttccctcaatgcagtgggaaaagatgaaaaggag

SEQ ID NO: 74884 - DNA, 201 bp, Homo sapiens
tgtgactttcagagtggaatggctgttgcttaacctctgcctctcaaatatcaggctaatttctcatgctgtaaccctagtccagaaccatacagagaaastaagtctggaaaacttaattccaaattggcctggttgacactgtacaaaaccaccagataattataattttatttaactctttgtcttcttttctttcct

SEQ ID NO: 74885 - DNA, 201 bp, Homo sapiens
caattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacagg

SEQ ID NO: 74886 - DNA, 201 bp, Homo sapiens
tttgcacacgaatgaatatatgtagtcagtgtgtttatatatttcatttcatatatgtgtcatatatatgtgtgtgtgtatgtatatatatatatatatayatatatatatataaaacactgaatattgcagaaaattaaagcaaagagtaagaagagttaaccaaattttccctcaatgcagtgggaaaagatgaaaagg

SEQ ID NO: 74887 - DNA, 201 bp, Homo sapiens
ctatccaaggatgtgactttcagagtggaatggctgttgcttaacctctgcctctcaaatatcaggctaatttctcatgctgtaaccctagtccagaaccrtacagagaaactaagtctggaaaacttaattccaaattggcctggttgacactgtacaaaaccaccagataattataattttatttaactctttgtcttc

SEQ ID NO: 74888 - DNA, 201 bp, Homo sapiens
agttcaaccgtttcttaaaaccttacacacacacctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaatt

SEQ ID NO: 74889 - DNA, 201 bp, Homo sapiens
agtttgcacacgaatgaatatatgtagtcagtgtgtttatatatttcatttcatatatgtgtcatatatatgtgtgtgtgtatgtatatatatatatatayatatatatatatataaaacactgaatattgcagaaaattaaagcaaagagtaagaagagttaaccaaattttccctcaatgcagtgggaaaagatgaaaa

SEQ ID NO: 74890 - DNA, 201 bp, Homo sapiens
atacacctatacctatatctatatttttatctctgtttctacttctgtaaactctctatacccaaatcctggtaaatggctgtaagtcttcttggagaagrctaggggaagatttacaatacatgcttttgactgcgtagcatggtgcttcctcaagagaatccagtctcccatccgttggtgctgctctgggtctataaa

SEQ ID NO: 74891 - DNA, 201 bp, Homo sapiens
gtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacaaaaagacttgtacatgaattttcataacagtttt

SEQ ID NO: 74892 - DNA, 201 bp, Homo sapiens
tgaaactagccatgaagtttgcacacgaatgaatatatgtagtcagtgtgtttatatatttcatttcatatatgtgtcatatatatgtgtgtgtgtatgtrtatatatatatatatatatatatatatataaaacactgaatattgcagaaaattaaagcaaagagtaagaagagttaaccaaattttccctcaatgcagt

SEQ ID NO: 74893 - DNA, 201 bp, Homo sapiens
aaaaaaaattagtaaaatagaaaaaacaaacaatataataatacacctatacctatatctatatttttatctctgtttctacttctgtaaactctctatayccaaatcctggtaaatggctgtaagtcttcttggagaagactaggggaagatttacaatacatgcttttgactgcgtagcatggtgcttcctcaagagaa

SEQ ID NO: 74894 - DNA, 201 bp, Homo sapiens
acagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggct

SEQ ID NO: 74895 - DNA, 201 bp, Homo sapiens
attgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaa

SEQ ID NO: 74896 - DNA, 201 bp, Homo sapiens
gcccaggcttctctcgaactcctgagctcaagcagtcctcctacctcagcctccaaacgtgctgggattacaggcgtgagccactgtgaatggcctacttwgatgaatcttactgataaaagcccatccatgcatccatatattaatacttataaggcatagaaatacatacaacaggactgcatacacacatacatatgt

SEQ ID NO: 74897 - DNA, 201 bp, Homo sapiens
aaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattccgaccct

SEQ ID NO: 74898 - DNA, 201 bp, Homo sapiens
caatctcccaggctcaagcgatcttcctgcctcagccttctgagtagctaggactacaggaatgtgccaccatgcgtggctttttaataaaatttttgttkagacagggtctcactatgttgcccaggcttctctcgaactcctgagctcaagcagtcctcctacctcagcctccaaacgtgctgggattacaggcgtgag

SEQ ID NO: 74899 - DNA, 201 bp, Homo sapiens
agctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagc

SEQ ID NO: 74900 - DNA, 201 bp, Homo sapiens
ttctttttggtcagcttggattgcctttggttctagttataaatcattttctttctttctttctttctttctttctttttttctttctttttctttctttytttctttttctttctttccttccttccttccttccctccttccttccttctttctttctttctctttctttctttctctctttctctttctctctctctc

SEQ ID NO: 74901 - DNA, 201 bp, Homo sapiens
taagtataaaataagtgttcagttctttttggtcagcttggattgcctttggttctagttataaatcattttctttctttctttctttctttctttctttytttctttctttttctttctttctttctttttctttctttccttccttccttccttccctccttccttccttctttctttctttctctttctttctttctc

SEQ ID NO: 74902 - DNA, 201 bp, Homo sapiens
aaaatgccaatttaagtttgaacttgcttcaccattcctatcccaacccccatgattagaaaatcaaaaagaacactttgagaaataacctcagtggggtyaaaagccagagtctccaggatgtcttgttcttaagacaaatagaaggaggtacaaatataggattgcagacttgtttacttcatttgttctctatttgtg

SEQ ID NO: 74903 - DNA, 201 bp, Homo sapiens
ttcactgtccctcttcgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagatagggtaggatgtaaaggcttcaatctgtttaaat

SEQ ID NO: 74904 - DNA, 201 bp, Homo sapiens
ttattctcattttttcctaacccaaccacctggttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcatttcctgaaccatg

SEQ ID NO: 74905 - DNA, 201 bp, Homo sapiens
ataaatccaaagtcctcttttcttttttgagcatttttaaaaatacaattgataaatttcctaactgttccttcctcatcttgcattgtggaataagtgcraacctccctgcggcatgaggcagaaaaccattgagcttatgacaaaaaacaggaaatacatgtaaaagagaccaattttaaaaaatcaggagaaatttta

SEQ ID NO: 74906 - DNA, 201 bp, Homo sapiens
atattttctgaatctcattatttaaggttaacaatgtgctaacctaaacaattcacaggatttgttttttattctcattttttcctaacccaaccacctgkttcaaggcacatagattaagaaggaaaatggaaatgggactaatatcccaggcttcactgtccctcttcgggccctggggaggagactcccaaaagtcta

SEQ ID NO: 74907 - DNA, 201 bp, Homo sapiens
gaacacaggtattaactcctgattgaaatgaacaaagataggagaagattaggggaaaaatctgtgtccttgctggaaaccagggcagtgcacacataaakagtatgccgttcactggatgggaaggaaaaaaaattaggagtatagtagtcaaagcacacaaacaaccctaacccagagtagacattgctggaagaaagg

SEQ ID NO: 74908 - DNA, 201 bp, Homo sapiens
tttccaacttggttccattctccccatcactttcaggtacaccaatcagacgtagatttggtctttccatatagtcccatatttcttggaggctttgttcrtttctttttattcttttttctctaaacttctcttctcacttcatttcattcatttgatcttccatctctgataccctttcttccagttgattgaatcagc

SEQ ID NO: 74909 - DNA, 201 bp, Homo sapiens
cccattcatttggagttggtgtcttccaggtggctacccttaagctgtgtgctcaaataaactctatccttaaatatattttctgaatctcattatttaargttaacaatgtgctaacctaaacaattcacaggatttgttttttattctcattttttcctaacccaaccacctggttcaaggcacatagattaagaagga

SEQ ID NO: 74910 - DNA, 201 bp, Homo sapiens
ctaaagatgatagttcatgactattaaagttcatagatttccttggaacttatggtctctgatggccaaaattttgtctgtcttgaacctcattgtcaacycaggaatcttactatgcctgatttaaagtagacaaccaaatgggtgtttgtaaaaaaattaaaaaaaattactttccaaattcattatgaacatagctac

SEQ ID NO: 74911 - DNA, 201 bp, Homo sapiens
tgatctcctgaccttgtgatccacccgcctcggcctcccaaagtgctgggattacaggcgtgagccaccgtgcccagcctatgacttaatttttttttttwaatttactaagtctgaattaaagaagttggggcttctaattttctgtatctataccagtctctagttgaaactacacaagggaaatgattatctcttcct

SEQ ID NO: 74912 - DNA, 201 bp, Homo sapiens
ccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagac

SEQ ID NO: 74913 - DNA, 201 bp, Homo sapiens
tatgcatgctgtcaggaagttgatgaggtatgtacagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagt

SEQ ID NO: 74914 - DNA, 201 bp, Homo sapiens
atgcaggttgagaccttacgtactgaagagagttcagattactctacctggctccaaaacattttctttcccacaggtaaatcatgtgaaactcctccagwtccagtgaatggcatggtgcatgtgatcacagacatccatgttggatccagaatcaactattcttgtactacagggtgagttggcagcaacatctcttgg

SEQ ID NO: 74915 - DNA, 201 bp, Homo sapiens
cctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaa

SEQ ID NO: 74916 - DNA, 201 bp, Homo sapiens
taattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagag

SEQ ID NO: 74917 - DNA, 201 bp, Homo sapiens
tagctgaccttcccacacacattcttgcaaagaggaaaagtcaagcagggtgtttggaggtgagttgccatcatccaccgcctttgtctggaaggaagcgyagggcctcacacgcgggatccatcggaagcccaagcattgtcaagctctgctgctgcacctgggtcagcaaggtgggctctgccagcgaaactcgttaga

SEQ ID NO: 74918 - DNA, 201 bp, Homo sapiens
ggcatttcattagctgaccttcccacacacattcttgcaaagaggaaaagtcaagcagggtgtttggaggtgagttgccatcatccaccgcctttgtctgkaaggaagcgcagggcctcacacgcgggatccatcggaagcccaagcattgtcaagctctgctgctgcacctgggtcagcaaggtgggctctgccagcgaa

SEQ ID NO: 74919 - DNA, 201 bp, Homo sapiens
ctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaatta

SEQ ID NO: 74920 - DNA, 201 bp, Homo sapiens
taactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaat

SEQ ID NO: 74921 - DNA, 201 bp, Homo sapiens
aggcctcatgtgccaaacagctagcgagttgcaaaggcaaagcaaaagtacttgaaggaaacttaaagtgctattccagtgaacacatgaatgataagaargtgaaacagccttattgctgatatggaagaagttttagtggtctagatacaagatcaaactagacatatttccttaagctaaagcctaatcctgagcaag

SEQ ID NO: 74922 - DNA, 201 bp, Homo sapiens
agaatactggttaccagaggttggggtagggagagacaatgggagatggagagagattggttaaagggcacagggtcacagatacataagaataaattcayccttgaatacttaaccctctgccctacatctgtcactcctacatccatattcattgctaatcctggggctaactcttgattgctttcttctcactactaa

SEQ ID NO: 74923 - DNA, 201 bp, Homo sapiens
aaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaataatggaatctgtaa

SEQ ID NO: 74924 - DNA, 201 bp, Homo sapiens
aaatgaacaaagataggagaagattaggggaaaaatctgtgtccttgctggaaaccagggcagtgcacacataaagagtatgccgttcactggatgggaargaaaaaaaattaggagtatagtagtcaaagcacacaaacaaccctaacccagagtagacattgctggaagaaagggaagggcatgtagcagctgtgtgag

SEQ ID NO: 74925 - DNA, 201 bp, Homo sapiens
tctgtctctgcctatgtaagtgataccttacgtcctccactttggaatgctgaccccattcatttggagttggtgtcttccaggtggctacccttaagctktgtgctcaaataaactctatccttaaatatattttctgaatctcattatttaaggttaacaatgtgctaacctaaacaattcacaggatttgttttttat

SEQ ID NO: 74926 - DNA, 201 bp, Homo sapiens
tctaaaaaagctcatctcatagaagtagagagtagaatactggttaccagaggttggggtagggagagacaatgggagatggagagagattggttaaaggrcacagggtcacagatacataagaataaattcatccttgaatacttaaccctctgccctacatctgtcactcctacatccatattcattgctaatcctggg

SEQ ID NO: 74927 - DNA, 201 bp, Homo sapiens
catgtgatcacagacatccatgttggatccagaatcaactattcttgtactacagggtgagttggcagcaacatctcttggttccagagttccagcacagyaatactaccttctagccacatctcaggaaggaaactaggctgttgccacctgctcttgagaggtttgaacacaggtattaactcctgattgaaatgaaca

SEQ ID NO: 74928 - DNA, 201 bp, Homo sapiens
taccaaagaattgtatattgtgaaattaaatcattcgaacttaaaacaattcaaacttatagctgggagaactttaaattattctgagccatgagaagacygtggctatgcagcctgagtcatgcagcaggcagctgtaacttctgcctttttatcctgtgaatagttaaaaccaaatggcgccagagataagacccactc

SEQ ID NO: 74929 - DNA, 201 bp, Homo sapiens
aatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggtt

SEQ ID NO: 74930 - DNA, 201 bp, Homo sapiens
ctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggc

SEQ ID NO: 74931 - DNA, 201 bp, Homo sapiens
ccacctcacggcctcccaaagtgctgggattacaggcatgagccaccgcgcccagcccaaaattctctctttcaataaggacaccagtcatattggattgsggcccacactaacaacttcatcttaacttgattgcctctgcaaagaccgtatttccaaataaggtcacattaataggaactggggattaagacatccata

SEQ ID NO: 74932 - DNA, 201 bp, Homo sapiens
agtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaataga

SEQ ID NO: 74933 - DNA, 201 bp, Homo sapiens
aatgctcacttcatgagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattt

SEQ ID NO: 74934 - DNA, 201 bp, Homo sapiens
gctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggttt

SEQ ID NO: 74935 - DNA, 201 bp, Homo sapiens
gtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaagattgtgtaggaag

SEQ ID NO: 74936 - DNA, 201 bp, Homo sapiens
ttttttttttttttttttttttgtatttttagtagagacaggatttcaccatgttagccaggatggtctcgatctcctgatctcatgatccgcccacctcmcggcctcccaaagtgctgggattacaggcatgagccaccgcgcccagcccaaaattctctctttcaataaggacaccagtcatattggattgcggcccac

SEQ ID NO: 74937 - DNA, 201 bp, Homo sapiens
atttgagaaatatttcccaagaacgtaggccccttcctcagcactgtgtccccaggatcctgatgagtggctgacacaggataagtgctaaattaagaaakattgactaaatgaatgagtaacccttcaaaacggttatttttcttcttcaaatgttttgctacttcattaaagttgtaaagtaagtaaacttgcattgga

SEQ ID NO: 74938 - DNA, 201 bp, Homo sapiens
aggtgggcagatcacctgaggtcaggagtttgagcctggccaacacggtgaaaccttgtttctactaaaaattcaaaaattagccggatgtgatggcaggygcctgtaatcccatctactcaggaggctgaggcagggagaattgcttgaacctgtgaggcagaggatcgcaccactgcactccagcctgggtgacagagg

SEQ ID NO: 74939 - DNA, 201 bp, Homo sapiens
atacatttgagaaatatttcccaagaacgtaggccccttcctcagcactgtgtccccaggatcctgatgagtggctgacacaggataagtgctaaattaakaaagattgactaaatgaatgagtaacccttcaaaacggttatttttcttcttcaaatgttttgctacttcattaaagttgtaaagtaagtaaacttgcat

SEQ ID NO: 74940 - DNA, 201 bp, Homo sapiens
gcatgttttaaagcaggtgtcctcaacccctggggcataaaccggtactgtccggtggcctgttaggaactgagcagaacagtaggaggtgagcggccaakcattactgcctgagctccacctcctgtcagatcactggcagcattagattctcataggagcagaaaccctattgtgaactgtgcatacgagggatctagg

SEQ ID NO: 74941 - DNA, 201 bp, Homo sapiens
tgatgatcaatatcagtaagtaatcagtgaaagttttcacctatttaagatgattagcacacatatatacatttgagaaatatttcccaagaacgtaggcyccttcctcagcactgtgtccccaggatcctgatgagtggctgacacaggataagtgctaaattaagaaagattgactaaatgaatgagtaacccttcaaa

SEQ ID NO: 74942 - DNA, 201 bp, Homo sapiens
agcttagttttcttcaaactagcagagactttttaaatggatggatgctgattttttttttaaaaaaagagcccatttctaaggcatgttttaaagcaggygtcctcaacccctggggcataaaccggtactgtccggtggcctgttaggaactgagcagaacagtaggaggtgagcggccaagcattactgcctgagctc

SEQ ID NO: 74943 - DNA, 201 bp, Homo sapiens
tctggctcacattcatggggatagaccacattgtgagccataaaaatagtatgctaattaagctttaccagggagtgtttaacatagggtagactctggcrccctcacatggtcctcatgtaggatctgatttggttttccctgctaggtaaaggtgcaagatagaaagaagggtaattccaatttgctttctgtgctttg

SEQ ID NO: 74944 - DNA, 201 bp, Homo sapiens
atcaatccacttggatataattgacatatacagacgacttcatccaacaacagcaaaagacattctctggctcacattcatggggatagaccacattgtgrgccataaaaatagtatgctaattaagctttaccagggagtgtttaacatagggtagactctggcgccctcacatggtcctcatgtaggatctgatttggt

SEQ ID NO: 74945 - DNA, 201 bp, Homo sapiens
ttacatcagaggcctgattcatttcaaaaccttcctcagagcaaggggtaattgccaggtaccctttaaagccagaattaatacatataacccatatttaygctgtctcaagactaattagcatggtgttgcatgctagacaaataagttcaactccagaaaacatgtaaaaactaacagaagtttcaacttgaatatctt

SEQ ID NO: 74946 - DNA, 201 bp, Homo sapiens
atgccaccacacctggctaattttttatattttgtagagatggagtcttgccatattgcccaggctggtctcaaactcctgggctcaagctatcctcccaycttggcctccaaaagtgttaggattacaagtgtgagccaccgtacccagccaaatttttatgttcttttatcccctcacttatcataaacaatttagtca

SEQ ID NO: 74947 - DNA, 201 bp, Homo sapiens
cttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagaatgtagtaatcatgagaatt

SEQ ID NO: 74948 - DNA, 201 bp, Homo sapiens
ggtgcgacaccatgccaggctaatttttgtatttttaatagagatggggtttcaccatgttggccaggctggtctcgaactcctgacctcatgatccaccygcctcagcctccaaaaatgctgggattacaggcgtgagccaccatgcctggcaaagaatgacactgggtgtattaaaaagtatgataagtgacatgatca

SEQ ID NO: 74949 - DNA, 201 bp, Homo sapiens
cacacacacatattaagggaatacgcaaacaaaaaatggcagaaataatatgggaaaagacagaacttaagaaagaaattgtcaagcaggtctacaaaatrattgttttattttggtgccaggtacagtccacaatgaagtcaagatattaagaagtaaagtggaccaggagaagttagagcagaaatatctcttttcaat

SEQ ID NO: 74950 - DNA, 201 bp, Homo sapiens
gatttccattataaaatatgaaacgtagtgagcatttttttggtttttttttgagacggagtctcgctctgttgcccaggctggagtgcagtggcatgatytcggctcactgcaagctctgcctcccgggttcccgccattctcctgcctcagcctcccgagtagctggggctacaggcacccgccaccatgccaggctaa

SEQ ID NO: 74951 - DNA, 201 bp, Homo sapiens
accccaagcacattacttttatgatttattactggttatcttctaggatttccattataaaatatgaaacgtagtgagcatttttttggtttttttttgaracggagtctcgctctgttgcccaggctggagtgcagtggcatgatctcggctcactgcaagctctgcctcccgggttcccgccattctcctgcctcagcc

SEQ ID NO: 74952 - DNA, 201 bp, Homo sapiens
aaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgagacggagtctcgctctgttgcccaggctggagtg

SEQ ID NO: 74953 - DNA, 201 bp, Homo sapiens
cggaagggattattgtcctgatttcagcactgctatctctggtttcactttccttgcagcagaagcaagagactaattgtaggaagagcattagcctgcgyagactatgcttaattaacatcatttctgtggtcttcagtttccatttagtttaatgagattgttgaactcaaatctcaatcactggattctaatttgttt

SEQ ID NO: 74954 - DNA, 201 bp, Homo sapiens
gcagggctattgttatcactgagactgatgatcaatatcagtaagtaatcagtgaaagttttcacctatttaagatgattagcacacatatatacatttgwgaaatatttcccaagaacgtaggccccttcctcagcactgtgtccccaggatcctgatgagtggctgacacaggataagtgctaaattaagaaagattga

SEQ ID NO: 74955 - DNA, 201 bp, Homo sapiens
atcagcagctgtgcttatgactggagagattattttgatatgacggaagggattattgtcctgatttcagcactgctatctctggtttcactttccttgcrgcagaagcaagagactaattgtaggaagagcattagcctgcgcagactatgcttaattaacatcatttctgtggtcttcagtttccatttagtttaatga

SEQ ID NO: 74956 - DNA, 201 bp, Homo sapiens
cactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaagaa

SEQ ID NO: 74957 - DNA, 201 bp, Homo sapiens
tgtgctagggagaattgtgttctatttctctaccttttactaactatgaggccttcagcaggcataggatatagcaaaagaaattcccccataactaacargtactctggaactgtcctttctacaatgtgtcagccgcctccagaaatcctgcatggtgagcataccctaagccatcaggacaactttttacctgggcag

SEQ ID NO: 74958 - DNA, 201 bp, Homo sapiens
gcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcagcagaagcaagagactaattgtaggaagagcattagcctgcgc

SEQ ID NO: 74959 - DNA, 201 bp, Homo sapiens
tcactgtggcagggctattgttatcactgagactgatgatcaatatcagtaagtaatcagtgaaagttttcacctatttaagatgattagcacacatatatacatttgagaaatatttcccaagaacgtaggccccttcctcagcactgtgtccccaggatcctgatgagtggctgacacaggataagtgctaaattaaga

SEQ ID NO: 74960 - DNA, 201 bp, Homo sapiens
tccatctgacagagaaacaaaatatgtggggcaaagctgatagaactgcaaggagaaatagatgaatgcactatcatagttggagacttcagcacctttaycttttctgatatcagaaaagataaaggtgctgaagtctctttatcagaaatgggcagattcagcaggcagaaaatccataaggacatacttgaactcaac

SEQ ID NO: 74961 - DNA, 201 bp, Homo sapiens
atctgttgacacctttactgagtttgttcctattgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactggg

SEQ ID NO: 74962 - DNA, 201 bp, Homo sapiens
aggaagagactattataaacaaatcagtagatgctagaaaggagtaacaacttgaaacctgacccagaaagtaaaaaaagaaaataaatcatcaacagacsttgacattttcaaaagcaaagcaatctgaatccatttggagttttttataatggcctgaatatgtttcaattcactgtggcagggctattgttatcactg

SEQ ID NO: 74963 - DNA, 201 bp, Homo sapiens
gaaagggtgagggaaaagagtatgactttactagcacttgaagagtgaatccagaaacaggttgcataggacagtttatgggaatatttatatataaaaartaacagaggaactaggattgttttgtcattagagggtactcctactacccatgaagtggtatggtgctatttgaaagagaacttagattagctgcaaata

SEQ ID NO: 74964 - DNA, 201 bp, Homo sapiens
attgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacaggg

SEQ ID NO: 74965 - DNA, 201 bp, Homo sapiens
gaggtattttgaaaatcaggtggggtagtgcatgtgacagcgttttgtaatctgaaaaccctcatgcatgtctgaaaaaccatgactaagcagtcgtgcargactgcaggatcactgaaaagggagaaatctcaactcctatgatcaggaaagggtgagggaaaagagtatgactttactagcacttgaagagtgaatcca

SEQ ID NO: 74966 - DNA, 201 bp, Homo sapiens
ctgtagactggagctgttcctatttggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctata

SEQ ID NO: 74967 - DNA, 201 bp, Homo sapiens
tttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagct

SEQ ID NO: 74968 - DNA, 201 bp, Homo sapiens
aaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaaaacaaacaaacaaacaaagcaaatcaaatatataatttatttca

SEQ ID NO: 74969 - DNA, 201 bp, Homo sapiens
ctgagagaggtattttgaaaatcaggtggggtagtgcatgtgacagcgttttgtaatctgaaaaccctcatgcatgtctgaaaaaccatgactaagcagtygtgcaggactgcaggatcactgaaaagggagaaatctcaactcctatgatcaggaaagggtgagggaaaagagtatgactttactagcacttgaagagtg

SEQ ID NO: 74970 - DNA, 201 bp, Homo sapiens
tccccagtgagatgaacccggtacctcagttggaaatgcagaaatcacccgtcttctgtgtcgctcacactgggagctgtagactggagctgttcctattyggccatcttggctcctccctcctattttattcttttcagagtgatctgttgacacctttactgagtttgttcctattgcaggactctttgattttctgga

SEQ ID NO: 74971 - DNA, 201 bp, Homo sapiens
gagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgattttt

SEQ ID NO: 74972 - DNA, 201 bp, Homo sapiens
caaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattg

SEQ ID NO: 74973 - DNA, 201 bp, Homo sapiens
agacgttttgcattcattatttgagtgttccttcttctctaaaagagtaaggggaaaagaaaaccaagttcccccaagagttgttattaatatttgatctycttaggcaccagaaagtaacctgtctagtgaagagatatgataaaacttacaattttatttttaggagagaagcatgcccagtaagttaagcaatctgtt

SEQ ID NO: 74974 - DNA, 201 bp, Homo sapiens
ccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatct

SEQ ID NO: 74975 - DNA, 201 bp, Homo sapiens
aacatcttcagttagaacccttctattattagttttgggctccccagaagtcttcttggttgcctagactcactggcaacatctcacttgaagtgacagtyttggttgttttggtcctgtctcttcctgacaactcagggttcgtccttctctgccactagacgttttgcattcattatttgagtgttccttcttctctaa

SEQ ID NO: 74976 - DNA, 201 bp, Homo sapiens
tccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatc

SEQ ID NO: 74977 - DNA, 201 bp, Homo sapiens
ccttctgaaagctccagtggagaacctgtttcttgcttctaaggggcactagcattccctggctcatggcagcaacactctgagctctgttttcatcattrccttctggtctattaccttcctcttataaggatccctgtgatcatatcaggttcacctagctactccaagatactctttccatctcaatatccaactgca

SEQ ID NO: 74978 - DNA, 201 bp, Homo sapiens
ctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaat

SEQ ID NO: 74979 - DNA, 201 bp, Homo sapiens
aaaattaaacccagtattttttccctaagacttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaa

SEQ ID NO: 74980 - DNA, 201 bp, Homo sapiens
gacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggcggtggtccaggcttggagtgacatgccata

SEQ ID NO: 74981 - DNA, 201 bp, Homo sapiens
tttaatgagattgttgaactcaaatctcaatcactggattctaatttgtttatatatttcctatctccctaatattttaaaggatctaggggaattatgcrcgttaacatagtaattagaataccattttataattcctataaaagcctgttaactggtagcctccttagttgagtcctgtaggttttgaggggcaggaag

SEQ ID NO: 74982 - DNA, 201 bp, Homo sapiens
tagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaagg

SEQ ID NO: 74983 - DNA, 201 bp, Homo sapiens
aaagaaaaataaataacacagtagatagatgagaaatatatgggaaacacagcaaagggttaatagtgttatcttacaggtagcagtagtggtggttgtgrtactagttgtaaaagttaatatataatgaatacttagtaccactgttagataggctggacatggtggcttatgtctgtaataccagcactttgggaggct

SEQ ID NO: 74984 - DNA, 201 bp, Homo sapiens
ggctcatgcacagtgcgctgcacccactgtcctgcactccccagtgagatgaacccggtacctcagttggaaatgcagaaatcacccgtcttctgtgtcgytcacactgggagctgtagactggagctgttcctatttggccatcttggctcctccctcctattttattcttttcagagtgatctgttgacacctttactg

SEQ ID NO: 74985 - DNA, 201 bp, Homo sapiens
gtgactgatcactgcttcccagggggaggcagaaaatgcttcttggaggagatgatgggtggattaaagaagacaagagctgagcaggagttgtagctacyggccagggaggaagggtattcagagcagaggaagcaaggtgagcaaaggcaccaagatgtgacactgctggactgccaagctattcagtgtggcagagta

SEQ ID NO: 74986 - DNA, 201 bp, Homo sapiens
acttttttttttctttaggttctgattaaaaggcaggtctgctagtcattgtgtcttggctggaatgaaagccctttggaatagcagtgttccagtgtgtkaacgtgagtagaaagaactatgtagtttggatagctctccttatttttgttttccagtgttttactgcacggaatcacttgtctggatctttacttaact

SEQ ID NO: 74987 - DNA, 201 bp, Homo sapiens
agcactttaggaggcagggtagataacttgaggtcaggactttgagaccagcctggccaacatggtgaatacccatttctacaaaaatccaaaaattagcygggcatgatggtgggtgcctgtaatcccagctactcaggaggctgaggcaggagaatctcttgaacctgggaggcagaggttgcagtgagccgagatcat

SEQ ID NO: 74988 - DNA, 201 bp, Homo sapiens
tgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactctttg

SEQ ID NO: 74989 - DNA, 201 bp, Homo sapiens
gtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgc

SEQ ID NO: 74990 - DNA, 201 bp, Homo sapiens
ataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctgg

SEQ ID NO: 74991 - DNA, 201 bp, Homo sapiens
ctgtcctgcactccccagtgagatgaacccggtacctcagttggaaatgcagaaatcacccgtcttctgtgtcgctcacactgggagctgtagactggagctgttcctatttggccatcttggctcctccctcctattttattcttttcagagtgatctgttgacacctttactgagtttgttcctattgcaggactcttt

SEQ ID NO: 74992 - DNA, 201 bp, Homo sapiens
gaaagattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaaga

SEQ ID NO: 74993 - DNA, 201 bp, Homo sapiens
ttggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagtt

SEQ ID NO: 74994 - DNA, 201 bp, Homo sapiens
ggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcac

SEQ ID NO: 74995 - DNA, 201 bp, Homo sapiens
ccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcgagactccgtgggcgtaggaccc

SEQ ID NO: 74996 - DNA, 201 bp, Homo sapiens
gaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctaga

SEQ ID NO: 74997 - DNA, 201 bp, Homo sapiens
atactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctc

SEQ ID NO: 74998 - DNA, 201 bp, Homo sapiens
gtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgt

SEQ ID NO: 74999 - DNA, 201 bp, Homo sapiens
aacttctcttctcacttcatttcattcatttgatcttccatctctgataccctttcttccagttgattgaatcagctactgaggcttgtgcattcgtcacrtagttctcgtgccatagttttcagctccatcaggtcctttaaggacttctctgcattggttattctagttagacattcatctaattttttttcaaggttt

SEQ ID NO: 75000 - DNA, 201 bp, Homo sapiens
aaaatctctcagcatttgcttgtctgtaaagtattttatttctccttcacttatgaagcttagtttggctggatatgaaattctgggttgaaaattctttyctttaagaatgttgaatattggccctcactctcttctggcttgtagagtttctgctgagagatccgctgttagtctgatgggcgtccctttgtgggtaac

SEQ ID NO: 75001 - DNA, 201 bp, Homo sapiens
tttgttctttgttggtttaaagtctgttttatcagagactaggattgcaacccctgccttttttttgttttccatttgcttggtagatcttcctccatccytttattttgagcctatgtgtgtctctgcacatgagatgggtttcctgaaaacagcacactgatgggtcttgactctttatcctatttgccagtctgtgtc

SEQ ID NO: 75002 - DNA, 201 bp, Homo sapiens
gtgacaaaatctctcagcatttgcttgtctgtaaagtattttatttctccttcacttatgaagcttagtttggctggatatgaaattctgggttgaaaatyctttcctttaagaatgttgaatattggccctcactctcttctggcttgtagagtttctgctgagagatccgctgttagtctgatgggcgtccctttgtgg

SEQ ID NO: 75003 - DNA, 201 bp, Homo sapiens
ttggaataagtgtggtgtggtgctgaaaagaatgtatattctgttgatttggggtggagagttctgtagatgtctattaggtctgcttggtgcagagctgrgttcaattcctggatatccttgttaactttctgtctcattgatcgtctaatgttgacagtggggtgttaaactctcccattattattgtgtgggagtcta

SEQ ID NO: 75004 - DNA, 201 bp, Homo sapiens
gtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttc

SEQ ID NO: 75005 - DNA, 201 bp, Homo sapiens
cttccaactatgtggtcaattttggaataagtgtggtgtggtgctgaaaagaatgtatattctgttgatttggggtggagagttctgtagatgtctattargtctgcttggtgcagagctgggttcaattcctggatatccttgttaactttctgtctcattgatcgtctaatgttgacagtggggtgttaaactctccca

SEQ ID NO: 75006 - DNA, 201 bp, Homo sapiens
tgcactgtggtctgagagacagtttgttataatttctgttcttttacatttgctgtggagcgctttacttccaactatgtggtcaattttggaataagtgyggtgtggtgctgaaaagaatgtatattctgttgatttggggtggagagttctgtagatgtctattaggtctgcttggtgcagagctgggttcaattcctg

SEQ ID NO: 75007 - DNA, 201 bp, Homo sapiens
gtggtcagttcttacgacaacctggacacacagtgctgacccgcatgatgggatgcaccaagctgggcccctgcaacgcacttggaggcttggccctgccrccgccccacctcccagctccagctacaattgcagtctgacctgggcaagcaagagcacatggtggagatcctgatggagacctgagccacacgtgccaca

SEQ ID NO: 75008 - DNA, 201 bp, Homo sapiens
ctgtgcccgccacacaggagccagagggggagcaccatgccccccacttcggagactgctgcacgaaggggccaggtatcagacctttgctgtctcacctyagcactggcaccaggagccctgcaaagcagcatctgggagatggacagccagggggaaaataaaggaagctttcagaagtggctagatgagatatttgaa

SEQ ID NO: 75009 - DNA, 201 bp, Homo sapiens
ggtgcgtgtggctccactgcctggtttctgcagagatcctgtgccagtgccctgtgcccgccacacaggagccagagggggagcaccatgccccccacttyggagactgctgcacgaaggggccaggtatcagacctttgctgtctcacctcagcactggcaccaggagccctgcaaagcagcatctgggagatggacagc

SEQ ID NO: 75010 - DNA, 201 bp, Homo sapiens
tgcactcctgcagctggcaggggcagtcactcctggacttgtccttttagaagctccagctttaccacttgctggtggagcccaaccactgccgcagggtyctcatcaccaacacgcctggcagatccaagaggagatggcccaggatgggatgtggtgaacagcagcacccaagagtgtggggtgcgtgtggctccactg

SEQ ID NO: 75011 - DNA, 201 bp, Homo sapiens
agagaaaaaaaaaaatagagaaaatcaatgaaaccaacagttgctacttggagatcaataaaatgtgtaaacctacagccagactgacaaagaaaaaaaaracacaaattaaccaatactgagaatgaaagaagtggtggtcaagcacggcaccccagccagcttgaagaccctgcactcctgcagctggcaggggcagtc

SEQ ID NO: 75012 - DNA, 201 bp, Homo sapiens
aaagaagagcaaattaaatcccaaactagcagatgtaaggaaatgataaagatagagccaaaatcaatgaaactgagaagagaaaaaaaaaaatagagaaratcaatgaaaccaacagttgctacttggagatcaataaaatgtgtaaacctacagccagactgacaaagaaaaaaaagacacaaattaaccaatactgag

SEQ ID NO: 75013 - DNA, 201 bp, Homo sapiens
cttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctag

SEQ ID NO: 75014 - DNA, 201 bp, Homo sapiens; identical to SEQ ID NO: 38188

SEQ ID NO: 75015 - DNA, 201 bp, Homo sapiens
ttagtttgaaattttccataggaagaaattcagtcctctgaaaacgtattgccaataagtgcattgcaggacatgatatataaagaaaatattggacagtrtatatatggagaattttagaatttagaatatgacatgaaatgaaggtgagatttcacttggttagaattttcttgaccagtctctcaacctgaggcagga

SEQ ID NO: 75016 - DNA, 201 bp, Homo sapiens; identical to SEQ ID NO: 38190

SEQ ID NO: 75017 - DNA, 201 bp, Homo sapiens
taatctaattgggtagttgacctgtgtatttagaatgtaacattccttattttttgcctctagataccgactcattggttcctcgtctgccacatgcatcrtctcaggcaacactgtcatttgggataataaaacacctgtttgtgacagtgagttgaaatatgcattcctatttcttttaccgatacattctaatttttc

SEQ ID NO: 75018 - DNA, 201 bp, Homo sapiens
acctgggatctttctgtgctattccctacaactgcatgggaatctgattatctcaaaataaaatttttttttttttaagttactactaaatttccaagggsatgggcttcctaccaaagaattgtatattgtgaaattaaatcattcgaacttaaaacaattcaaacttatagctgggagaactttaaattattctgagcc

SEQ ID NO: 75019 - DNA, 201 bp, Homo sapiens
aaatgttattattaggggaaaattgagtaaagtgtacctgggatctttctgtgctattccctacaactgcatgggaatctgattatctcaaaataaaattwttttttttttaagttactactaaatttccaaggggatgggcttcctaccaaagaattgtatattgtgaaattaaatcattcgaacttaaaacaattcaaa

SEQ ID NO: 75020 - DNA, 201 bp, Homo sapiens
gttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctgttcttttacatttgctgtggagcgcttt

SEQ ID NO: 75021 - DNA, 201 bp, Homo sapiens
tgctcgctgctagtgcagcagtgtgagatccacctgggatgctggaacttggctgggggaggagcatccgacattgctaaggcttgactgggcggttctakgctcacagtgtaaacaaagcgccagggaagcctgaactgggtggagcccactgcagctcagcaaggcctactgcctctctagattccacctctgggtgca

SEQ ID NO: 75022 - DNA, 201 bp, Homo sapiens
tgcctggctggggaggtcccacgcccacggagccttgctcgctgctagtgcagcagtgtgagatccacctgggatgctggaacttggctgggggaggagcrtccgacattgctaaggcttgactgggcggttctaggctcacagtgtaaacaaagcgccagggaagcctgaactgggtggagcccactgcagctcagcaag

SEQ ID NO: 75023 - DNA, 201 bp, Homo sapiens
gtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactg

SEQ ID NO: 75024 - DNA, 201 bp, Homo sapiens
gcggagcttgcagcgagccgagatcgcgccactgcactccagcctgggcgacagagcgagattccgtctcaaaatcaatcaatcaatcaatcaatcaatchctatacacttataaggatgagagtgaaaaaagacaatatgttggtggtattgtgaatcaccaatttagaaaatggatatatttaaaaattgcaaaggatt

SEQ ID NO: 75025 - DNA, 201 bp, Homo sapiens
acctaactgatgactttgagtttcccattgggacatatctgaactatgaatgccgccctggttattccggaagaccgttttctatcatctgcctaaaaaaytcagtctggacaagtgctaaggacaagtgcaaacgtaagtaactctggagtgggaacccctctgttagtcaaacatctgtaagatctgattcaatttgtt

SEQ ID NO: 75026 - DNA, 201 bp, Homo sapiens
gtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattt

SEQ ID NO: 75027 - DNA, 201 bp, Homo sapiens
atatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctca

SEQ ID NO: 75028 - DNA, 201 bp, Homo sapiens
gaaactaaaaaagaagagcaaattaaatcccaaactagcagatgtaaggaaatgataaagatagagccaaaatcaatgaaactgagaagagaaaaaaaaawatagagaaaatcaatgaaaccaacagttgctacttggagatcaataaaatgtgtaaacctacagccagactgacaaagaaaaaaaagacacaaattaacc

SEQ ID NO: 75029 - DNA, 201 bp, Homo sapiens
tcagaccagtagtcctcaaagattttttgcctcagggcaccttttacattttaagattaacaaagatcccaaagaggtttcttttatgtgggttatatctrttggtatttatcatattggaattcaaactgagagattttttaaataagtattgattctttttgtttttgtttttgtttttcctaagagagggtaccagta

SEQ ID NO: 75030 - DNA, 201 bp, Homo sapiens
tctcaaaaaattgaaatcattcaaaatacattatctgatcacaacagaatgaaagtaggaatcaacaacaaggccaatccccaaagaaatgaaaagtatasaagacactcctaaataatccatgcataaaaatagtagtcagccgggaaattagaaagtgttttgaattgaatcataacacatcaaaatatccaaacatgt

SEQ ID NO: 75031 - DNA, 201 bp, Homo sapiens
ccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagttttt

SEQ ID NO: 75032 - DNA, 201 bp, Homo sapiens
cagggcaccttttacattttaagattaacaaagatcccaaagaggtttcttttatgtgggttatatctgttggtatttatcatattggaattcaaactgaragattttttaaataagtattgattctttttgtttttgtttttgtttttcctaagagagggtaccagtatgtttcccaggctggagcacagtggcacaatc

SEQ ID NO: 75033 - DNA, 201 bp, Homo sapiens
gtgtgccactacacctggctaattttttgtatttttagtagaaatggggtttcaccgtgttagccaggatggtctctatctcctgacctcgtgatccgccsgcctcggcctcccaaactgctgggattacaggcgtgagccactgcacccggcccagtgtagataattcactttactaaaactcacctggaactttgggga

SEQ ID NO: 75034 - DNA, 201 bp, Homo sapiens
cctcaaagattttttgcctcagggcaccttttacattttaagattaacaaagatcccaaagaggtttcttttatgtgggttatatctgttggtatttatcrtattggaattcaaactgagagattttttaaataagtattgattctttttgtttttgtttttgtttttcctaagagagggtaccagtatgtttcccaggct

SEQ ID NO: 75035 - DNA, 201 bp, Homo sapiens
gatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacaga

SEQ ID NO: 75036 - DNA, 201 bp, Homo sapiens
cccaatatgtgaaagtaagtaaattcttttttttttttttttaattcagaccagtagtcctcaaagattttttgcctcagggcaccttttacattttaagrttaacaaagatcccaaagaggtttcttttatgtgggttatatctgttggtatttatcatattggaattcaaactgagagattttttaaataagtattgat

SEQ ID NO: 75037 - DNA, 201 bp, Homo sapiens
gcagcgtagaaaataaaccatataaaaagttccttcattattatgtgtcttattaattgctatacaaaacagtaaccctttcttttcccatttagttattrcttaattggtaaagaaattctatattgtgaacttaaaggatcagtagcagtttggagcagtaagcccccaatatgtgaaagtaagtaaattctttttttt

SEQ ID NO: 75038 - DNA, 201 bp, Homo sapiens
accataacatttcttgagcacccacaaggtgggtagagtgtagtagaaaaagaagaacatggtccttgacccccaggaacttgccttttaagagaagacascctgaagtgacaagctgttataagttagtgttttaaactatggaagaacaatctgagcagagtgctctatactgtagatgacttcttagaggagaagtta

SEQ ID NO: 75039 - DNA, 201 bp, Homo sapiens
ttgatgttcaagaaaggaaaaacaattcatgtaagtctatccaaagtagtaaatgttttatatttaagtagtgtatattcacttgtcagatgctcagttcrcttatctgaaacctatgaaataaagtcttatattttagaatatttgagttcatatttattttaatctatgaaatccactacatttacttaataatcacct

SEQ ID NO: 75040 - DNA, 201 bp, Homo sapiens
tagtagctttattataggacatgctggataaacaatccaacagctacctcagggagcttctgagagaatgcatgatgcaatgatcagtgaggcaagatcamattgtgtttgatgttcaagaaaggaaaaacaattcatgtaagtctatccaaagtagtaaatgttttatatttaagtagtgtatattcacttgtcagatgc

SEQ ID NO: 75041 - DNA, 201 bp, Homo sapiens
ttttagtagaaatggggtttcaccgtgttagccaggatggtctctatctcctgacctcgtgatccgcccgcctcggcctcccaaactgctgggattacagrcgtgagccactgcacccggcccagtgtagataattcactttactaaaactcacctggaactttggggaaatttctgactgcacctatcttatgatataat

SEQ ID NO: 75042 - DNA, 201 bp, Homo sapiens
tccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaa

SEQ ID NO: 75043 - DNA, 201 bp, Homo sapiens
aaaatgttattattaggggaaaattgagtaaagtgtacctgggatctttctgtgctattccctacaactgcatgggaatctgattatctcaaaataaaatwtttttttttttaagttactactaaatttccaaggggatgggcttcctaccaaagaattgtatattgtgaaattaaatcattcgaacttaaaacaattcaa

SEQ ID NO: 75044 - DNA, 201 bp, Homo sapiens
caaaatgttattattaggggaaaattgagtaaagtgtacctgggatctttctgtgctattccctacaactgcatgggaatctgattatctcaaaataaaawttttttttttttaagttactactaaatttccaaggggatgggcttcctaccaaagaattgtatattgtgaaattaaatcattcgaacttaaaacaattca

SEQ ID NO: 75045 - DNA, 201 bp, Homo sapiens; identical to SEQ ID NO: 38221

SEQ ID NO: 75046 - DNA, 201 bp, Homo sapiens
gtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggaga

SEQ ID NO: 75047 - DNA, 201 bp, Homo sapiens
ttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataatta

SEQ ID NO: 75048 - DNA, 201 bp, Homo sapiens
tgggattacaggtgcgacaccatgccaggctaatttttgtatttttaatagagatggggtttcaccatgttggccaggctggtctcgaactcctgacctcrtgatccacctgcctcagcctccaaaaatgctgggattacaggcgtgagccaccatgcctggcaaagaatgacactgggtgtattaaaaagtatgataagt

SEQ ID NO: 75049 - DNA, 201 bp, Homo sapiens
tgttctgtagaatgattattttcaatatgaaattgattacaatatattcttcacattgttttgtgtttgacagcagtggactttgagtaccaaatttttttcgaatagctactatgagggacatattgtgctgggtgttgtggccacatggatgaatggagtcggccttgttaactattaaactcaaaaacacgtgataat

SEQ ID NO: 75050 - DNA, 201 bp, Homo sapiens
agctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggaga

SEQ ID NO: 75051 - DNA, 201 bp, Homo sapiens
tctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgccta

SEQ ID NO: 75052 - DNA, 201 bp, Homo sapiens
gcaattcttctgcctcagcctcccgagtagctgggactacaggcgtgtgccactacacctggctaattttttgtatttttagtagaaatggggtttcaccrtgttagccaggatggtctctatctcctgacctcgtgatccgcccgcctcggcctcccaaactgctgggattacaggcgtgagccactgcacccggcccag

SEQ ID NO: 75053 - DNA, 201 bp, Homo sapiens
ttttccttaaatgaagttgtggagtttaggtgtcagcctggctttgtcatgaaaggaccccccgcaccgtgtgcaatgccaggccctgaacaaatgggagmcagagctaccaagctgctccaggggtgtgtttgcctgaggcctagaagggccctgcaagtgacatgcattgctgttggatcaggagatgagtatttgttt

SEQ ID NO: 75054 - DNA, 201 bp, Homo sapiens
aagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtg

SEQ ID NO: 75055 - DNA, 201 bp, Homo sapiens
ttccctgtccttttagggcagcttgagcccttttgtttgacttagcacaacgtgactccaaactagggttgttttaatttcccaagacacagtagtaggcratttcttgaggacctaattgcagatagagtttgtcggtctcagcatgtgggagctccagatgaatggcagtaatgggaagcagtttggtagtggttcagc

SEQ ID NO: 75056 - DNA, 201 bp, Homo sapiens
ttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggc

SEQ ID NO: 75057 - DNA, 201 bp, Homo sapiens
ctggactgccaagctattcagtgtggcagagtagggtaaaggagacaacaaagaagggagaggaataaatcacagggtgagcagttctaaaaagcaacagkcttgtcaggaataaacaatcaccatcgtaaactcagactttgatattattccctgtccttttagggcagcttgagcccttttgtttgacttagcacaacg

SEQ ID NO: 75058 - DNA, 201 bp, Homo sapiens; identical to SEQ ID NO: 38249

SEQ ID NO: 75059 - DNA, 201 bp, Homo sapiens
atctgttaaatatcagaaaattaaatatactatttggctggggcttagagcctaggaaaaagtccctcctgcctccaagaggaaggttctttaaagagctrtgctcaggatggtctttctgttgtacctaaaaagctagggcagcagcagctgagggccagaaaggatctgtctcccctgtttatgttgactctgcagggc

SEQ ID NO: 75060 - DNA, 201 bp, Homo sapiens; identical to SEQ ID NO: 38252

SEQ ID NO: 75061 - DNA, 201 bp, Homo sapiens
gggcatctgtgctttctgttccctcagtcctggaacgttctccccatgacctgctgcataaatgggctgtttcttctgcaagctcagctggaatgttaccrcttcagagaccttcttggaaccccccaactcaggttgaacacatacaacccagttcaagtacctcttgtaatcacccttttaaagtgatcttttctgttc

SEQ ID NO: 75062 - DNA, 201 bp, Homo sapiens
aaatatattaaccagggaagtgttctggaggaaaggagtataattttctgacagcatttaacaaatgactggggggagggaaggctttgcttctcatcaarcagacaaaactctgccactttggggcatctgtgctttctgttccctcagtcctggaacgttctccccatgacctgctgcataaatgggctgtttcttctg

SEQ ID NO: 75063 - DNA, 201 bp, Homo sapiens
tttaggatcttattccatgtacagattgtacgttgcatttcttctcttaggaacattcattcaacgaatatgggtcttgtatgtctggtgctgttacactrgtaggtaataacagacaattcctattttctttatcctttttttactatttgtttacacacgtacatgcaggaagataagcagggactttttttgctcatt

SEQ ID NO: 75064 - DNA, 201 bp, Homo sapiens
tattgtgtttcatgtgtatctatatccaaattatatttaggatcttattccatgtacagattgtacgttgcatttcttctcttaggaacattcattcaacraatatgggtcttgtatgtctggtgctgttacactggtaggtaataacagacaattcctattttctttatcctttttttactatttgtttacacacgtaca

SEQ ID NO: 75065 - DNA, 201 bp, Homo sapiens; identical to SEQ ID NO: 38261

SEQ ID NO: 75066 - DNA, 201 bp, Homo sapiens
atacaggcttattgtgcaaaatgaacaaaataaaaggacaactgtttttaatattttgttatatttccttctgactttattgtgtttcatgtgtatctatrtccaaattatatttaggatcttattccatgtacagattgtacgttgcatttcttctcttaggaacattcattcaacgaatatgggtcttgtatgtctggt

SEQ ID NO: 75067 - DNA, 201 bp, Homo sapiens
tgtgagatccacctgggatgctggaacttggctgggggaggagcatccgacattgctaaggcttgactgggcggttctaggctcacagtgtaaacaaagcrccagggaagcctgaactgggtggagcccactgcagctcagcaaggcctactgcctctctagattccacctctgggtgcatggcatatctgaacaaaaggc

SEQ ID NO: 75068 - DNA, 201 bp, Homo sapiens
agcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattacttaattggtaaagaaattctatattgtgaacttaaaggatcagtag

SEQ ID NO: 75069 - DNA, 201 bp, Homo sapiens
aacatacgcagcttttgtactggttgactgaaatataacaacatcaatgaggccagaatcaataatatcaatgttataaggttgatgagcaaattctatayccataaaaaactgagggccaggctcggtggctcacgcctgtaatcccagcattttgggaagctgaggtgggcagatcatgaggtcagaagttcgagacca

SEQ ID NO: 75070 - DNA, 201 bp, Homo sapiens
aatttttgtattttttagtagagacagggattcacaatgttggcccggctggtctctaactcctgacctcaggtaatccatctgcctcgactttccaaagkggtgggattacaggcatgagcctggtgctgacttttttgacctgttggctaattggacttagaacttctgtatgttgaaaaaatgactataaatcatgct

SEQ ID NO: 75071 - DNA, 201 bp, Homo sapiens
catccctcttggaaatggtatccttctgatatttgaagaatccagtcatatccttaaaatggctcacagcattccaaacttccaccttcacctagaaatgstttttttcttatcttaaggtgtaatttattttaaactagtcttgagctaatttaaatagcccccaatttcatcctctgttgggtgaacacctcccagttt

SEQ ID NO: 75072 - DNA, 201 bp, Homo sapiens; identical to SEQ ID NO: 38277

SEQ ID NO: 75073 - DNA, 201 bp, Homo sapiens; identical to SEQ ID NO: 38280

SEQ ID NO: 75074 - DNA, 201 bp, Homo sapiens
ttccttaaatgaagttgtggagtttaggtgtcagcctggctttgtcatgaaaggaccccccgcaccgtgtgcaatgccaggccctgaacaaatgggagacrgagctaccaagctgctccaggggtgtgtttgcctgaggcctagaagggccctgcaagtgacatgcattgctgttggatcaggagatgagtatttgtttag

SEQ ID NO: 75075 - DNA, 201 bp, Homo sapiens; identical to SEQ ID NO: 38283

SEQ ID NO: 75076 - DNA, 201 bp, Homo sapiens; identical to SEQ ID NO: 38288

SEQ ID NO: 75077 - DNA, 201 bp, Homo sapiens; identical to SEQ ID NO: 38291

SEQ ID NO: 75078 - DNA, 201 bp, Homo sapiens; identical to SEQ ID NO: 38297

SEQ ID NO: 75079 - DNA, 201 bp, Homo sapiens; identical to SEQ ID NO: 38300

SEQ ID NO: 75080 - DNA, 201 bp, Homo sapiens; identical to SEQ ID NO: 38303

SEQ ID NO: 75081 - DNA, 201 bp, Homo sapiens
tgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataacatgagatatgaag

SEQ ID NO: 75082 - DNA, 201 bp, Homo sapiens
cctagagtgcagtggtgcgatcttggctcaatgaaacctctgcctcccgggttcaagggattctcctgcctcagcctcccgagtagctgggactacaggcmtgtgccactacgccaggttaatttttgtatttttagtagagacagttttgccatgttggccaggctggtctcaaactcctggcctcaagtgatccacccg

SEQ ID NO: 75083 - DNA, 201 bp, Homo sapiens
agacgtagatttggtctttccatatagtcccatatttcttggaggctttgttcgtttctttttattcttttttctctaaacttctcttctcacttcatttsattcatttgatcttccatctctgataccctttcttccagttgattgaatcagctactgaggcttgtgcattcgtcacatagttctcgtgccatagttttc

SEQ ID NO: 75084 - DNA, 201 bp, Homo sapiens
aacgctgcaacaagcatgtcagttggcatcatttatccaacagtgtgtgttgacttcgtgtctctgtgtagcattttggttattctcacaatatcccagadgttttcattattatcatgtctgtgatagtgatctgtcttcagtgatctttgatgttactattttcattgtttggagtccctacgaactgcacccatataa

SEQ ID NO: 75085 - DNA, 201 bp, Homo sapiens
acccaccaccacacctggctaatttttgtattttttagtagagacagggattcacaatgttggcccggctggtctctaactcctgacctcaggtaatccayctgcctcgactttccaaagtggtgggattacaggcatgagcctggtgctgacttttttgacctgttggctaattggacttagaacttctgtatgttgaaa

SEQ ID NO: 75086 - DNA, 201 bp, Homo sapiens
atttttgtattttttagtagagacagggattcacaatgttggcccggctggtctctaactcctgacctcaggtaatccatctgcctcgactttccaaagtkgtgggattacaggcatgagcctggtgctgacttttttgacctgttggctaattggacttagaacttctgtatgttgaaaaaatgactataaatcatgctg

SEQ ID NO: 75087 - DNA, 201 bp, Homo sapiens
acctgaacctaagacccaaatgatagtcaaggaggaaatggtagtgaggaagctgagcatctattagtgaagaaatcaagggagagatgggaattgctcayacatttgctaccacttttttttttctttaggttctgattaaaaggcaggtctgctagtcattgtgtcttggctggaatgaaagccctttggaatagcagt

SEQ ID NO: 75088 - DNA, 201 bp, Homo sapiens
gcattcagggtggtatggctgtagatcagtatccagttatttgtattacttctgaatctgtaagtatcatgtttattatatgtaatattgtatatttgtgyttgctttgtctttattagttctgccagagcttttgttcttattatttaataaagatgttatactgggccaggtgtggtggctcacacctgtaatcccagc

SEQ ID NO: 75089 - DNA, 201 bp, Homo sapiens
cagattcttgtcttaggagccatagaactccaaaggtttatggctataactgtgttttgacataattggctttctttatagtcctacgtgatttacttatrcattacaaaaaacagctctgagaagggattcataattctgaccagccaggcaaaggtgtatacatgatacataaagatattaagaacccctcatgactat

SEQ ID NO: 75090 - DNA, 201 bp, Homo sapiens
ggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatcactatacacttataaggatgagagtgaaaaaagacaa

SEQ ID NO: 75091 - DNA, 201 bp, Homo sapiens
agcctgggcgacagagcgagattccgtctcaaaatcaatcaatcaatcaatcaatcaatcactatacacttataaggatgagagtgaaaaaagacaatatkttggtggtattgtgaatcaccaatttagaaaatggatatatttaaaaattgcaaaggatttctcagctagcgctcagttaagcatattttctcattaaat

SEQ ID NO: 75092 - DNA, 201 bp, Homo sapiens; identical to SEQ ID NO: 38351

SEQ ID NO: 75093 - DNA, 201 bp, Homo sapiens
ttcaaacattcagtccattgtacaaacactgaatttgataagcacatctgcttaaatgatatcacatgtgttgatttcatgtgcttttccacctttgtttstaaattccgttaacccatctctgaattcattcaaccaagactctctcccagacaactctagtccaaaataatgtctgtctttgaaactcacatttcctga

SEQ ID NO: 75094 - DNA, 201 bp, Homo sapiens
tactataaattttcaacatataaatttggaaggattcaaacattcagtccattgtacaaacactgaatttgataagcacatctgcttaaatgatatcacaygtgttgatttcatgtgcttttccacctttgtttctaaattccgttaacccatctctgaattcattcaaccaagactctctcccagacaactctagtccaa

SEQ ID NO: 75095 - DNA, 201 bp, Homo sapiens
atttcaccatgttagccaggatggtctcgatctcctgatctcatgatccgcccacctcacggcctcccaaagtgctgggattacaggcatgagccaccgcrcccagcccaaaattctctctttcaataaggacaccagtcatattggattgcggcccacactaacaacttcatcttaacttgattgcctctgcaaagaccg

SEQ ID NO: 75096 - DNA, 201 bp, Homo sapiens
ctcagactttgatattattccctgtccttttagggcagcttgagcccttttgtttgacttagcacaacgtgactccaaactagggttgttttaatttcccragacacagtagtaggcaatttcttgaggacctaattgcagatagagtttgtcggtctcagcatgtgggagctccagatgaatggcagtaatgggaagcag

SEQ ID NO: 75097 - DNA, 201 bp, Homo sapiens
gacaacaaagaagggagaggaataaatcacagggtgagcagttctaaaaagcaacagtcttgtcaggaataaacaatcaccatcgtaaactcagactttgrtattattccctgtccttttagggcagcttgagcccttttgtttgacttagcacaacgtgactccaaactagggttgttttaatttcccaagacacagtag

SEQ ID NO: 75098 - DNA, 201 bp, Homo sapiens; identical to SEQ ID NO: 8295

SEQ ID NO: 75099 - DNA, 201 bp, Homo sapiens; identical to SEQ ID NO: 8297

SEQ ID NO: 75100 - DNA, 201 bp, Homo sapiens
tccacctcccgggttcctgccattctcctgcctcagcctcttgagtaggctgggacaacaggtgcccaccaccatttttttttttttttttttttttgtawttttagtagagacaggatttcaccatgttagccaggatggtctcgatctcctgatctcatgatccgcccacctcacggcctcccaaagtgctgggattac

SEQ ID NO: 75101 - DNA, 201 bp, Homo sapiens
tcaaggcaactgcaaattcagtgtgtggtgggactcactttctagttaatagacttcaatcttttctttgtgtcctcacctcagagaaaagcagtgagggwgctcttgcgggtctcttttctaagggaactagtcccattcacaaggggtctttgagaagtaattagatactataaattttcaacatataaatttggaagg

SEQ ID NO: 75102 - DNA, 201 bp, Homo sapiens
cagggaggcggggttgcagtgagccaagatcgtgccactgcattccagcctggacaacaaaagcaaaattccctctcaaaaaaaaaaaaaaaaaaaaaaaagaaagaaagaaagaaaaaagaaactaaaataagacagaaatagaagtaattcacacacagaaatcatctcaccttctttaaaatgctcctcaaggaggcc

SEQ ID NO: 75103 - DNA, 201 bp, Homo sapiens
agatggcctgctctatgggagagccacaatcacaccaggactagacagtagcaggctgatgtatatctcaaacactggagacaattcagaaactgcataarcagtctgaagacttactaagaaactaaaatgaggctgggcgcggtggctcaggcctgtaatccctgcatttagggaggcctaggcgggtggaccacctga

SEQ ID NO: 75104 - DNA, 201 bp, Homo sapiens
tagtggtcatcaagtaagaagagccgtttatcctggagctaaaaaagactgacagatatagaatagtgtagaacaagatggcctgctctatgggagagccrcaatcacaccaggactagacagtagcaggctgatgtatatctcaaacactggagacaattcagaaactgcataaacagtctgaagacttactaagaaact

SEQ ID NO: 75105 - DNA, 201 bp, Homo sapiens
ttgctccaaagttaaattataaactaaattcctttcatggttagcttggcctacacccaggaatgagcaaagccggcccacctgtgaggctggaagcaagrtgaagtcagtcacgttagatttctttcactctcagaatctttgcaaaggtggtttcaggatagtgagtgcatttctctaacaaaacaccattgattttca

SEQ ID NO: 75106 - DNA, 201 bp, Homo sapiens
tcctaatcctaatcttttggcctttcattagctttcaggccctgagcaaggagggagctagttttaggaagagactgttattatccttgctccaaagttamattataaactaaattcctttcatggttagcttggcctacacccaggaatgagcaaagccggcccacctgtgaggctggaagcaagatgaagtcagtcacg

SEQ ID NO: 75107 - DNA, 201 bp, Homo sapiens
gccacctgactcctgagcagtaatgaattataagaactatgcctatattttagcagagttcaggtccctctcctaatcctaatcttttggcctttcattarctttcaggccctgagcaaggagggagctagttttaggaagagactgttattatccttgctccaaagttaaattataaactaaattcctttcatggttagc

SEQ ID NO: 75108 - DNA, 201 bp, Homo sapiens
ttatagatcatttggtaggaagggagctagggaatgggtactactgattggttggggatgggggtgtgggaaatgttcctcatgtgctgtgtccacctctrgttgggggccacaggaccagttgagtcatgagtcacaggtccaggtagagtcagtcagttgccaaatgcaaaaatctgaaaaacatctcagaagaccaat

SEQ ID NO: 75109 - DNA, 201 bp, Homo sapiens
cctaactattgatttgtttcacctacataatttaagatcatttcctcatattaatcatcttcaggcataaacatgactcaataaccatttcataaaattawttctttagaaatgattatcttgtatagtttaagcaacctcagagcatataccatttcttcacattttccatctcgtaaaacctgcctactttttcatatt

SEQ ID NO: 75110 - DNA, 201 bp, Homo sapiens
ccaccgtgcccagcctatgacttaattttttttttttaatttactaagtctgaattaaagaagttggggcttctaattttctgtatctataccagtctctmgttgaaactacacaagggaaatgattatctcttccttttgaaaatattcaagatactttaatatgttgaagatatttgagtatctccacccttctaacta

SEQ ID NO: 75111 - DNA, 201 bp, Homo sapiens
gctccacctcccgggttcctgccattctcctgcctcagcctcttgagtaggctgggacaacaggtgcccaccaccatttttttttttttttttttttttgkatttttagtagagacaggatttcaccatgttagccaggatggtctcgatctcctgatctcatgatccgcccacctcacggcctcccaaagtgctgggatt

SEQ ID NO: 75112 - DNA, 201 bp, Homo sapiens
ctttgtttacctactcaagcctaggcaatggtgggcgcccctcccccagcctcactgctgccttgcagtttgatctcagactgctgtgctagcaatgagcragactccgtgggcgtaggaccctctgagccatgtgcgggatataatctcctggtgtgccgtttgttaagccattggaaaagcacagtattagggtgggag

SEQ ID NO: 75113 - DNA, 201 bp, Homo sapiens
ttactctacctggctccaaaacattttctttcccacaggtaaatcatgtgaaactcctccagttccagtgaatggcatggtgcatgtgatcacagacatcyatgttggatccagaatcaactattcttgtactacagggtgagttggcagcaacatctcttggttccagagttccagcacagcaatactaccttctagcca

SEQ ID NO: 75114 - DNA, 201 bp, Homo sapiens
gaaagcctttggaatagcagtgttccagtgtgtgaacgtaagtaataggagtaacatttcaggccaatctctcctcttcatctgttcagtatttgacccaygacctcccctaatgtggttcttcaattttctaatctgaattattgatttgaaaatttcttattttagtaatgtttggttgtgaatcaatgtgtacatcac

SEQ ID NO: 75115 - DNA, 201 bp, Homo sapiens
tcttctctcaactcatcaaagtcattctccatccagctttgttcctttgctggtgaggagctgcgttcctttggaggaggagaggcgctctgatttttagwgtttccagtttttctgctctgttttttccccatctttgtagttttatctacctttggtctttgatgatggtgacatacagataggtttttggtgtggatg

SEQ ID NO: 75116 - DNA, 201 bp, Homo sapiens
ttctcctgcctcagcctcccacacagctgggactacaggcgcccgccaccacacctggctaattttttgtatttttttagtagagacggggtttcaccgtkttagccaggatggtctgatctcctgaccttgtgatccacccgcctcggcctcccaaagtgctgggattacaggcgtgagccaccgtgcccagcctatgac

SEQ ID NO: 75117 - DNA, 201 bp, Homo sapiens
atcgcaacactgcactccagtctgggcaacagagcagactctgtctaaaaaataaaaataaaaaaactgaatttgcaacttttaagtgaacagttttctayaggaaatattctaaacaagtacagtttcctacaatgagctttacagcaatcgaagttttcgtatttcacagagatttcaatacactttttaaaaagtagt

SEQ ID NO: 75118 - DNA, 201 bp, Homo sapiens
ggcacacataggctgccagtggggaagaactgagactttccattgggtattttaatatatgaacaaatattttgtaattacaattaactttttttttttttgagacagagtcttgctctgtcacccagcctagagtgcagtggtgcgatcttggctcaatgaaacctctgcctcccgggttcaagggattctcctgcctca

SEQ ID NO: 75119 - DNA, 201 bp, Homo sapiens
tgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaa

SEQ ID NO: 75120 - DNA, 201 bp, Homo sapiens
cttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccatcttgaattgatttttg

SEQ ID NO: 75121 - DNA, 201 bp, Homo sapiens
tttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtc

SEQ ID NO: 75122 - DNA, 201 bp, Homo sapiens
ttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaag

SEQ ID NO: 75123 - DNA, 201 bp, Homo sapiens
ctagttactgtgttttggctggaatggaaagcctttggaatagcagtgttccagtgtgtgaacgtaagtaataggagtaacatttcaggccaatctctccycttcatctgttcagtatttgacccatgacctcccctaatgtggttcttcaattttctaatctgaattattgatttgaaaatttcttattttagtaatgtt

SEQ ID NO: 75124 - DNA, 201 bp, Homo sapiens
gctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaa

SEQ ID NO: 75125 - DNA, 201 bp, Homo sapiens
aggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggac

SEQ ID NO: 75126 - DNA, 201 bp, Homo sapiens
agacagacagacagacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaa

SEQ ID NO: 75127 - DNA, 201 bp, Homo sapiens
tgtcaactcaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttaca

SEQ ID NO: 75128 - DNA, 201 bp, Homo sapiens
atctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcc

SEQ ID NO: 75129 - DNA, 201 bp, Homo sapiens
atgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatg

SEQ ID NO: 75130 - DNA, 201 bp, Homo sapiens
gggctcaagctatcctcccaccttggcctccaaaagtgttaggattacaagtgtgagccaccgtacccagccaaatttttatgttcttttatcccctcacktatcataaacaatttagtcagcttgttttttagcctgcagtattgaatgacatagggcttcccatgtgctaggactttccatgtgtagaaaatgcaatga

SEQ ID NO: 75131 - DNA, 201 bp, Homo sapiens
aggtgagatcatggcttactgcaaccgccacctccctggctcaagcaattctcctgcctgagcctcccaagcagctgggactacaggtgcatgctaccacrcctggttaaattttttatattttttttatagagatcgaatctcaccatgtttcccaggcttgtctcgaacacctgagctgaagcaatccacccacctggg

SEQ ID NO: 75132 - DNA, 201 bp, Homo sapiens
gcccaggctggtctcaaactcctgggctcaagctatcctcccaccttggcctccaaaagtgttaggattacaagtgtgagccaccgtacccagccaaattyttatgttcttttatcccctcacttatcataaacaatttagtcagcttgttttttagcctgcagtattgaatgacatagggcttcccatgtgctaggactt

SEQ ID NO: 75133 - DNA, 201 bp, Homo sapiens
ttatggagacagcaaagacgtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctgacagaaatgagaaataga

SEQ ID NO: 75134 - DNA, 201 bp, Homo sapiens
agggtcttgatctgtcactcaagttggactgcagaggtgagatcatggcttactgcaaccgccacctccctggctcaagcaattctcctgcctgagcctcycaagcagctgggactacaggtgcatgctaccacacctggttaaattttttatattttttttatagagatcgaatctcaccatgtttcccaggcttgtctc

SEQ ID NO: 75135 - DNA, 201 bp, Homo sapiens
ctgattaaaaggcaggtctgctagtcattgtgtcttggctggaatgaaagccctttggaatagcagtgttccagtgtgtgaacgtgagtagaaagaactaygtagtttggatagctctccttatttttgttttccagtgttttactgcacggaatcacttgtctggatctttacttaactaaattactgattaaaatactt

SEQ ID NO: 75136 - DNA, 201 bp, Homo sapiens
ttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttc

SEQ ID NO: 75137 - DNA, 201 bp, Homo sapiens
agggagagatgggaattgctcacacatttgctaccacttttttttttctttaggttctgattaaaaggcaggtctgctagtcattgtgtcttggctggaaygaaagccctttggaatagcagtgttccagtgtgtgaacgtgagtagaaagaactatgtagtttggatagctctccttatttttgttttccagtgttttac

SEQ ID NO: 75138 - DNA, 201 bp, Homo sapiens
tggatccccttctctctctctctctacgttcctcgcactgaccaacctctttgtgatcttcaggcgtgccatacccccagcccgtaataaaatctttactkccatcttgtgtttcttgtaatgactgaagaggttttctctatcataaagatcctaaatgaaaacatacccgcatatgagctctttctggtgtgtttcctt

SEQ ID NO: 75139 - DNA, 201 bp, Homo sapiens
gtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaag

SEQ ID NO: 75140 - DNA, 201 bp, Homo sapiens
tagaagggtgaggagggtggagaagagttttattgagtgacaaaacagcttctcagcagagaagagacacaagggtggaccccagatgaagtcagggggtyattctctcagtgtggctggttctggagcctttatggactcagaattggaagtgtgtgttaattggttggtgagtatgcaaaaaaggctaaaacaaagcca

SEQ ID NO: 75141 - DNA, 201 bp, Homo sapiens
tttataaaatgtatgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctc

SEQ ID NO: 75142 - DNA, 201 bp, Homo sapiens
cagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataatttta

SEQ ID NO: 75143 - DNA, 201 bp, Homo sapiens
gaggcagaaaatgcttcttggaggagatgatgggtggattaaagaagacaagagctgagcaggagttgtagctaccggccagggaggaagggtattcagakcagaggaagcaaggtgagcaaaggcaccaagatgtgacactgctggactgccaagctattcagtgtggcagagtagggtaaaggagacaacaaagaaggg

SEQ ID NO: 75144 - DNA, 201 bp, Homo sapiens
actctacctggctccaaaacattttctttcccacaggtaaatcatgtgaaactcctccagttccagtgaatggcatggtgcatgtgatcacagacatccakgttggatccagaatcaactattcttgtactacagggtgagttggcagcaacatctcttggttccagagttccagcacagcaatactaccttctagccaca

SEQ ID NO: 75145 - DNA, 201 bp, Homo sapiens; identical to SEQ ID NO: 74685

SEQ ID NO: 75146 - DNA, 201 bp, Homo sapiens; identical to SEQ ID NO: 74686

SEQ ID NO: 75147 - DNA, 201 bp, Homo sapiens
gactttcaggcatgtgctaccaagctcagatttttttttttggaaacagggtttcactctgtcacccagactggagtgcagtggtgcaatcttggctcacygcaacctccgcctcccaggctcaagcgattctcctgcctcagcctcctgagtagtggggattacaggcgtgcggcactaccgcctggctaatttttgtat

SEQ ID NO: 75148 - DNA, 201 bp, Homo sapiens; identical to SEQ ID NO: 74688

SEQ ID NO: 75149 - DNA, 201 bp, Homo sapiens
tttgggaggccgaggtggatggatcacctgagatgaggagttctagaccagcctgaccaacatggtgaaatcccgtctctactaaaaatacaaaaattacycgggcgtggtgacctgcacctgtaattccagctactcaggaggctgaggcaggagaattgcttgaacctggggggcagaggttgcagtgagctgagattg

SEQ ID NO: 75150 - DNA, 201 bp, Homo sapiens; identical to SEQ ID NO: 74704

SEQ ID NO: 75151 - DNA, 201 bp, Homo sapiens
gcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaa

SEQ ID NO: 75152 - DNA, 201 bp, Homo sapiens; identical to SEQ ID NO: 74705

SEQ ID NO: 75153 - DNA, 201 bp, Homo sapiens; identical to SEQ ID NO: 74706

SEQ ID NO: 75154 - DNA, 201 bp, Homo sapiens
taaaaatatataaacctaatttgtgaagttagaagatagggtatttcatgaaccttacctgtagattcagtggtgaggaaaataaacaaggcttgcactasccaagtctgcaacgtcaacatcttgcgcggatatttctgcaacagacacatgtaatattacttttaatattttttctcttatatacacataatttaagac

SEQ ID NO: 75155 - DNA, 201 bp, Homo sapiens; identical to SEQ ID NO: 74707

SEQ ID NO: 75156 - DNA, 201 bp, Homo sapiens; identical to SEQ ID NO: 74708

SEQ ID NO: 75157 - DNA, 201 bp, Homo sapiens; identical to SEQ ID NO: 74710

SEQ ID NO: 75158 - DNA, 201 bp, Homo sapiens; identical to SEQ ID NO: 74713

SEQ ID NO: 75159 - DNA, 201 bp, Homo sapiens
tgggaggccgaggtggatggatcacctgagatgaggagttctagaccagcctgaccaacatggtgaaatcccgtctctactaaaaatacaaaaattacccrggcgtggtgacctgcacctgtaattccagctactcaggaggctgaggcaggagaattgcttgaacctggggggcagaggttgcagtgagctgagattgtg

SEQ ID NO: 75160 - DNA, 201 bp, Homo sapiens
ctctacaaaaaaattttaaaagagaaaaaaggcaagaaagtacgctctgcatgatttattttacagaagttcaaaaagaggcaaaagtctacggtgtttgktgacagaggtcagagcagttgttttttgtgaggaagggtataaaaggggacattctgggtgctgagcatgttctgtatcttgatctggacagtgataaat

SEQ ID NO: 75161 - DNA, 201 bp, Homo sapiens
aactaaaattgccaaatagaaggcaaaataatgcttgttgaattaataagttgcgtggggatcaagatgaagaaaatttctatatatctttcacagtacartgttactgtgaataaactgccagaagttggtaatacctacacaaaattaactaattattaaattagtttttaaattatccactctgttctcttccattag

SEQ ID NO: 75162 - DNA, 201 bp, Homo sapiens; identical to SEQ ID NO: 74728

SEQ ID NO: 75163 - DNA, 201 bp, Homo sapiens; identical to SEQ ID NO: 74731

SEQ ID NO: 75164 - DNA, 201 bp, Homo sapiens
atcatcaaaaaatagctctccagctggcgcggtggctcacgcctataatcccagcactttgggaggccgagataggcagatcacctgaggttgggagttcsagaccagcctgaccaacatagagaaaccctgtctctaataacaatacaaaattagccgggagtggtggcgcacacctgtaatctcagctacttgggaggc

SEQ ID NO: 75165 - DNA, 201 bp, Homo sapiens
gaagctgaggtgggacaaccacttgagcctgggcttatagaggctgcagcaagctaagaagccaagatcttgccattgtactccagcctgggtaacagtgygaggctctgtctcaaaaaaaaaaaaagtctcgcagaaaaaaaaaaaaagggcagtctaaaggtaaagtaaacatagcactgattggcaaatgaatagaca

SEQ ID NO: 75166 - DNA, 201 bp, Homo sapiens
catatttcttcttctactagcactaaattaagcctgctaacaactattctatgtaaccagagataaaaatccattttaagatttgttcacttaaattctarcttaagtactagtgctcctctttgaaatacaacaagtaacttcaaacttaggcaaggagttgaatcttccattattgtttcatacacattaagcctttga

SEQ ID NO: 75167 - DNA, 201 bp, Homo sapiens
cttttctattttacaaagatgggatcatgtaagtgagaaatgttttataacctttttcacttaacactacatagtggacatcttcataagttaatatatakagagtaattccttgtagcctttgctcaaattcacctcctcatagagatcttccctaaccaccctgtgtttcttatacccctttactgatttttttttttt

SEQ ID NO: 75168 - DNA, 201 bp, Homo sapiens
caaatatttcctctatattaacttatttttggttgttttttgagatagggtctcagtctgccaccctaggctggagtgcagtggcacaatctccacacacygcaacctttgcctcccgggttcaagtgactctcccacctcagcctcccaagtagctgagactttcaggcatgtgctaccaagctcagatttttttttttg

SEQ ID NO: 75169 - DNA, 201 bp, Homo sapiens; identical to SEQ ID NO: 74691

SEQ ID NO: 75170 - DNA, 201 bp, Homo sapiens; identical to SEQ ID NO: 74689

SEQ ID NO: 75171 - DNA, 201 bp, Homo sapiens; identical to SEQ ID NO: 74695

SEQ ID NO: 75172 - DNA, 201 bp, Homo sapiens; identical to SEQ ID NO: 74697

SEQ ID NO: 75173 - DNA, 201 bp, Homo sapiens; identical to SEQ ID NO: 74699

SEQ ID NO: 75174 - DNA, 201 bp, Homo sapiens; identical to SEQ ID NO: 74700

SEQ ID NO: 75175 - DNA, 201 bp, Homo sapiens; identical to SEQ ID NO: 74701

SEQ ID NO: 75176 - DNA, 201 bp, Homo sapiens
ttatcaccatttcatagatcaggaaattgaggtacagaaaatgactgaccaaggtcctacagctagtaagggggacagctgggatagtattattcatacayacacacacacacacatacacacacacacacacacacacacacgtacacataaatatttttacgagacagggtcttgctctgttacccaggatagagtgca

SEQ ID NO: 75177 - DNA, 201 bp, Homo sapiens
aggcagccatcagggtttttgctgataagaaacgcagaaatgttagactcatgggtttcctatcaagttgtaactaaaaaatggtgaattttattgtttayaaattagaccttaaaaacaaacaaaatctgcccagataaggtataaccaaaagaaacgagtgcttaatacctccaaagacatctacaagaatgtttacag

SEQ ID NO: 75178 - DNA, 201 bp, Homo sapiens; identical to SEQ ID NO: 74702

SEQ ID NO: 75179 - DNA, 201 bp, Homo sapiens; identical to SEQ ID NO: 74703

SEQ ID NO: 75180 - DNA, 201 bp, Homo sapiens
ctaaaatacattgttacattgttaaggtacagaacaacgcatttgctattatttgtgggcaaaacaatatacaagaaaacaaaacacacattcgttttttwatatatgcacagtatctctaggaggataaaagttcaaatactggctgtgacagggtatttgagagatcagggtggtagggagacgctccaccatatactc

SEQ ID NO: 75181 - DNA, 201 bp, Homo sapiens
ttccagaccagcctggcctacatggtgaaaccccgtccatactaaaaatacaaaaagtagctgggcgtggtggtgggcacctgtaatcccagctacttggkaggctgaggcaggagaatcacttgaacccgggaggcggaggttgcagtgaacggagatggcgccactgcactccaggctgggcgacagagtgaaactccg

SEQ ID NO: 75182 - DNA, 201 bp, Homo sapiens
caccaggctgcagtgcagtagcacaattacagctcactgcagcttgaacttcccaggctcaggtaattctcccacctcagcctcccgagtagctgggactrgagatggcaccatcatgcctagctaatttttttatttttagtacagatagtgttttgccatgttgcccaggctgagctcaaagggatctgcccacctcag

SEQ ID NO: 75183 - DNA, 201 bp, Homo sapiens
ttagctaataagctataattctttgttttcttattggttgctttaggtttatagtgtacatctttaacttttcacaatctatcttcaagtaatattatgtyacctcaggcatagtatataatagtatacttccatttctccccccagacctttgtgctattttagcatatattttacttttgcatatattaaaacttcaca

SEQ ID NO: 75184 - DNA, 201 bp, Homo sapiens
tctttgttttcttattggttgctttaggtttatagtgtacatctttaacttttcacaatctatcttcaagtaatattatgtcacctcaggcatagtatatwatagtatacttccatttctccccccagacctttgtgctattttagcatatattttacttttgcatatattaaaacttcacattggtagctcccacctgaa

SEQ ID NO: 75185 - DNA, 201 bp, Homo sapiens; identical to SEQ ID NO: 74714

SEQ ID NO: 75186 - DNA, 201 bp, Homo sapiens; identical to SEQ ID NO: 74716

SEQ ID NO: 75187 - DNA, 201 bp, Homo sapiens; identical to SEQ ID NO: 74715

SEQ ID NO: 75188 - DNA, 201 bp, Homo sapiens
aatcccagcactttgggaggccgaggtaggtagattgcttgagcccaggagttcaagaccagcctaagcaacatggcaaaaccccatctctataaaaaatwaaaaaaaaataaaaaaaaaaatcagccgggcatggtggaccatgcctgtaatcccagctactcaggaagctgaggtgggacaaccacttgagcctgggct

SEQ ID NO: 75189 - DNA, 201 bp, Homo sapiens
ggtcacaccactgcactccagcctaggtgacagagcgagactccgtctcaaaacaaagttcagaaaaaaggcagccatcagggtttttgctgataagaaaygcagaaatgttagactcatgggtttcctatcaagttgtaactaaaaaatggtgaattttattgtttataaattagaccttaaaaacaaacaaaatctgcc

SEQ ID NO: 75190 - DNA, 201 bp, Homo sapiens
gtttgaacccggaaggcaggggctgcagtgagctgagatggcaccactgcactccagcctgggcaacaaagcgaaattctatttaaaaaaaaaaaaagacyacatttgtcaaaattcactgaattctgtgtcaactgtttcaaaggcactgagattttaccttactttcaagctaacaagtcagcctaccacagtgtcatg

SEQ ID NO: 75191 - DNA, 201 bp, Homo sapiens
ggcagatcacttgaggtcaggagttcgagacgagcctggccaacatggtgaaaccccatctctattaaaaatacaaaaagtagcttggcgtggtggcgggygtctgtgatgccagctactcgggaggctgaggcaggagaactgtttgaacccgtgaaacagaggttgcagtaagcccagatcatgccactggactccagc

SEQ ID NO: 75192 - DNA, 201 bp, Homo sapiens
ctctatgacttgattgtggtggtgactataagactctatacatttggcaggacgcgatggctcacgcctgtaatcccagcactttgggaggccgaggtggrcagatcacttgaggtcaggagttcgagacgagcctggccaacatggtgaaaccccatctctattaaaaatacaaaaagtagcttggcgtggtggcgggtg

SEQ ID NO: 75193 - DNA, 201 bp, Homo sapiens
ggcaactaagagaagaatcagtagggtaatcagcatgcacagggttaaaaaccagatcctatagaatgattagatatctgggtaactgtaatttggggacraggacttacagacacaggaaagcagcccttcaatacctgaagagcatgtagtatgaatgacgtaaaatttaacaagatttaacaaattttctcctattca

SEQ ID NO: 75194 - DNA, 201 bp, Homo sapiens
tgcctcactccccctttgtcttctgccatgactggaaacttcccaaagcctccccagaagcagatgccaccatgcttccgcacagcctacagaactgtgartcaattaaaccttttctttataaattacccagtctcaggtatttctttatagcagtgtgagaatggactaatacttggctaattaaaaaaaaaaattgta

SEQ ID NO: 75195 - DNA, 201 bp, Homo sapiens
gcatgatatggtttgaatctgtgtccccacccaaatctcatgtcgtatcataatccccagtgttggaggtggggcctggtggagaggtgattaaatcatargggtggatttctcacttggtactgcctcgagatggtggatgaggaatgagttattgtgagctctggtcatttaaaagtttgtagcaccttccctttctct

SEQ ID NO: 75196 - DNA, 201 bp, Homo sapiens
tcaacatgaaacaagggtatatctcagctaccacatagttacgtaactttataaaaatgatgttcagatcaaagtaagtatgagtgccactgtagtcagaytggttttggtatattacgtttatttttttcataaagaaacttttattcaaagacaacaataacctttataataaatatgcagtaactatcatttttataa

SEQ ID NO: 75197 - DNA, 201 bp, Homo sapiens
tcactagctcaacatgaaacaagggtatatctcagctaccacatagttacgtaactttataaaaatgatgttcagatcaaagtaagtatgagtgccactgyagtcagattggttttggtatattacgtttatttttttcataaagaaacttttattcaaagacaacaataacctttataataaatatgcagtaactatcat

SEQ ID NO: 75198 - DNA, 201 bp, Homo sapiens
tgtaattcatagcatggccaaaaattttcccgatatataaagaatgcctacaaatcactaaaaaattctaacacctaatagaacaggcaaacatatttgartagtttatagaaaaggaaatacaagtaaatcaagcatgtgaaaagatactttcaacctcactcaaaatgagagatataaattagaactactcagatagga

SEQ ID NO: 75199 - DNA, 201 bp, Homo sapiens; identical to SEQ ID NO: 74733

SEQ ID NO: 75200 - DNA, 201 bp, Homo sapiens
tctccacacaccgcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcactgcaacctccgcctcccaggctcaagcgatt

SEQ ID NO: 75201 - DNA, 201 bp, Homo sapiens
atttttttttttggaaacagggtttcactctgtcacccagactggagtgcagtggtgcaatcttggctcactgcaacctccgcctcccaggctcaagcgaktctcctgcctcagcctcctgagtagtggggattacaggcgtgcggcactaccgcctggctaatttttgtatttttagtagatacggggttttaccatgtt

SEQ ID NO: 75202 - DNA, 201 bp, Homo sapiens
tttttttggaaacagggtttcactctgtcacccagactggagtgcagtggtgcaatcttggctcactgcaacctccgcctcccaggctcaagcgattctcmtgcctcagcctcctgagtagtggggattacaggcgtgcggcactaccgcctggctaatttttgtatttttagtagatacggggttttaccatgttggcca

SEQ ID NO: 75203 - DNA, 201 bp, Homo sapiens
ttttttggaaacagggtttcactctgtcacccagactggagtgcagtggtgcaatcttggctcactgcaacctccgcctcccaggctcaagcgattctccwgcctcagcctcctgagtagtggggattacaggcgtgcggcactaccgcctggctaatttttgtatttttagtagatacggggttttaccatgttggccag

SEQ ID NO: 75204 - DNA, 201 bp, Homo sapiens
ggtttttgctgataagaaacgcagaaatgttagactcatgggtttcctatcaagttgtaactaaaaaatggtgaattttattgtttataaattagaccttaaaaacaaacaaaatctgcccagataaggtataaccaaaagaaacgagtgcttaatacctccaaagacatctacaagaatgtttacagaagttttattcaa

SEQ ID NO: 75205 - DNA, 201 bp, Homo sapiens; identical to SEQ ID NO: 74738

SEQ ID NO: 75206 - DNA, 201 bp, Homo sapiens; identical to SEQ ID NO: 74737

SEQ ID NO: 75207 - DNA, 201 bp, Homo sapiens; identical to SEQ ID NO: 74740

SEQ ID NO: 75208 - DNA, 201 bp, Homo sapiens; identical to SEQ ID NO: 74742

SEQ ID NO: 75209 - DNA, 201 bp, Homo sapiens; identical to SEQ ID NO: 74743

SEQ ID NO: 75210 - DNA, 201 bp, Homo sapiens; identical to SEQ ID NO: 74745

SEQ ID NO: 75211 - DNA, 201 bp, Homo sapiens; identical to SEQ ID NO: 74430

SEQ ID NO: 75212 - DNA, 201 bp, Homo sapiens; identical to SEQ ID NO: 74480

SEQ ID NO: 75213 - DNA, 201 bp, Homo sapiens; identical to SEQ ID NO: 74482

SEQ ID NO: 75214 - DNA, 201 bp, Homo sapiens; identical to SEQ ID NO: 74483

SEQ ID NO: 75215 - DNA, 201 bp, Homo sapiens; identical to SEQ ID NO: 74435

SEQ ID NO: 75216 - DNA, 201 bp, Homo sapiens; identical to SEQ ID NO: 74439

SEQ ID NO: 75217 - DNA, 201 bp, Homo sapiens; identical to SEQ ID NO: 74440

SEQ ID NO: 75218 - DNA, 201 bp, Homo sapiens; identical to SEQ ID NO: 74441

SEQ ID NO: 75219 - DNA, 201 bp, Homo sapiens; identical to SEQ ID NO: 74484

SEQ ID NO: 75220 - DNA, 201 bp, Homo sapiens; identical to SEQ ID NO: 74442

SEQ ID NO: 75221 - DNA, 201 bp, Homo sapiens; identical to SEQ ID NO: 74485

SEQ ID NO: 75222 - DNA, 201 bp, Homo sapiens; identical to SEQ ID NO: 74486

SEQ ID NO: 75223 - DNA, 201 bp, Homo sapiens; identical to SEQ ID NO: 74487

SEQ ID NO: 75224 - DNA, 201 bp, Homo sapiens; identical to SEQ ID NO: 74488

SEQ ID NO: 75225 - DNA, 201 bp, Homo sapiens; identical to SEQ ID NO: 74489

SEQ ID NO: 75226 - DNA, 201 bp, Homo sapiens; identical to SEQ ID NO: 74491

SEQ ID NO: 75227 - DNA, 201 bp, Homo sapiens; identical to SEQ ID NO: 74490

SEQ ID NO: 75228 - DNA, 201 bp, Homo sapiens; identical to SEQ ID NO: 74492

SEQ ID NO: 75229 - DNA, 201 bp, Homo sapiens; identical to SEQ ID NO: 74493

SEQ ID NO: 75230 - DNA, 201 bp, Homo sapiens; identical to SEQ ID NO: 74494

SEQ ID NO: 75231 - DNA, 201 bp, Homo sapiens; identical to SEQ ID NO: 74495

SEQ ID NO: 75232 - DNA, 201 bp, Homo sapiens; identical to SEQ ID NO: 74443

SEQ ID NO: 75233 - DNA, 201 bp, Homo sapiens; identical to SEQ ID NO: 74444

SEQ ID NO: 75234 - DNA, 201 bp, Homo sapiens; identical to SEQ ID NO: 74446

SEQ ID NO: 75235 - DNA, 201 bp, Homo sapiens; identical to SEQ ID NO: 74447

SEQ ID NO: 75236 - DNA, 201 bp, Homo sapiens; identical to SEQ ID NO: 74449

SEQ ID NO: 75237 - DNA, 201 bp, Homo sapiens; identical to SEQ ID NO: 74451

SEQ ID NO: 75238 - DNA, 201 bp, Homo sapiens; identical to SEQ ID NO: 74452

SEQ ID NO: 75239 - DNA, 201 bp, Homo sapiens; identical to SEQ ID NO: 74453

SEQ ID NO: 75240 - DNA, 201 bp, Homo sapiens; identical to SEQ ID NO: 74454

SEQ ID NO: 75241 - DNA, 201 bp, Homo sapiens; identical to SEQ ID NO: 74455

SEQ ID NO: 75242 - DNA, 201 bp, Homo sapiens; identical to SEQ ID NO: 74456

SEQ ID NO: 75243 - DNA, 201 bp, Homo sapiens; identical to SEQ ID NO: 74457

SEQ ID NO: 75244 - DNA, 201 bp, Homo sapiens; identical to SEQ ID NO: 74458

SEQ ID NO: 75245 - DNA, 201 bp, Homo sapiens; identical to SEQ ID NO: 74459

SEQ ID NO: 75246 - DNA, 201 bp, Homo sapiens; identical to SEQ ID NO: 74460

SEQ ID NO: 75247 - DNA, 201 bp, Homo sapiens; identical to SEQ ID NO: 74461

SEQ ID NO: 75248 - DNA, 201 bp, Homo sapiens; identical to SEQ ID NO: 74463

SEQ ID NO: 75249 - DNA, 201 bp, Homo sapiens; identical to SEQ ID NO: 74464

SEQ ID NO: 75250 - DNA, 201 bp, Homo sapiens; identical to SEQ ID NO: 74465

SEQ ID NO: 75251 - DNA, 201 bp, Homo sapiens; identical to SEQ ID NO: 74466

SEQ ID NO: 75252 - DNA, 201 bp, Homo sapiens; identical to SEQ ID NO: 74467

SEQ ID NO: 75253 - DNA, 201 bp, Homo sapiens; identical to SEQ ID NO: 74469

SEQ ID NO: 75254 - DNA, 201 bp, Homo sapiens; identical to SEQ ID NO: 74470

SEQ ID NO: 75255 - DNA, 201 bp, Homo sapiens; identical to SEQ ID NO: 74471

SEQ ID NO: 75256 - DNA, 201 bp, Homo sapiens; identical to SEQ ID NO: 74472

SEQ ID NO: 75257 - DNA, 201 bp, Homo sapiens; identical to SEQ ID NO: 74473

SEQ ID NO: 75258 - DNA, 201 bp, Homo sapiens; identical to SEQ ID NO: 74474

SEQ ID NO: 75259 - DNA, 201 bp, Homo sapiens; identical to SEQ ID NO: 74496

SEQ ID NO: 75260 - DNA, 201 bp, Homo sapiens; identical to SEQ ID NO: 74475

SEQ ID NO: 75261 - DNA, 201 bp, Homo sapiens; identical to SEQ ID NO: 74497

SEQ ID NO: 75262 - DNA, 201 bp, Homo sapiens; identical to SEQ ID NO: 74498

SEQ ID NO: 75263 - DNA, 201 bp, Homo sapiens; identical to SEQ ID NO: 74499

SEQ ID NO: 75264 - DNA, 201 bp, Homo sapiens; identical to SEQ ID NO: 74476

SEQ ID NO: 75265 - DNA, 201 bp, Homo sapiens; identical to SEQ ID NO: 74477

SEQ ID NO: 75266 - DNA, 201 bp, Homo sapiens; identical to SEQ ID NO: 74478

SEQ ID NO: 75267 - DNA, 201 bp, Homo sapiens; identical to SEQ ID NO: 74479

SEQ ID NO: 75268 - DNA, 201 bp, Homo sapiens
ttttcttttttattatgtcctttcctggttttggtattagggcgatcctggcttcatagaataatttagggaggattctctccttctctgttttggaatartttcagtaggattggtaccaattctcttctttgaatgtctgattgaattcagctgtgagtccatgtgaatctgtgattttttatcgttggcagtttttta

SEQ ID NO: 75269 - DNA, 201 bp, Homo sapiens
agctcaggaaccctgtgggggtaaaagacaagttatcccaggttgccagcctccttcctgtaagtccaggagagaaaaattatggtgagaggatgcgtctyaggctgataaataacagagttgatctctgcttccttcagcaatggagccaagcaatgctctttccccacttgcctgaaggctgacattgaaagaggggtt

SEQ ID NO: 75270 - DNA, 201 bp, Homo sapiens
tgtttgaaaaagagtgctacatgtattgctttgctctttccccagtggggagtcatttctgtctgtatgaaaattaagacaggaggcctaggctggtggaygaatgcagacttagacgacaaatgacgtctattggatgcattcaaaagtccaagccgtatttggttaaggagtatttgtgatggcacacaaagaaaatgg

SEQ ID NO: 75271 - DNA, 201 bp, Homo sapiens
tactctattttagttttctatttcttcctgtagttttgacctttatatctttctagaaacgtatccgttttatctaaattttcaaatttatatgtatagarttggtcgtaagattttgcattttaaaatgtgtataaatgtcatttacccttttcgttctgaatctcctgtattttccttaggagtcttgccagaggtctc

SEQ ID NO: 75272 - DNA, 201 bp, Homo sapiens
aaaattatggtgagaggatgcgtctcaggctgataaataacagagttgatctctgcttccttcagcaatggagccaagcaatgctctttccccacttgccygaaggctgacattgaaagaggggttcatgcctgagattcccttcctggaggagcctcagtgttacaatgcacagaaaggactcatatcctcctgcaaccc

SEQ ID NO: 75273 - DNA, 201 bp, Homo sapiens
gagaaaaattatggtgagaggatgcgtctcaggctgataaataacagagttgatctctgcttccttcagcaatggagccaagcaatgctctttccccactygcctgaaggctgacattgaaagaggggttcatgcctgagattcccttcctggaggagcctcagtgttacaatgcacagaaaggactcatatcctcctgca

SEQ ID NO: 75274 - DNA, 201 bp, Homo sapiens
aacacataacaatgttggattgttaagaaaaaaaaaaagaccagtgtttgaaaaagagtgctacatgtattgctttgctctttccccagtggggagtcatytctgtctgtatgaaaattaagacaggaggcctaggctggtggatgaatgcagacttagacgacaaatgacgtctattggatgcattcaaaagtccaagcc

SEQ ID NO: 75275 - DNA, 201 bp, Homo sapiens
aatatctttttccactcctttaccttaagtttttgtgagtccttacacattagatgactcttgaagactgaagatacttggttgctgaatttttatccttyctgccattctgtatcttttaagtggagagtgttaatattgagatgtgaagtactgttctatttctcatgctagttgttgcctgaattccttatttttttc

SEQ ID NO: 75276 - DNA, 201 bp, Homo sapiens
cgttgaactgaaatgaaagacgaaaggttatataatcagccattgaaaccacctcagataattagagaaacatttccatcccaccaaattccattgcccaycactcaatggacgctccgcaggagcctgagtacttgggacctcatgcatctggctgcattaagatcccagcctgggatccctctctcgctataggtcatg

SEQ ID NO: 75277 - DNA, 201 bp, Homo sapiens
ttatggtgagaggatgcgtctcaggctgataaataacagagttgatctctgcttccttcagcaatggagccaagcaatgctctttccccacttgcctgaargctgacattgaaagaggggttcatgcctgagattcccttcctggaggagcctcagtgttacaatgcacagaaaggactcatatcctcctgcaacccaccc

SEQ ID NO: 75278 - DNA, 201 bp, Homo sapiens
ttgcattactgttttataggccctgtgagatttatgctttaaggaggttctattttggtgtattttggagttttgtttgaagacttagaactccttttagyattttgtgtagtgctggattggtagcggtgaagtctctcagcatttgtttgtctgaaaaagactttatctctccttcatttatgacgcttagttttgctg

SEQ ID NO: 75279 - DNA, 201 bp, Homo sapiens
  misc_feature (1)...(201): n = A,T,C or G, or insertion/deletion polymorphism (see Tables 1-2)
tgggtagagaaatgccctcaggtgtggacagggttaggcaggtctgagctcagactctcctcgggcggggggcttgcggcagccactgtgagggatggggyggagggtttttctccagccaatggaattatgttccagagggcattatggcnnnnnnnnnnnnnnnnnnnnnnnnnnnnnnnnnnnnnnnnnnnnnnnnnn

SEQ ID NO: 75280 - DNA, 201 bp, Homo sapiens
ccgtatttggttaaggagtatttgtgatggcacacaaagaaaatggttaaagtgtattagattatatttatgattttaaattctgatgttcatttaacttmttaatggtaatgataaaacatgctctcagtaaggtatatgttgaattagtgctgtgggaatatgggtcctatcaggcagatttgcagtctgctcaccatt

SEQ ID NO: 75281 - DNA, 201 bp, Homo sapiens
acttgatttgggggcagctcactgaaatacagtcaattcagaagagtgtcatgtgtaacaggccccattatacaatagttaacatatccccattttcatgsttctcttctttcctatgtttaaaccaaaatgaacttctttattaactcctactgtctactaaaaccctcagagaaaagtgatgagagatgatttggtgca

SEQ ID NO: 75282 - DNA, 201 bp, Homo sapiens
aagaggagcacagtagctttcgggaattgaccagggacaggtgcccagggacacacaaggcccagaagatgcttgtaagaagccagggagactgaaggcaycaactggatgtataagagagctgctgtgcactgattgtgtgtatcaggagtgaagaatccatcctctacacgaaaaagaaagcttacaacaaacatgtcc

SEQ ID NO: 75283 - DNA, 201 bp, Homo sapiens
taagagagctgctgtgcactgattgtgtgtatcaggagtgaagaatccatcctctacacgaaaaagaaagcttacaacaaacatgtcctctaccttgaccraaaggtgtcaatatgagacgcaaaacacataacaatgttggattgttaagaaaaaaaaaaagaccagtgtttgaaaaagagtgctacatgtattgctttg

SEQ ID NO: 75284 - DNA, 201 bp, Homo sapiens
agtgagctcaggaaccctgtgggggtaaaagacaagttatcccaggttgccagcctccttcctgtaagtccaggagagaaaaattatggtgagaggatgcrtctcaggctgataaataacagagttgatctctgcttccttcagcaatggagccaagcaatgctctttccccacttgcctgaaggctgacattgaaagagg

SEQ ID NO: 75285 - DNA, 201 bp, Homo sapiens
tgtgtgtggcttctctttcctgactccctgactcagtccagcctctctgcagactccagctgtatttacttatatctgtgccagtgacgcccaagtctgtrccttcagccccacctctcctgaaattggaggaagccggtcccccgatggaagatattatttgcaaggggagatgggcaagaggagcacagtagctttcgg

SEQ ID NO: 75286 - DNA, 201 bp, Homo sapiens
ttttgtgtagtgctggattggtagcggtgaagtctctcagcatttgtttgtctgaaaaagactttatctctccttcatttatgacgcttagttttgctggrtacaaaattcttgcctggaaattattttgtttgaggaggctaaagataagaccccagtcttttctggcttataggctgctgttaatctgataggttttcc

SEQ ID NO: 75287 - DNA, 201 bp, Homo sapiens
actccctgactcagtccagcctctctgcagactccagctgtatttacttatatctgtgccagtgacgcccaagtctgtgccttcagccccacctctcctgraattggaggaagccggtcccccgatggaagatattatttgcaaggggagatgggcaagaggagcacagtagctttcgggaattgaccagggacaggtgcc

SEQ ID NO: 75288 - DNA, 201 bp, Homo sapiens
caggtgcccagggacacacaaggcccagaagatgcttgtaagaagccagggagactgaaggcatcaactggatgtataagagagctgctgtgcactgattrtgtgtatcaggagtgaagaatccatcctctacacgaaaaagaaagcttacaacaaacatgtcctctaccttgaccaaaaggtgtcaatatgagacgcaaa

SEQ ID NO: 75289 - DNA, 201 bp, Homo sapiens
aaatcatattaattttatgctgcataggtttctcacaagtttcctgtgaagccaaaagggaaaataagacagataaagggtccttatttactatatactgycttccttagcttattatgtgacagctgaaattactacgcaaaaacaagtcagcagcattttcctttatagtttttgaggaaatgaggctgatcagggata

SEQ ID NO: 75290 - DNA, 201 bp, Homo sapiens
aacaggccccattatacaatagttaacatatccccattttcatggttctcttctttcctatgtttaaaccaaaatgaacttctttattaactcctactgtytactaaaaccctcagagaaaagtgatgagagatgatttggtgcatatttttaaaggaaaacaaacagtcatgttgggttttgattatttgtggtgctaag

SEQ ID NO: 75291 - DNA, 201 bp, Homo sapiens
gaaccaacctcataaaatgatctcaaaaattctgttccattctatgttctagaatcacacgtgtaagaggcatgatctgctcctggaaatgtgggaggacrccctcatctgcaataagatcaggacagggccctttggaaggcgattctttgcttcccatgacaatttctttgatattctctactctattttagttttcta

SEQ ID NO: 75292 - DNA, 201 bp, Homo sapiens
tgagggcactaaacttgatttgggggcagctcactgaaatacagtcaattcagaagagtgtcatgtgtaacaggccccattatacaatagttaacatatcyccattttcatggttctcttctttcctatgtttaaaccaaaatgaacttctttattaactcctactgtctactaaaaccctcagagaaaagtgatgagaga

SEQ ID NO: 75293 - DNA, 201 bp, Homo sapiens
caatttgtctatgtgcctgtttttataccattcccatgctgttttggtgactatagccttgcagtatattttgaagtcaggtaatgtgatgctccagattyattcgttttgcttaatcttactttggctatgtgggctcttttgtagttccatatgaattttaggattgtttttttctagctctgtaaagaatgatgatgg

SEQ ID NO: 75294 - DNA, 201 bp, Homo sapiens
ttggaggatgtttcatgtgctgatgagaagaatgtatattctacagttgttgagtagaatgttctgtaaatatctgttaagtttatttcttctagtgtaamttaagtccattgtttcattgttgactttctgtcttgatgactttctagtactgtcagtggagtattgaagtccccactattattgtgttgctgtctatct

SEQ ID NO: 75295 - DNA, 201 bp, Homo sapiens
gctcctctcagggtggcaactaatgacttttatacaactcaagccagtggtcactgttctgtttctgtcttatgtgtgtcattagtgtgtttgagatgccycctctcctctttcctggaagttttctcctgtctcttgtcttttatgaacccacttcctctctgttttcctaccaatttctagtcctctgcttttcagcct

SEQ ID NO: 75296 - DNA, 201 bp, Homo sapiens
atgtgctgatgagaagaatgtatattctacagttgttgagtagaatgttctgtaaatatctgttaagtttatttcttctagtgtaacttaagtccattgtytcattgttgactttctgtcttgatgactttctagtactgtcagtggagtattgaagtccccactattattgtgttgctgtctatctcatttctcatgtct

SEQ ID NO: 75297 - DNA, 201 bp, Homo sapiens
cttttcttctgctgggtttgggtttggtttgttcttgtttctctagttccttgaggtgtgactttacattttgtatttgtgctctttcagactttttgatrtaggcatttaatgctatgaactttcctcttaggactgtttttactgtgtccgagtggttttcacaagttgtgtcactattatcattcagttcagagaatt

SEQ ID NO: 75298 - DNA, 201 bp, Homo sapiens
ttcttaggtcatttaacataatcccaaatttcttggaggctttgtttatttattaaagttcttttttctttgtctttgtctgactgggttaattcgaaagkcttgttgtttgagctatgaagttctttcttctacttgttggatcctattgttgaaactttccagtgcattttgtatttctctaagtgtgtctttcatttc

SEQ ID NO: 75299 - DNA, 201 bp, Homo sapiens
cacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatcgctgtactgttttccataggttgtactagttta

SEQ ID NO: 75300 - DNA, 201 bp, Homo sapiens
tcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtc

SEQ ID NO: 75301 - DNA, 201 bp, Homo sapiens
catgtgtgtgcaagtgtctttttcatacaatggcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacgtctattttttttttt

SEQ ID NO: 75302 - DNA, 201 bp, Homo sapiens
caactcaagccagtggtcactgttctgtttctgtcttatgtgtgtcattagtgtgtttgagatgccccctctcctctttcctggaagttttctcctgtctsttgtcttttatgaacccacttcctctctgttttcctaccaatttctagtcctctgcttttcagcctctttcttcatgtctgtgtttgtctggatgcagga

SEQ ID NO: 75303 - DNA, 201 bp, Homo sapiens
gttctttaaggcatcgctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgt

SEQ ID NO: 75304 - DNA, 201 bp, Homo sapiens
aaattaagacaggaggcctaggctggtggatgaatgcagacttagacgacaaatgacgtctattggatgcattcaaaagtccaagccgtatttggttaagkagtatttgtgatggcacacaaagaaaatggttaaagtgtattagattatatttatgattttaaattctgatgttcatttaacttcttaatggtaatgata

SEQ ID NO: 75305 - DNA, 201 bp, Homo sapiens
gtccagctggagggatgggagggcctctctgccacacatagaactagaggccatgatgcccactcatgaatgagccccttccctgagagcgagaaatcttrggtccacacagctgggttcttaggacagcagaggaggaggcattttcttcttactcaagagaaaggctgggctgagggggccaggtcaggagcacgagaa

SEQ ID NO: 75306 - DNA, 201 bp, Homo sapiens
taatctggtgtctgaggcctggcagcaccacactctcttcagtgagtcaggctcaagtctgagcacatctgcagagcttatgtttgctgtgttgctcatgkaaggcagggaatccaaaattgttttcttagagatggactctcactatgtttcctaggctgctttcaaactcctggcctcaagtgatcctcctgtctcggc

SEQ ID NO: 75307 - DNA, 201 bp, Homo sapiens
aagcgtctttcccaaggagcctgtggatctgggccagcccaacaccctcgtctgccatgttgacaagttcttcccaccagtgctgaacatcacgtggctgygcaatggggagccagtcattgagggtattgcagagaccatcttcctgcccagcaagaaactcagattacacaggttccactatctgaccctcgttcccat

SEQ ID NO: 75308 - DNA, 201 bp, Homo sapiens
ttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctgg

SEQ ID NO: 75309 - DNA, 201 bp, Homo sapiens
agaactccttttagcattttgtgtagtgctggattggtagcggtgaagtctctcagcatttgtttgtctgaaaaagactttatctctccttcatttatgamgcttagttttgctggatacaaaattcttgcctggaaattattttgtttgaggaggctaaagataagaccccagtcttttctggcttataggctgctgtta

SEQ ID NO: 75310 - DNA, 201 bp, Homo sapiens
ttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagctctgtaaagaatgatgatggcattttgatggggattgcat

SEQ ID NO: 75311 - DNA, 201 bp, Homo sapiens
ccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgcgcaatggggagccagtcattgagggtattgcagagaccatcttcct

SEQ ID NO: 75312 - DNA, 201 bp, Homo sapiens
tagtgattcctgtggcctctcatgtcattactgccatcaaatccatctgctgtcctcctcaccccatgttcctgccctggcctacgccttcattacttccyaccagagggcttaaaagtgctactggtcttgccttgagtcccgcctcctccagcccatccttcctacaggtgccccatccaaacacaaatctgaccgtgt

SEQ ID NO: 75313 - DNA, 201 bp, Homo sapiens
gtaatgtgatgctccagatttattcgttttgcttaatcttactttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttcc

SEQ ID NO: 75314 - DNA, 201 bp, Homo sapiens
ttgagtcccgcctcctccagcccatccttcctacaggtgccccatccaaacacaaatctgaccgtgttactctcctgcttaagatacttcacaacttcctrtgtcctgtgggataaaatgcaaacacttgccatcagcacacaaggcaggttacagtgctgcctggcccacatctcccctggcttcagtcacactgaagaa

SEQ ID NO: 75315 - DNA, 201 bp, Homo sapiens
gatgatggattttgtcaaatgctttttctgcatctattgagatcatatgatttttgttttcaaatctgtttatgtgatctatcacatttattgacttgtgygtattaaatcatccttgcatccctggcatgaaacccaatttatcaccatgtatgatctttttgatatgctgttggattatgttagcttgtattttgttga

SEQ ID NO: 75316 - DNA, 201 bp, Homo sapiens
gcattctgtgtagcatcctacgtattcacccattctccatcttctccttcatgcagcagaccatgtgtcaacatatgcggagtttgtgcagacgcacagamcctctggggagtatatgtttgaatttgatgaggaggagcagttctacgtgaacctggatgagaaggagatggtctggcctctaccagagtttattcacac

SEQ ID NO: 75317 - DNA, 201 bp, Homo sapiens
gtaaaagacaagttatcccaggttgccagcctccttcctgtaagtccaggagagaaaaattatggtgagaggatgcgtctcaggctgataaataacagagytgatctctgcttccttcagcaatggagccaagcaatgctctttccccacttgcctgaaggctgacattgaaagaggggttcatgcctgagattcccttcc

SEQ ID NO: 75318 - DNA, 201 bp, Homo sapiens
tccttcctgtaagtccaggagagaaaaattatggtgagaggatgcgtctcaggctgataaataacagagttgatctctgcttccttcagcaatggagccawgcaatgctctttccccacttgcctgaaggctgacattgaaagaggggttcatgcctgagattcccttcctggaggagcctcagtgttacaatgcacagaa

SEQ ID NO: 75319 - DNA, 201 bp, Homo sapiens
tgctctttccccacttgcctgaaggctgacattgaaagaggggttcatgcctgagattcccttcctggaggagcctcagtgttacaatgcacagaaaggastcatatcctcctgcaacccaccccacaaggaaatcaaagcaggaatattacctgtttatgcagatcctcgttgaactgaaatgaaagacgaaaggttata

SEQ ID NO: 75320 - DNA, 201 bp, Homo sapiens
gctcactgaaatacagtcaattcagaagagtgtcatgtgtaacaggccccattatacaatagttaacatatccccattttcatggttctcttctttcctaygtttaaaccaaaatgaacttctttattaactcctactgtctactaaaaccctcagagaaaagtgatgagagatgatttggtgcatatttttaaaggaaaa

SEQ ID NO: 75321 - DNA, 201 bp, Homo sapiens
agctttcgggaattgaccagggacaggtgcccagggacacacaaggcccagaagatgcttgtaagaagccagggagactgaaggcatcaactggatgtatmagagagctgctgtgcactgattgtgtgtatcaggagtgaagaatccatcctctacacgaaaaagaaagcttacaacaaacatgtcctctaccttgaccaa

SEQ ID NO: 75322 - DNA, 201 bp, Homo sapiens
attatggtgagaggatgcgtctcaggctgataaataacagagttgatctctgcttccttcagcaatggagccaagcaatgctctttccccacttgcctgarggctgacattgaaagaggggttcatgcctgagattcccttcctggaggagcctcagtgttacaatgcacagaaaggactcatatcctcctgcaacccacc

SEQ ID NO: 75323 - DNA, 201 bp, Homo sapiens
ctctgtcttcccttggtgccccagaggtccatgaactaatccaggtgcctgagaccatggagatgctggtctgtgccctcggcctgctggtgggcctggcrggggtccttaatggcaccattgtctcaaagaccaagcgatctgacagcatccccgggtccaggggctcctatgagtcatcctataggtgtattagggaca

SEQ ID NO: 75324 - DNA, 201 bp, Homo sapiens
ccagtctatacaccatgtatttttctttttcctttgggattcatttctgtaggtgagtaatcctctagaccctaaactcagtgggggaccctcaccatccrtgtgcggcactgaacctgctgtcacactatgcatctaagtagaggactggttctccccatgctgggctgggaggggaaatcctcacttagggaccaccaa

SEQ ID NO: 75325 - DNA, 201 bp, Homo sapiens
acagcaaatgcttttcctaaggcacaatagtcttttcagtgagctcaggaaccctgtgggggtaaaagacaagttatcccaggttgccagcctccttcctktaagtccaggagagaaaaattatggtgagaggatgcgtctcaggctgataaataacagagttgatctctgcttccttcagcaatggagccaagcaatgct

SEQ ID NO: 75326 - DNA, 201 bp, Homo sapiens
acatttccagcaacgaaggacatcctatcttttgcacaatctcaaaggcaatccacctcatttctttgaaatatatatgctatagatttttggttcactayctttaacatgtcatgaaattgattaaattctgtctatgtcttgagctgaattcagtttaaattaatatgaattttgcggagtccactaatgtgttaacca

SEQ ID NO: 75327 - DNA, 201 bp, Homo sapiens
atgttggattgttaagaaaaaaaaaaagaccagtgtttgaaaaagagtgctacatgtattgctttgctctttccccagtggggagtcatttctgtctgtaygaaaattaagacaggaggcctaggctggtggatgaatgcagacttagacgacaaatgacgtctattggatgcattcaaaagtccaagccgtatttggtta

SEQ ID NO: 75328 - DNA, 201 bp, Homo sapiens
tcattcacccattaactgatgggcatttggggtggttccatatttttgcaattgtgaatcatggtgctgtaaacatgtgtgtgcaagtgtctttttcatayaatggcttttttcctccagtagtgggattgctggatcaaatggtagatctatttctagttctttaaggcatcgctgtactgttttccataggttgtacta

SEQ ID NO: 75329 - DNA, 201 bp, Homo sapiens
ggaaatcaaagcaggaatattacctgtttatgcagatcctcgttgaactgaaatgaaagacgaaaggttatataatcagccattgaaaccacctcagatarttagagaaacatttccatcccaccaaattccattgcccatcactcaatggacgctccgcaggagcctgagtacttgggacctcatgcatctggctgcatt

SEQ ID NO: 75330 - DNA, 201 bp, Homo sapiens
cttgccttgagtcccgcctcctccagcccatccttcctacaggtgccccatccaaacacaaatctgaccgtgttactctcctgcttaagatacttcacaayttcctatgtcctgtgggataaaatgcaaacacttgccatcagcacacaaggcaggttacagtgctgcctggcccacatctcccctggcttcagtcacact

SEQ ID NO: 75331 - DNA, 201 bp, Homo sapiens
atagaaactgacttcagagcaacttcttggcagcagtatccaatttggaagttgaaggtctgtcctggagccagatgctaacgaaacacagcaaatgcttktcctaaggcacaatagtcttttcagtgagctcaggaaccctgtgggggtaaaagacaagttatcccaggttgccagcctccttcctgtaagtccaggaga

SEQ ID NO: 75332 - DNA, 201 bp, Homo sapiens
tgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaa

SEQ ID NO: 75333 - DNA, 201 bp, Homo sapiens
ctaaaattggtcaaaacgtattgtttttataatgtactgttggattcagtgacatggctaaaattagtccacaatcctgttctcctgtactattcttagcyggctctggaaatataaatgaaccaacctcataaaatgatctcaaaaattctgttccattctatgttctagaatcacacgtgtaagaggcatgatctgctc

SEQ ID NO: 75334 - DNA, 201 bp, Homo sapiens
ccatccttcctacaggtgccccatccaaacacaaatctgaccgtgttactctcctgcttaagatacttcacaacttcctatgtcctgtgggataaaatgcraacacttgccatcagcacacaaggcaggttacagtgctgcctggcccacatctcccctggcttcagtcacactgaagaactgcagttctccttgcaactt

SEQ ID NO: 75335 - DNA, 201 bp, Homo sapiens
gaggattctctccttctctgttttggaatagtttcagtaggattggtaccaattctcttctttgaatgtctgattgaattcagctgtgagtccatgtgaayctgtgattttttatcgttggcagttttttaaaaattaccatttcaatctttctgctttttattggtctgttcacagtttctatttcttcctgatttattc

SEQ ID NO: 75336 - DNA, 201 bp, Homo sapiens
ctcagtgggggaccctcaccatccgtgtgcggcactgaacctgctgtcacactatgcatctaagtagaggactggttctccccatgctgggctgggagggraaatcctcacttagggaccaccaaccatgcagtgtcatttggcttcacttcctcttccaggccgaaccctaaactctctgtaattcactgtaataataat

SEQ ID NO: 75337 - DNA, 201 bp, Homo sapiens
attaacaaatgtaatgagaaatgacattcattgagttgcttactatgttctaggcactattctaagtgcttctcatgtgttcacttatttacatctggagkttggttcttatttatttcatgttacagagcaggaatcagacaccgggagaggtgaagaccacacagcttcaaagtgcaaagcttggatttaaacccaggc

SEQ ID NO: 75338 - DNA, 201 bp, Homo sapiens
cagcagtatccaatttggaagttgaaggtctgtcctggagccagatgctaacgaaacacagcaaatgcttttcctaaggcacaatagtcttttcagtgagstcaggaaccctgtgggggtaaaagacaagttatcccaggttgccagcctccttcctgtaagtccaggagagaaaaattatggtgagaggatgcgtctcag

SEQ ID NO: 75339 - DNA, 201 bp, Homo sapiens
ataatcagccattgaaaccacctcagataattagagaaacatttccatcccaccaaattccattgcccatcactcaatggacgctccgcaggagcctgagyacttgggacctcatgcatctggctgcattaagatcccagcctgggatccctctctcgctataggtcatgtttgttccccgattatctgatatcagtggcc

SEQ ID NO: 75340 - DNA, 201 bp, Homo sapiens
atagtggtctgagacataaatggatgagggcactaaacttgatttgggggcagctcactgaaatacagtcaattcagaagagtgtcatgtgtaacaggccmcattatacaatagttaacatatccccattttcatggttctcttctttcctatgtttaaaccaaaatgaacttctttattaactcctactgtctactaaaa

SEQ ID NO: 75341 - DNA, 201 bp, Homo sapiens
tttcagtgagctcaggaaccctgtgggggtaaaagacaagttatcccaggttgccagcctccttcctgtaagtccaggagagaaaaattatggtgagaggmtgcgtctcaggctgataaataacagagttgatctctgcttccttcagcaatggagccaagcaatgctctttccccacttgcctgaaggctgacattgaaa

SEQ ID NO: 75342 - DNA, 201 bp, Homo sapiens
atagttaagaatagtggtctgagacataaatggatgagggcactaaacttgatttgggggcagctcactgaaatacagtcaattcagaagagtgtcatgtrtaacaggccccattatacaatagttaacatatccccattttcatggttctcttctttcctatgtttaaaccaaaatgaacttctttattaactcctactg

SEQ ID NO: 75343 - DNA, 201 bp, Homo sapiens
gtgtcattagtgtgtttgagatgccccctctcctctttcctggaagttttctcctgtctcttgtcttttatgaacccacttcctctctgttttcctaccamtttctagtcctctgcttttcagcctctttcttcatgtctgtgtttgtctggatgcaggagcacacactcagatccctgctatcctgactttgtgtacttt

SEQ ID NO: 75344 - DNA, 201 bp, Homo sapiens
tttattaactgaatgaaaattaacatttgaagtgtggaatttgcttcaaaatgtgccaacctttagttttcagattttgtaaatataataaatacaaagtracctaagctgaaccaattacatctgtgtagcccagtctatacaccatgtatttttctttttcctttgggattcatttctgtaggtgagtaatcctctaga

SEQ ID NO: 75345 - DNA, 201 bp, Homo sapiens
caaaatgtgccaacctttagttttcagattttgtaaatataataaatacaaagtaacctaagctgaaccaattacatctgtgtagcccagtctatacaccrtgtatttttctttttcctttgggattcatttctgtaggtgagtaatcctctagaccctaaactcagtgggggaccctcaccatccgtgtgcggcactgaa

SEQ ID NO: 75346 - DNA, 201 bp, Homo sapiens
aaagaaaaaatgattgtgtcctattccctaggttaagaagattatgagaaacatgattggttgtccttgtgtgtggcttctctttcctgactccctgactyagtccagcctctctgcagactccagctgtatttacttatatctgtgccagtgacgcccaagtctgtgccttcagccccacctctcctgaaattggaggaa

SEQ ID NO: 75347 - DNA, 201 bp, Homo sapiens
ctgacattgaaagaggggttcatgcctgagattcccttcctggaggagcctcagtgttacaatgcacagaaaggactcatatcctcctgcaacccaccccmcaaggaaatcaaagcaggaatattacctgtttatgcagatcctcgttgaactgaaatgaaagacgaaaggttatataatcagccattgaaaccacctcag

SEQ ID NO: 75348 - DNA, 201 bp, Homo sapiens
atcctctagaccctaaactcagtgggggaccctcaccatccgtgtgcggcactgaacctgctgtcacactatgcatctaagtagaggactggttctccccrtgctgggctgggaggggaaatcctcacttagggaccaccaaccatgcagtgtcatttggcttcacttcctcttccaggccgaaccctaaactctctgtaa

SEQ ID NO: 75349 - DNA, 201 bp, Homo sapiens
tctgttttggaatagtttcagtaggattggtaccaattctcttctttgaatgtctgattgaattcagctgtgagtccatgtgaatctgtgattttttatcrttggcagttttttaaaaattaccatttcaatctttctgctttttattggtctgttcacagtttctatttcttcctgatttattctaggagggttgtatat

SEQ ID NO: 75350 - DNA, 201 bp, Homo sapiens
taagtccaggagagaaaaattatggtgagaggatgcgtctcaggctgataaataacagagttgatctctgcttccttcagcaatggagccaagcaatgctytttccccacttgcctgaaggctgacattgaaagaggggttcatgcctgagattcccttcctggaggagcctcagtgttacaatgcacagaaaggactcat

SEQ ID NO: 75351 - DNA, 201 bp, Homo sapiens
ttcccatgacaatttctttgatattctctactctattttagttttctatttcttcctgtagttttgacctttatatctttctagaaacgtatccgttttayctaaattttcaaatttatatgtatagagttggtcgtaagattttgcattttaaaatgtgtataaatgtcatttacccttttcgttctgaatctcctgtat

SEQ ID NO: 75352 - DNA, 201 bp, Homo sapiens
ctaccttgaccaaaaggtgtcaatatgagacgcaaaacacataacaatgttggattgttaagaaaaaaaaaaagaccagtgtttgaaaaagagtgctacaygtattgctttgctctttccccagtggggagtcatttctgtctgtatgaaaattaagacaggaggcctaggctggtggatgaatgcagacttagacgacaa

SEQ ID NO: 75353 - DNA, 201 bp, Homo sapiens
aggaggactactcaatattgtttctaccaggagttgtgtgacttggacaagttactttacctctggggtcagttccctactatggaaaataagttcttctrcatgggggtgtgaagattcaatgagtaagtttagcacatagtaagtgcccaataaatattatcttactgtattcagcattaccattatcatagacggatg

SEQ ID NO: 75354 - DNA, 201 bp, Homo sapiens
caatgctctttccccacttgcctgaaggctgacattgaaagaggggttcatgcctgagattcccttcctggaggagcctcagtgttacaatgcacagaaargactcatatcctcctgcaacccaccccacaaggaaatcaaagcaggaatattacctgtttatgcagatcctcgttgaactgaaatgaaagacgaaaggtt

SEQ ID NO: 75355 - DNA, 201 bp, Homo sapiens
gttctcctgtactattcttagctggctctggaaatataaatgaaccaacctcataaaatgatctcaaaaattctgttccattctatgttctagaatcacaygtgtaagaggcatgatctgctcctggaaatgtgggaggacgccctcatctgcaataagatcaggacagggccctttggaaggcgattctttgcttcccat

SEQ ID NO: 75356 - DNA, 201 bp, Homo sapiens
ctgtgggggtaaaagacaagttatcccaggttgccagcctccttcctgtaagtccaggagagaaaaattatggtgagaggatgcgtctcaggctgataaakaacagagttgatctctgcttccttcagcaatggagccaagcaatgctctttccccacttgcctgaaggctgacattgaaagaggggttcatgcctgagat

SEQ ID NO: 75357 - DNA, 201 bp, Homo sapiens
tatcatatgtgatctatatatagatcatatatatatatatgtgatctatatatatatatatatatatagatctatatatatatagatcacatatatatatmtcacatatatatatatcacattttcttcattcacccattaactgatgggcatttggggtggttccatatttttgcaattgtgaatcatggtgctgtaaac

SEQ ID NO: 75358 - DNA, 201 bp, Homo sapiens
tgagttgcttactatgttctaggcactattctaagtgcttctcatgtgttcacttatttacatctggaggttggttcttatttatttcatgttacagagcrggaatcagacaccgggagaggtgaagaccacacagcttcaaagtgcaaagcttggatttaaacccaggctttgggcctgcagtggctgcagtcttgtcca

SEQ ID NO: 75359 - DNA, 201 bp, Homo sapiens
caaagaaaatggttaaagtgtattagattatatttatgattttaaattctgatgttcatttaacttcttaatggtaatgataaaacatgctctcagtaagrtatatgttgaattagtgctgtgggaatatgggtcctatcaggcagatttgcagtctgctcaccattgaatagttaagaatagtggtctgagacataaatg

SEQ ID NO: 75360 - DNA, 201 bp, Homo sapiens
gctatagatttttggttcactacctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgttttta

SEQ ID NO: 75361 - DNA, 201 bp, Homo sapiens
tgagaggatgcgtctcaggctgataaataacagagttgatctctgcttccttcagcaatggagccaagcaatgctctttccccacttgcctgaaggctgasattgaaagaggggttcatgcctgagattcccttcctggaggagcctcagtgttacaatgcacagaaaggactcatatcctcctgcaacccaccccacaag

SEQ ID NO: 75362 - DNA, 201 bp, Homo sapiens
ctctgcagactccagctgtatttacttatatctgtgccagtgacgcccaagtctgtgccttcagccccacctctcctgaaattggaggaagccggtccccmgatggaagatattatttgcaaggggagatgggcaagaggagcacagtagctttcgggaattgaccagggacaggtgcccagggacacacaaggcccagaa

SEQ ID NO: 75363 - DNA, 201 bp, Homo sapiens
ccagcctctctgcagactccagctgtatttacttatatctgtgccagtgacgcccaagtctgtgccttcagccccacctctcctgaaattggaggaagccrgtcccccgatggaagatattatttgcaaggggagatgggcaagaggagcacagtagctttcgggaattgaccagggacaggtgcccagggacacacaagg

SEQ ID NO: 75364 - DNA, 201 bp, Homo sapiens
aattaccatttcaatctttctgctttttattggtctgttcacagtttctatttcttcctgatttattctaggagggttgtatatttccaggaatctgtctyctctaggttttctagtttgtgcctgtgaatgtgttcatattagccttgaatgatattttatatttctgtaatatcagtggcattttcttccattttgttt

SEQ ID NO: 75365 - DNA, 201 bp, Homo sapiens
aacatgctctcagtaaggtatatgttgaattagtgctgtgggaatatgggtcctatcaggcagatttgcagtctgctcaccattgaatagttaagaatagyggtctgagacataaatggatgagggcactaaacttgatttgggggcagctcactgaaatacagtcaattcagaagagtgtcatgtgtaacaggccccatt

SEQ ID NO: 75366 - DNA, 201 bp, Homo sapiens
tcctcgttgaactgaaatgaaagacgaaaggttatataatcagccattgaaaccacctcagataattagagaaacatttccatcccaccaaattccattgmccatcactcaatggacgctccgcaggagcctgagtacttgggacctcatgcatctggctgcattaagatcccagcctgggatccctctctcgctataggt

SEQ ID NO: 75367 - DNA, 201 bp, Homo sapiens
attttttatcgttggcagttttttaaaaattaccatttcaatctttctgctttttattggtctgttcacagtttctatttcttcctgatttattctaggarggttgtatatttccaggaatctgtcttctctaggttttctagtttgtgcctgtgaatgtgttcatattagccttgaatgatattttatatttctgtaata

SEQ ID NO: 75368 - DNA, 201 bp, Homo sapiens
atgttaactgctcagtgactctgagggtaggatttatgtgctctgggtctgaggatttcataatgatctcgatttgaagactttctgctattctcatgacytccttccatcgttgaatccctggattgaaatcatattaattttatgctgcataggtttctcacaagtttcctgtgaagccaaaagggaaaataagacaga

SEQ ID NO: 75369 - DNA, 201 bp, Homo sapiens
tcttcccaccagtgctgaacatcacgtggctgcgcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggg

SEQ ID NO: 75370 - DNA, 201 bp, Homo sapiens
ttagcacatagtaagtgcccaataaatattatcttactgtattcagcattaccattatcatagacggatgttaagtcttcagggacaagggaaacaacctrtatcgtccatgggtcatttctgtctttgtttcttctcactccttttcttttctttcatttgcatttctcattttctgtgttattccttcatgttcccaat

SEQ ID NO: 75371 - DNA, 201 bp, Homo sapiens
ttttagtttaattaggtcccatctatttatcttgtttcttttgcatttgcttttgggttcttggtcatgaactctttgcctatgccaatgtctagaagagyttttccaatgttctagaatttttatggtttcaggtcttagatttaagtctttgatctaccttgagttgatttttgtataaggtgagagatgaggatccag

SEQ ID NO: 75372 - DNA, 201 bp, Homo sapiens
gatctatatatatatatatatatatagatctatatatatatagatcacatatatatatatcacatatatatatatcacattttcttcattcacccattaaytgatgggcatttggggtggttccatatttttgcaattgtgaatcatggtgctgtaaacatgtgtgtgcaagtgtctttttcatacaatggcttttttcct

SEQ ID NO: 75373 - DNA, 201 bp, Homo sapiens
ctgaaattggaggaagccggtcccccgatggaagatattatttgcaaggggagatgggcaagaggagcacagtagctttcgggaattgaccagggacaggygcccagggacacacaaggcccagaagatgcttgtaagaagccagggagactgaaggcatcaactggatgtataagagagctgctgtgcactgattgtgtg

SEQ ID NO: 75374 - DNA, 201 bp, Homo sapiens
ttttccatttgtatggaatatctttttccactcctttaccttaagtttttgtgagtccttacacattagatgactcttgaagactgaagatacttggttgstgaatttttatccttcctgccattctgtatcttttaagtggagagtgttaatattgagatgtgaagtactgttctatttctcatgctagttgttgcctga

SEQ ID NO: 75375 - DNA, 201 bp, Homo sapiens
gtgacttggacaagttactttacctctggggtcagttccctactatggaaaataagttcttctacatgggggtgtgaagattcaatgagtaagtttagcayatagtaagtgcccaataaatattatcttactgtattcagcattaccattatcatagacggatgttaagtcttcagggacaagggaaacaacctatatcgt

SEQ ID NO: 75376 - DNA, 201 bp, Homo sapiens
gagcacagtagctttcgggaattgaccagggacaggtgcccagggacacacaaggcccagaagatgcttgtaagaagccagggagactgaaggcatcaacyggatgtataagagagctgctgtgcactgattgtgtgtatcaggagtgaagaatccatcctctacacgaaaaagaaagcttacaacaaacatgtcctctac

SEQ ID NO: 75377 - DNA, 201 bp, Homo sapiens
tgtgggtgcagatacctcagcttctgatcctgacaagtgttagtccagagattgttcactccactcggggtactgccctaacctgtaacatgagtacaggmgacaagcaggaaagagaatgactctgactggatatggtttgtaatttgtaatgttaactgctcagtgactctgagggtaggatttatgtgctctgggtct

SEQ ID NO: 75378 - DNA, 201 bp, Homo sapiens
cattcctagaataaatctaaaattggtcaaaacgtattgtttttataatgtactgttggattcagtgacatggctaaaattagtccacaatcctgttctcytgtactattcttagctggctctggaaatataaatgaaccaacctcataaaatgatctcaaaaattctgttccattctatgttctagaatcacacgtgtaa

SEQ ID NO: 75379 - DNA, 201 bp, Homo sapiens
actgttctgtttctgtcttatgtgtgtcattagtgtgtttgagatgccccctctcctctttcctggaagttttctcctgtctcttgtcttttatgaacccrcttcctctctgttttcctaccaatttctagtcctctgcttttcagcctctttcttcatgtctgtgtttgtctggatgcaggagcacacactcagatccct

SEQ ID NO: 75380 - DNA, 201 bp, Homo sapiens
cacagaaaggactcatatcctcctgcaacccaccccacaaggaaatcaaagcaggaatattacctgtttatgcagatcctcgttgaactgaaatgaaagasgaaaggttatataatcagccattgaaaccacctcagataattagagaaacatttccatcccaccaaattccattgcccatcactcaatggacgctccgca

SEQ ID NO: 75381 - DNA, 201 bp, Homo sapiens
tgctcctctcagggtggcaactaatgacttttatacaactcaagccagtggtcactgttctgtttctgtcttatgtgtgtcattagtgtgtttgagatgcmccctctcctctttcctggaagttttctcctgtctcttgtcttttatgaacccacttcctctctgttttcctaccaatttctagtcctctgcttttcagcc

SEQ ID NO: 75382 - DNA, 201 bp, Homo sapiens
gtttcctgtgaagccaaaagggaaaataagacagataaagggtccttatttactatatactgtcttccttagcttattatgtgacagctgaaattactacrcaaaaacaagtcagcagcattttcctttatagtttttgaggaaatgaggctgatcagggataaagatgttttaaaaagaaaaaatgattgtgtcctattc

SEQ ID NO: 75383 - DNA, 201 bp, Homo sapiens
ctagttttgccctctgccttgtgatcttttactgccctctgaagcatgtgatccctgtgacccattccctattcatagacccccaccccttttgaaatccrtaataaaaacttgctggttttgcggctcaggtgggcatcatggaacctgctgacatgtgatatcacccccggagacccagctgtaaatttctctcttttg

SEQ ID NO: 75384 - DNA, 201 bp, Homo sapiens
gctctttccccagtggggagtcatttctgtctgtatgaaaattaagacaggaggcctaggctggtggatgaatgcagacttagacgacaaatgacgtctaytggatgcattcaaaagtccaagccgtatttggttaaggagtatttgtgatggcacacaaagaaaatggttaaagtgtattagattatatttatgatttta

SEQ ID NO: 75385 - DNA, 201 bp, Homo sapiens
ctttgcttcccatgacaatttctttgatattctctactctattttagttttctatttcttcctgtagttttgacctttatatctttctagaaacgtatcckttttatctaaattttcaaatttatatgtatagagttggtcgtaagattttgcattttaaaatgtgtataaatgtcatttacccttttcgttctgaatctc

SEQ ID NO: 75386 - DNA, 201 bp, Homo sapiens
ccatctgctgtcctcctcaccccatgttcctgccctggcctacgccttcattacttcccaccagagggcttaaaagtgctactggtcttgccttgagtccmgcctcctccagcccatccttcctacaggtgccccatccaaacacaaatctgaccgtgttactctcctgcttaagatacttcacaacttcctatgtcctgt

SEQ ID NO: 75387 - DNA, 201 bp, Homo sapiens
acatttgaagtgtggaatttgcttcaaaatgtgccaacctttagttttcagattttgtaaatataataaatacaaagtaacctaagctgaaccaattacakctgtgtagcccagtctatacaccatgtatttttctttttcctttgggattcatttctgtaggtgagtaatcctctagaccctaaactcagtgggggaccc

SEQ ID NO: 75388 - DNA, 201 bp, Homo sapiens
gagatggtctggcctctaccagagtttattcacacctttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcac

SEQ ID NO: 75389 - DNA, 201 bp, Homo sapiens
tgctaacgaaacacagcaaatgcttttcctaaggcacaatagtcttttcagtgagctcaggaaccctgtgggggtaaaagacaagttatcccaggttgccrgcctccttcctgtaagtccaggagagaaaaattatggtgagaggatgcgtctcaggctgataaataacagagttgatctctgcttccttcagcaatggag

SEQ ID NO: 75390 - DNA, 201 bp, Homo sapiens
aattacatctgtgtagcccagtctatacaccatgtatttttctttttcctttgggattcatttctgtaggtgagtaatcctctagaccctaaactcagtgrgggaccctcaccatccgtgtgcggcactgaacctgctgtcacactatgcatctaagtagaggactggttctccccatgctgggctgggaggggaaatcct

SEQ ID NO: 75391 - DNA, 201 bp, Homo sapiens
tttgcattttaaaatgtgtataaatgtcatttacccttttcgttctgaatctcctgtattttccttaggagtcttgccagaggtctcattaaagttttcaytgcctcaaaatttgattttatcttctctatttttatatttcattgaattcagcttttgtccttattatttacatgtattttctttttgctgtttttctgc

SEQ ID NO: 75392 - DNA, 201 bp, Homo sapiens
gagaggatgcgtctcaggctgataaataacagagttgatctctgcttccttcagcaatggagccaagcaatgctctttccccacttgcctgaaggctgacrttgaaagaggggttcatgcctgagattcccttcctggaggagcctcagtgttacaatgcacagaaaggactcatatcctcctgcaacccaccccacaagg

SEQ ID NO: 75393 - DNA, 201 bp, Homo sapiens
aacctcatcagtgattctagttttgccctctgccttgtgatcttttactgccctctgaagcatgtgatccctgtgacccattccctattcatagacccccrccccttttgaaatccataataaaaacttgctggttttgcggctcaggtgggcatcatggaacctgctgacatgtgatatcacccccggagacccagctgt

SEQ ID NO: 75394 - DNA, 201 bp, Homo sapiens
cctgacaagtgttagtccagagattgttcactccactcggggtactgccctaacctgtaacatgagtacaggagacaagcaggaaagagaatgactctgaytggatatggtttgtaatttgtaatgttaactgctcagtgactctgagggtaggatttatgtgctctgggtctgaggatttcataatgatctcgatttgaa

SEQ ID NO: 75395 - DNA, 201 bp, Homo sapiens
gaacctcatcagtgattctagttttgccctctgccttgtgatcttttactgccctctgaagcatgtgatccctgtgacccattccctattcatagaccccyaccccttttgaaatccataataaaaacttgctggttttgcggctcaggtgggcatcatggaacctgctgacatgtgatatcacccccggagacccagctg

SEQ ID NO: 75396 - DNA, 201 bp, Homo sapiens
tggtgagaggatgcgtctcaggctgataaataacagagttgatctctgcttccttcagcaatggagccaagcaatgctctttccccacttgcctgaaggcygacattgaaagaggggttcatgcctgagattcccttcctggaggagcctcagtgttacaatgcacagaaaggactcatatcctcctgcaacccaccccac

SEQ ID NO: 75397 - DNA, 201 bp, Homo sapiens
ggttatataatcagccattgaaaccacctcagataattagagaaacatttccatcccaccaaattccattgcccatcactcaatggacgctccgcaggagyctgagtacttgggacctcatgcatctggctgcattaagatcccagcctgggatccctctctcgctataggtcatgtttgttccccgattatctgatatca

SEQ ID NO: 75398 - DNA, 201 bp, Homo sapiens
tcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaaactgggcaccttgaaaagaacaggataacagcaattttcagggaacaagggagataaccataa

SEQ ID NO: 75399 - DNA, 201 bp, Homo sapiens
ctccttcctgtaagtccaggagagaaaaattatggtgagaggatgcgtctcaggctgataaataacagagttgatctctgcttccttcagcaatggagccragcaatgctctttccccacttgcctgaaggctgacattgaaagaggggttcatgcctgagattcccttcctggaggagcctcagtgttacaatgcacaga

SEQ ID NO: 75400 - DNA, 201 bp, Homo sapiens
acacaaggcccagaagatgcttgtaagaagccagggagactgaaggcatcaactggatgtataagagagctgctgtgcactgattgtgtgtatcaggagtraagaatccatcctctacacgaaaaagaaagcttacaacaaacatgtcctctaccttgaccaaaaggtgtcaatatgagacgcaaaacacataacaatgtt

SEQ ID NO: 75401 - DNA, 201 bp, Homo sapiens
ctttttcatacaatggcttttttcctccagtagtgggattgctggatcaaatggtagatctatttctagttctttaaggcatcgctgtactgttttccatwggttgtactagtttaatttcccaccagtagcatagaagtgttctcttttcatcacacctaccccaacgtctatttttttttttatttttaaattatgacc

SEQ ID NO: 75402 - DNA, 201 bp, Homo sapiens
tcttggcagcagtatccaatttggaagttgaaggtctgtcctggagccagatgctaacgaaacacagcaaatgcttttcctaaggcacaatagtcttttcrgtgagctcaggaaccctgtgggggtaaaagacaagttatcccaggttgccagcctccttcctgtaagtccaggagagaaaaattatggtgagaggatgcg

SEQ ID NO: 75403 - DNA, 201 bp, Homo sapiens
aacgtattgtttttataatgtactgttggattcagtgacatggctaaaattagtccacaatcctgttctcctgtactattcttagctggctctggaaatayaaatgaaccaacctcataaaatgatctcaaaaattctgttccattctatgttctagaatcacacgtgtaagaggcatgatctgctcctggaaatgtggga

SEQ ID NO: 75404 - DNA, 201 bp, Homo sapiens
tatacaccatgtatttttctttttcctttgggattcatttctgtaggtgagtaatcctctagaccctaaactcagtgggggaccctcaccatccgtgtgcrgcactgaacctgctgtcacactatgcatctaagtagaggactggttctccccatgctgggctgggaggggaaatcctcacttagggaccaccaaccatgc

SEQ ID NO: 75405 - DNA, 201 bp, Homo sapiens
tgtcaggtgaacagtctgtggtctctgcagggcctgtaccacccctgggcactgtatgccccacagagtgggcctctcctgtgcagggcctgggaagaggytgattataatctggtgtctgaggcctggcagcaccacactctcttcagtgagtcaggctcaagtctgagcacatctgcagagcttatgtttgctgtgttg

SEQ ID NO: 75406 - DNA, 201 bp, Homo sapiens
gactccagctgtatttacttatatctgtgccagtgacgcccaagtctgtgccttcagccccacctctcctgaaattggaggaagccggtcccccgatggargatattatttgcaaggggagatgggcaagaggagcacagtagctttcgggaattgaccagggacaggtgcccagggacacacaaggcccagaagatgctt

SEQ ID NO: 75407 - DNA, 201 bp, Homo sapiens
ctcatatcctcctgcaacccaccccacaaggaaatcaaagcaggaatattacctgtttatgcagatcctcgttgaactgaaatgaaagacgaaaggttatrtaatcagccattgaaaccacctcagataattagagaaacatttccatcccaccaaattccattgcccatcactcaatggacgctccgcaggagcctgagt

SEQ ID NO: 75408 - DNA, 201 bp, Homo sapiens
cactgaaatacagtcaattcagaagagtgtcatgtgtaacaggccccattatacaatagttaacatatccccattttcatggttctcttctttcctatgtktaaaccaaaatgaacttctttattaactcctactgtctactaaaaccctcagagaaaagtgatgagagatgatttggtgcatatttttaaaggaaaacaa

SEQ ID NO: 75409 - DNA, 201 bp, Homo sapiens
accaaattccattgcccatcactcaatggacgctccgcaggagcctgagtacttgggacctcatgcatctggctgcattaagatcccagcctgggatcccyctctcgctataggtcatgtttgttccccgattatctgatatcagtggcctctagagctttctgacatttcttttctgtcaaacccctcatcgtggaataa

SEQ ID NO: 75410 - DNA, 201 bp, Homo sapiens
ccattgcccatcactcaatggacgctccgcaggagcctgagtacttgggacctcatgcatctggctgcattaagatcccagcctgggatccctctctcgcyataggtcatgtttgttccccgattatctgatatcagtggcctctagagctttctgacatttcttttctgtcaaacccctcatcgtggaataagtgtgaat

SEQ ID NO: 75411 - DNA, 201 bp, Homo sapiens
gctccgcaggagcctgagtacttgggacctcatgcatctggctgcattaagatcccagcctgggatccctctctcgctataggtcatgtttgttccccgaytatctgatatcagtggcctctagagctttctgacatttcttttctgtcaaacccctcatcgtggaataagtgtgaatatgccaggggaaggtaagtcccg

SEQ ID NO: 75412 - DNA, 201 bp, Homo sapiens
agaaactgacttcagagcaacttcttggcagcagtatccaatttggaagttgaaggtctgtcctggagccagatgctaacgaaacacagcaaatgcttttyctaaggcacaatagtcttttcagtgagctcaggaaccctgtgggggtaaaagacaagttatcccaggttgccagcctccttcctgtaagtccaggagaga

SEQ ID NO: 75413 - DNA, 201 bp, Homo sapiens
tgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttgtctgactgggttaattcgaaa

SEQ ID NO: 75414 - DNA, 201 bp, Homo sapiens
atatcctcctgcaacccaccccacaaggaaatcaaagcaggaatattacctgtttatgcagatcctcgttgaactgaaatgaaagacgaaaggttatatawtcagccattgaaaccacctcagataattagagaaacatttccatcccaccaaattccattgcccatcactcaatggacgctccgcaggagcctgagtact

SEQ ID NO: 75415 - DNA, 201 bp, Homo sapiens
ttcttcctcaagaatgccaatcattcttaggtcatttaacataatcccaaatttcttggaggctttgtttatttattaaagttcttttttctttgtctttktctgactgggttaattcgaaaggcttgttgtttgagctatgaagttctttcttctacttgttggatcctattgttgaaactttccagtgcattttgtatt

SEQ ID NO: 75416 - DNA, 201 bp, Homo sapiens
gaggctttgtttatttattaaagttcttttttctttgtctttgtctgactgggttaattcgaaaggcttgttgtttgagctatgaagttctttcttctacytgttggatcctattgttgaaactttccagtgcattttgtatttctctaagtgtgtctttcatttccagaagttggattgtttcttctttatgatatctac

SEQ ID NO: 75417 - DNA, 201 bp, Homo sapiens
tctgaggatttcataatgatctcgatttgaagactttctgctattctcatgacctccttccatcgttgaatccctggattgaaatcatattaattttatgytgcataggtttctcacaagtttcctgtgaagccaaaagggaaaataagacagataaagggtccttatttactatatactgtcttccttagcttattatgt

SEQ ID NO: 75418 - DNA, 201 bp, Homo sapiens
taaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattca

SEQ ID NO: 75419 - DNA, 201 bp, Homo sapiens
ctgtttcctgttaagatgtttatcaatgacaatgtgtgcccagcgggatgtggaacctcatcagtgattctagttttgccctctgccttgtgatcttttaytgccctctgaagcatgtgatccctgtgacccattccctattcatagacccccaccccttttgaaatccataataaaaacttgctggttttgcggctcagg

SEQ ID NO: 75420 - DNA, 201 bp, Homo sapiens
tgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactattt

SEQ ID NO: 75421 - DNA, 201 bp, Homo sapiens
atctttgtaagctgaagatgtatgtcacctcaggaccctgtgatgattgcgttaactgcataaattgtttgtaaagcatgtgtgtttgaacaatatgaaawctgggcaccttgaaaagaacaggataacagcaattttcagggaacaagggagataaccataaggtctgactgcctgcagggccaggcagaacagagtcat

SEQ ID NO: 75422 - DNA, 201 bp, Homo sapiens
atgctaacgaaacacagcaaatgcttttcctaaggcacaatagtcttttcagtgagctcaggaaccctgtgggggtaaaagacaagttatcccaggttgcyagcctccttcctgtaagtccaggagagaaaaattatggtgagaggatgcgtctcaggctgataaataacagagttgatctctgcttccttcagcaatgga

SEQ ID NO: 75423 - DNA, 201 bp, Homo sapiens
agagatattggtctgtagttttcttttttattatgtcctttcctggttttggtattagggcgatcctggcttcatagaataatttagggaggattctctcyttctctgttttggaatagtttcagtaggattggtaccaattctcttctttgaatgtctgattgaattcagctgtgagtccatgtgaatctgtgatttttt

SEQ ID NO: 75424 - DNA, 201 bp, Homo sapiens
catttcaatctttctgctttttattggtctgttcacagtttctatttcttcctgatttattctaggagggttgtatatttccaggaatctgtcttctctargttttctagtttgtgcctgtgaatgtgttcatattagccttgaatgatattttatatttctgtaatatcagtggcattttcttccattttgtttctaatt

SEQ ID NO: 75425 - DNA, 201 bp, Homo sapiens
ttcctacaggtgccccatccaaacacaaatctgaccgtgttactctcctgcttaagatacttcacaacttcctatgtcctgtgggataaaatgcaaacacytgccatcagcacacaaggcaggttacagtgctgcctggcccacatctcccctggcttcagtcacactgaagaactgcagttctccttgcaacttcatgcc

SEQ ID NO: 75426 - DNA, 201 bp, Homo sapiens
gcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggc

SEQ ID NO: 75427 - DNA, 201 bp, Homo sapiens
cttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcatgtgatttagtgattcctgtggcctctcatgtca

SEQ ID NO: 75428 - DNA, 201 bp, Homo sapiens
tcagagcaacttcttggcagcagtatccaatttggaagttgaaggtctgtcctggagccagatgctaacgaaacacagcaaatgcttttcctaaggcacawtagtcttttcagtgagctcaggaaccctgtgggggtaaaagacaagttatcccaggttgccagcctccttcctgtaagtccaggagagaaaaattatggt

SEQ ID NO: 75429 - DNA, 201 bp, Homo sapiens
aaagacgaaaggttatataatcagccattgaaaccacctcagataattagagaaacatttccatcccaccaaattccattgcccatcactcaatggacgcyccgcaggagcctgagtacttgggacctcatgcatctggctgcattaagatcccagcctgggatccctctctcgctataggtcatgtttgttccccgatta

SEQ ID NO: 75430 - DNA, 201 bp, Homo sapiens
ggaagatattatttgcaaggggagatgggcaagaggagcacagtagctttcgggaattgaccagggacaggtgcccagggacacacaaggcccagaagatrcttgtaagaagccagggagactgaaggcatcaactggatgtataagagagctgctgtgcactgattgtgtgtatcaggagtgaagaatccatcctctaca

SEQ ID NO: 75431 - DNA, 201 bp, Homo sapiens
atcagccattgaaaccacctcagataattagagaaacatttccatcccaccaaattccattgcccatcactcaatggacgctccgcaggagcctgagtacytgggacctcatgcatctggctgcattaagatcccagcctgggatccctctctcgctataggtcatgtttgttccccgattatctgatatcagtggcctct

SEQ ID NO: 75432 - DNA, 201 bp, Homo sapiens
ttgcctgaaggctgacattgaaagaggggttcatgcctgagattcccttcctggaggagcctcagtgttacaatgcacagaaaggactcatatcctcctgyaacccaccccacaaggaaatcaaagcaggaatattacctgtttatgcagatcctcgttgaactgaaatgaaagacgaaaggttatataatcagccattga

SEQ ID NO: 75433 - DNA, 201 bp, Homo sapiens
gaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccacaagacaattttgtgaatgttatgtgaatgataata

SEQ ID NO: 75434 - DNA, 201 bp, Homo sapiens
gggaacatggttggaggcccagtgagagaaacagtgctttgaatcaaagagcagaatgatagaaactgacttcagagcaacttcttggcagcagtatccamtttggaagttgaaggtctgtcctggagccagatgctaacgaaacacagcaaatgcttttcctaaggcacaatagtcttttcagtgagctcaggaaccctg

SEQ ID NO: 75435 - DNA, 201 bp, Homo sapiens
cttcttatgtatcaggtaaagctaagatactatcccataggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcattttt

SEQ ID NO: 75436 - DNA, 201 bp, Homo sapiens
gaatcaaagagcagaatgatagaaactgacttcagagcaacttcttggcagcagtatccaatttggaagttgaaggtctgtcctggagccagatgctaacraaacacagcaaatgcttttcctaaggcacaatagtcttttcagtgagctcaggaaccctgtgggggtaaaagacaagttatcccaggttgccagcctcct

SEQ ID NO: 75437 - DNA, 201 bp, Homo sapiens
ggtaaaagacaagttatcccaggttgccagcctccttcctgtaagtccaggagagaaaaattatggtgagaggatgcgtctcaggctgataaataacagarttgatctctgcttccttcagcaatggagccaagcaatgctctttccccacttgcctgaaggctgacattgaaagaggggttcatgcctgagattcccttc

SEQ ID NO: 75438 - DNA, 201 bp, Homo sapiens
agggaacatggttggaggcccagtgagagaaacagtgctttgaatcaaagagcagaatgatagaaactgacttcagagcaacttcttggcagcagtatccwatttggaagttgaaggtctgtcctggagccagatgctaacgaaacacagcaaatgcttttcctaaggcacaatagtcttttcagtgagctcaggaaccct

SEQ ID NO: 75439 - DNA, 201 bp, Homo sapiens
tttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcggagtttgtgcagacgcacagaccctctggggagtatatgtttg

SEQ ID NO: 75440 - DNA, 201 bp, Homo sapiens
gctttgaatcaaagagcagaatgatagaaactgacttcagagcaacttcttggcagcagtatccaatttggaagttgaaggtctgtcctggagccagatgytaacgaaacacagcaaatgcttttcctaaggcacaatagtcttttcagtgagctcaggaaccctgtgggggtaaaagacaagttatcccaggttgccagc

SEQ ID NO: 75441 - DNA, 201 bp, Homo sapiens
aaacagtcatgttgggttttgattatttgtggtgctaagaagaagggaacatggttggaggcccagtgagagaaacagtgctttgaatcaaagagcagaaygatagaaactgacttcagagcaacttcttggcagcagtatccaatttggaagttgaaggtctgtcctggagccagatgctaacgaaacacagcaaatgct

SEQ ID NO: 75442 - DNA, 201 bp, Homo sapiens
tcctgttacctgtttgcttcctgcattctgtgtagcatcctacgtattcacccattctccatcttctccttcatgcagcagaccatgtgtcaacatatgcrgagtttgtgcagacgcacagaccctctggggagtatatgtttgaatttgatgaggaggagcagttctacgtgaacctggatgagaaggagatggtctggc

SEQ ID NO: 75443 - DNA, 201 bp, Homo sapiens
caaaatgaacttctttattaactcctactgtctactaaaaccctcagagaaaagtgatgagagatgatttggtgcatatttttaaaggaaaacaaacagtyatgttgggttttgattatttgtggtgctaagaagaagggaacatggttggaggcccagtgagagaaacagtgctttgaatcaaagagcagaatgatagaa

SEQ ID NO: 75444 - DNA, 201 bp, Homo sapiens
cctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccggatcaatggtccaaacagacttgggccacaaatgg

SEQ ID NO: 75445 - DNA, 201 bp, Homo sapiens
ctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtca

SEQ ID NO: 75446 - DNA, 201 bp, Homo sapiens
accaaaatgaacttctttattaactcctactgtctactaaaaccctcagagaaaagtgatgagagatgatttggtgcatatttttaaaggaaaacaaacastcatgttgggttttgattatttgtggtgctaagaagaagggaacatggttggaggcccagtgagagaaacagtgctttgaatcaaagagcagaatgatag

SEQ ID NO: 75447 - DNA, 201 bp, Homo sapiens
ggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtctt

SEQ ID NO: 75448 - DNA, 201 bp, Homo sapiens
tgtttaaaccaaaatgaacttctttattaactcctactgtctactaaaaccctcagagaaaagtgatgagagatgatttggtgcatatttttaaaggaaarcaaacagtcatgttgggttttgattatttgtggtgctaagaagaagggaacatggttggaggcccagtgagagaaacagtgctttgaatcaaagagcaga

SEQ ID NO: 75449 - DNA, 201 bp, Homo sapiens
atatttatgattttaaattctgatgttcatttaacttcttaatggtaatgataaaacatgctctcagtaaggtatatgttgaattagtgctgtgggaataygggtcctatcaggcagatttgcagtctgctcaccattgaatagttaagaatagtggtctgagacataaatggatgagggcactaaacttgatttgggggc

SEQ ID NO: 75450 - DNA, 201 bp, Homo sapiens
agtgctttgaatcaaagagcagaatgatagaaactgacttcagagcaacttcttggcagcagtatccaatttggaagttgaaggtctgtcctggagccagrtgctaacgaaacacagcaaatgcttttcctaaggcacaatagtcttttcagtgagctcaggaaccctgtgggggtaaaagacaagttatcccaggttgcc

SEQ ID NO: 75451 - DNA, 201 bp, Homo sapiens
catggttctcttctttcctatgtttaaaccaaaatgaacttctttattaactcctactgtctactaaaaccctcagagaaaagtgatgagagatgatttgrtgcatatttttaaaggaaaacaaacagtcatgttgggttttgattatttgtggtgctaagaagaagggaacatggttggaggcccagtgagagaaacagt

SEQ ID NO: 75452 - DNA, 201 bp, Homo sapiens
aggatttttgcatctattttcatcagagatattggtctgtagttttcttttttattatgtcctttcctggttttggtattagggcgatcctggcttcataraataatttagggaggattctctccttctctgttttggaatagtttcagtaggattggtaccaattctcttctttgaatgtctgattgaattcagctgtga

SEQ ID NO: 75453 - DNA, 201 bp, Homo sapiens
agatgcttgtaagaagccagggagactgaaggcatcaactggatgtataagagagctgctgtgcactgattgtgtgtatcaggagtgaagaatccatcctytacacgaaaaagaaagcttacaacaaacatgtcctctaccttgaccaaaaggtgtcaatatgagacgcaaaacacataacaatgttggattgttaagaaa

SEQ ID NO: 75454 - DNA, 201 bp, Homo sapiens
gaaacagtgctttgaatcaaagagcagaatgatagaaactgacttcagagcaacttcttggcagcagtatccaatttggaagttgaaggtctgtcctggarccagatgctaacgaaacacagcaaatgcttttcctaaggcacaatagtcttttcagtgagctcaggaaccctgtgggggtaaaagacaagttatcccagg

SEQ ID NO: 75455 - DNA, 201 bp, Homo sapiens
ccattttcatggttctcttctttcctatgtttaaaccaaaatgaacttctttattaactcctactgtctactaaaaccctcagagaaaagtgatgagagaygatttggtgcatatttttaaaggaaaacaaacagtcatgttgggttttgattatttgtggtgctaagaagaagggaacatggttggaggcccagtgagag

SEQ ID NO: 75456 - DNA, 201 bp, Homo sapiens
gaggcccagtgagagaaacagtgctttgaatcaaagagcagaatgatagaaactgacttcagagcaacttcttggcagcagtatccaatttggaagttgarggtctgtcctggagccagatgctaacgaaacacagcaaatgcttttcctaaggcacaatagtcttttcagtgagctcaggaaccctgtgggggtaaaaga

SEQ ID NO: 75457 - DNA, 201 bp, Homo sapiens
ggcactaaacttgatttgggggcagctcactgaaatacagtcaattcagaagagtgtcatgtgtaacaggccccattatacaatagttaacatatccccaytttcatggttctcttctttcctatgtttaaaccaaaatgaacttctttattaactcctactgtctactaaaaccctcagagaaaagtgatgagagatgat

SEQ ID NO: 75458 - DNA, 201 bp, Homo sapiens
aacatatccccattttcatggttctcttctttcctatgtttaaaccaaaatgaacttctttattaactcctactgtctactaaaaccctcagagaaaagtratgagagatgatttggtgcatatttttaaaggaaaacaaacagtcatgttgggttttgattatttgtggtgctaagaagaagggaacatggttggaggcc

SEQ ID NO: 75459 - DNA, 201 bp, Homo sapiens
ttttcagggaacaagggagataaccataaggtctgactgcctgcagggccaggcagaacagagtcatatttctcttcttgcaaaagcaaataggagaaatrtcgctgaattcttttgtcagcaaggaatagccctgggaaaagaatgcattcccgggggaggtctctaaaatggccactctgggagtgtctgaattacatg

SEQ ID NO: 75460 - DNA, 201 bp, Homo sapiens
ttccagcctggcaaattctagtcatactggttctctgctctcgaaccctgtttcctgttaagatgtttatcaatgacaatgtgtgcccagcgggatgtggmacctcatcagtgattctagttttgccctctgccttgtgatcttttactgccctctgaagcatgtgatccctgtgacccattccctattcatagaccccca

SEQ ID NO: 75461 - DNA, 201 bp, Homo sapiens
agtgccctcaggcttgctaggattaggaaattccagcctggcaaattctagtcatactggttctctgctctcgaaccctgtttcctgttaagatgtttatyaatgacaatgtgtgcccagcgggatgtggaacctcatcagtgattctagttttgccctctgccttgtgatcttttactgccctctgaagcatgtgatccc

SEQ ID NO: 75462 - DNA, 201 bp, Homo sapiens
agcttgtattttgttgaggatttttgcatctattttcatcagagatattggtctgtagttttcttttttattatgtcctttcctggttttggtattagggygatcctggcttcatagaataatttagggaggattctctccttctctgttttggaatagtttcagtaggattggtaccaattctcttctttgaatgtctga

SEQ ID NO: 75463 - DNA, 201 bp, Homo sapiens
cctgcagtgccctcaggcttgctaggattaggaaattccagcctggcaaattctagtcatactggttctctgctctcgaaccctgtttcctgttaagatgyttatcaatgacaatgtgtgcccagcgggatgtggaacctcatcagtgattctagttttgccctctgccttgtgatcttttactgccctctgaagcatgtg

SEQ ID NO: 75464 - DNA, 201 bp, Homo sapiens
gagcctgagtacttgggacctcatgcatctggctgcattaagatcccagcctgggatccctctctcgctataggtcatgtttgttccccgattatctgatwtcagtggcctctagagctttctgacatttcttttctgtcaaacccctcatcgtggaataagtgtgaatatgccaggggaaggtaagtcccgctcaccctg

SEQ ID NO: 75465 - DNA, 201 bp, Homo sapiens
attaactgaatgaaaattaacatttgaagtgtggaatttgcttcaaaatgtgccaacctttagttttcagattttgtaaatataataaatacaaagtaacmtaagctgaaccaattacatctgtgtagcccagtctatacaccatgtatttttctttttcctttgggattcatttctgtaggtgagtaatcctctagaccc

SEQ ID NO: 75466 - DNA, 201 bp, Homo sapiens
gaaggtctgtcctggagccagatgctaacgaaacacagcaaatgcttttcctaaggcacaatagtcttttcagtgagctcaggaaccctgtgggggtaaargacaagttatcccaggttgccagcctccttcctgtaagtccaggagagaaaaattatggtgagaggatgcgtctcaggctgataaataacagagttgatc

SEQ ID NO: 75467 - DNA, 201 bp, Homo sapiens
atgaaagacgaaaggttatataatcagccattgaaaccacctcagataattagagaaacatttccatcccaccaaattccattgcccatcactcaatggaygctccgcaggagcctgagtacttgggacctcatgcatctggctgcattaagatcccagcctgggatccctctctcgctataggtcatgtttgttccccga

SEQ ID NO: 75468 - DNA, 201 bp, Homo sapiens
tcagcaatggagccaagcaatgctctttccccacttgcctgaaggctgacattgaaagaggggttcatgcctgagattcccttcctggaggagcctcagtrttacaatgcacagaaaggactcatatcctcctgcaacccaccccacaaggaaatcaaagcaggaatattacctgtttatgcagatcctcgttgaactgaa

SEQ ID NO: 75469 - DNA, 201 bp, Homo sapiens
gagatttatgctttaaggaggttctattttggtgtattttggagttttgtttgaagacttagaactccttttagcattttgtgtagtgctggattggtagyggtgaagtctctcagcatttgtttgtctgaaaaagactttatctctccttcatttatgacgcttagttttgctggatacaaaattcttgcctggaaatta

SEQ ID NO: 75470 - DNA, 201 bp, Homo sapiens
ttgtatttgtgctctttcagactttttgatataggcatttaatgctatgaactttcctcttaggactgtttttactgtgtccgagtggttttcacaagttrtgtcactattatcattcagttcagagaattttgcatcttgatttcactgttgacccaaagatcattcaggagcaaattatttaatttccatgtatttgta

SEQ ID NO: 75471 - DNA, 201 bp, Homo sapiens
cttctctcaatcacttaattatcacctttgcaggcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcatt

SEQ ID NO: 75472 - DNA, 201 bp, Homo sapiens
ttgaagtcaggtaatgtgatgctccagatttattcgttttgcttaatcttactttggctatgtgggctcttttgtagttccatatgaattttaggattgtktttttctagctctgtaaagaatgatgatggcattttgatggggattgcattgaatttgtagattgcttttggcagtatggtcattttcacaatgttgatt

SEQ ID NO: 75473 - DNA, 201 bp, Homo sapiens
tcatggtttcgaatacccaacacctcccacatccaaggccagcccctgctctctgtaccttataactctgtcttcccttggtgccccagaggtccatgaamtaatccaggtgcctgagaccatggagatgctggtctgtgccctcggcctgctggtgggcctggcgggggtccttaatggcaccattgtctcaaagaccaa

SEQ ID NO: 75474 - DNA, 201 bp, Homo sapiens
cctgctctctgtaccttataactctgtcttcccttggtgccccagaggtccatgaactaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcat

SEQ ID NO: 75475 - DNA, 201 bp, Homo sapiens
gatgggcaagaggagcacagtagctttcgggaattgaccagggacaggtgcccagggacacacaaggcccagaagatgcttgtaagaagccagggagactkaaggcatcaactggatgtataagagagctgctgtgcactgattgtgtgtatcaggagtgaagaatccatcctctacacgaaaaagaaagcttacaacaaa

SEQ ID NO: 75476 - DNA, 201 bp, Homo sapiens
tccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgaggg

SEQ ID NO: 75477 - DNA, 201 bp, Homo sapiens
attttcacaatgttgattctacccttccatgagcatgggacgtggttctacttgttagtgtcatctataatttctttcggcagtgtttttaattttcctcrtacaggtgtttaacctctattgcgggaagtcagggaccctgaatggagggaccggctgaagccacagtggaagaacataaattgtgaagatttcatggac

SEQ ID NO: 75478 - DNA, 201 bp, Homo sapiens
tttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgct

SEQ ID NO: 75479 - DNA, 201 bp, Homo sapiens
gttggaggcccagtgagagaaacagtgctttgaatcaaagagcagaatgatagaaactgacttcagagcaacttcttggcagcagtatccaatttggaagytgaaggtctgtcctggagccagatgctaacgaaacacagcaaatgcttttcctaaggcacaatagtcttttcagtgagctcaggaaccctgtgggggtaa

SEQ ID NO: 75480 - DNA, 201 bp, Homo sapiens
aacatggttggaggcccagtgagagaaacagtgctttgaatcaaagagcagaatgatagaaactgacttcagagcaacttcttggcagcagtatccaattkggaagttgaaggtctgtcctggagccagatgctaacgaaacacagcaaatgcttttcctaaggcacaatagtcttttcagtgagctcaggaaccctgtgg

SEQ ID NO: 75481 - DNA, 201 bp, Homo sapiens
ggagtccactaatgtgttaaccacattatatattttctgacactgaagaatcattgcattcctagaataaatctaaaattggtcaaaacgtattgtttttrtaatgtactgttggattcagtgacatggctaaaattagtccacaatcctgttctcctgtactattcttagctggctctggaaatataaatgaaccaacct

SEQ ID NO: 75482 - DNA, 201 bp, Homo sapiens
agaaaaaaaaaaagaccagtgtttgaaaaagagtgctacatgtattgctttgctctttccccagtggggagtcatttctgtctgtatgaaaattaagacargaggcctaggctggtggatgaatgcagacttagacgacaaatgacgtctattggatgcattcaaaagtccaagccgtatttggttaaggagtatttgtga

SEQ ID NO: 75483 - DNA, 201 bp, Homo sapiens
gattggttgtccttgtgtgtggcttctctttcctgactccctgactcagtccagcctctctgcagactccagctgtatttacttatatctgtgccagtgaygcccaagtctgtgccttcagccccacctctcctgaaattggaggaagccggtcccccgatggaagatattatttgcaaggggagatgggcaagaggagca

SEQ ID NO: 75484 - DNA, 201 bp, Homo sapiens
agaaaaattatggtgagaggatgcgtctcaggctgataaataacagagttgatctctgcttccttcagcaatggagccaagcaatgctctttccccacttrcctgaaggctgacattgaaagaggggttcatgcctgagattcccttcctggaggagcctcagtgttacaatgcacagaaaggactcatatcctcctgcaa

SEQ ID NO: 75485 - DNA, 201 bp, Homo sapiens
ggtgcttccttccccattccctccagcacgggcggggggaggggacgctgagcggatgaatttatagacaccatccccctcgccttggcatgaaaagcggmaatggggtggacagcgtcaatgtctaacaggtgtttgtttcatatgggtctaaaactaatgcttttctcaagaccccgcaactcagcctggaccagtttc

SEQ ID NO: 75486 - DNA, 201 bp, Homo sapiens
tcacttgtcctcgacgctcgcctccgctcacagcctcagcatcccaggctgcgaggcatgcgcagtgggtgcttccttccccattccctccagcacgggcsgggggaggggacgctgagcggatgaatttatagacaccatccccctcgccttggcatgaaaagcggcaatggggtggacagcgtcaatgtctaacaggtg

SEQ ID NO: 75487 - DNA, 201 bp, Homo sapiens
tgagggatggaggggagcccatcagggctcagggattggatggaggtgatgggggcaggggatgggtctcaccctcccttcttcctgggccctcagatcgwgtgttccagtatctctgattatgcggtgaagatcgtcaaagccaacaagttagaccacggtgagcccagaaagaggatgggtttgtgggagtggaggggg

SEQ ID NO: 75488 - DNA, 201 bp, Homo sapiens
ggaggcggagcttgcagtgagccaagatggcgccactgcactccagcctgggcgacagagcgagactccgtctcaaaaaaaaataaaataaaataaataawtaaataaataaataaataaataaataaataataaagacagaatcctgcttttatggagttctcattcgagttgggggagaaggcaataaaacagatgagc

SEQ ID NO: 75489 - DNA, 201 bp, Homo sapiens
ccgtggctcacttctgggatccacagccccacctgctgagaacctctgctcacttctttcacccaagaggggaactgggccccccaaaaactacccacttycagtttctagaactccatatccttcccttatggtgaaattatcatttcttcctttcatctccagcttcttttgtagttgttgtttctgagacacagtctc

SEQ ID NO: 75490 - DNA, 201 bp, Homo sapiens; identical to SEQ ID NO: 45982

SEQ ID NO: 75491 - DNA, 201 bp, Homo sapiens
aatcacgcctgggcactgcgggctcacggctttaatcccagcactttgggaggctgaggcaggaggatcacttgagcccaggacttggacaccagcctggrcaacatagggagaccccatctctattaaaaaaataaagacaggtcgggcacggtggctcatgcctgtaatcccaacactttgggaggctgagacggacgg

SEQ ID NO: 75492 - DNA, 201 bp, Homo sapiens
aggccccagcgggacgggtgcagctcgcgtgggctggggtccaggtagaagacgaaaaccacgctcaatttttcccacagacgggacttactgtgggggcktagctgcaaggtgttagaaagccacagcccaagccaggtgtgacagaccctggagggagatggtgcgatgtgggggaggtcgtaggaacaggaaatccgt

SEQ ID NO: 75493 - DNA, 201 bp, Homo sapiens
gagaaggcaataaaacagatgagcaaaacagaaggcaataaaacagatgagcaaaatatagggtatggtgacattctatagtgtcatctgatattgatggkgacacatgctatggtgaatgataaatcgggtagagaagagtgatgtgggggtgttgcagttaaataagggggtggcaggccaggtgcggtggctcacgcc

SEQ ID NO: 75494 - DNA, 201 bp, Homo sapiens
ggacttactgtgggggcttagctgcaaggtgttagaaagccacagcccaagccaggtgtgacagaccctggagggagatggtgcgatgtgggggaggtcgyaggaacaggaaatccgtagcggcgcaatagcccaggtccttaggccccagcaggcctccccgggagaggtgaggtgacggagaggtggatgaagcatacg

SEQ ID NO: 75495 - DNA, 201 bp, Homo sapiens
acgtttctgggtgaggagcggtgctggtcggtttccttccggggatccaggtttctgcttccgggatgtctgaggctcacttccggcatttcagctggttyatttctgggagactatcacccctttttccgagaattttgatgtctgctcccaggacccctttagcaatttctccgtggctcacttctgggatccacagcc

SEQ ID NO: 75496 - DNA, 201 bp, Homo sapiens
ctccaaagctcaatgacagggaggtgactcgcggatagcagtcccatcagctgtcatgggggtgggcattccgacagagggaacgcaagggtggggttggsgggggcagcaggccgaggccggctgacccgcccgcgcccccaggccccgagtccccgtacacgcactggaagcagacggtgttctacatggaggactacc

SEQ ID NO: 75497 - DNA, 201 bp, Homo sapiens
ggcgctcctcagtgtgtttggggtctccctcgctccacgccctccagggggccgcatgtgcacttgccctgcattgcctggcccccgaggttccagggtcycaactgtctactaaccggcttcccgacagggtgagggtgaggtcgcatctacaaccagagccagcgcttccccgccgccaccccttttcttggaatcccg

SEQ ID NO: 75498 - DNA, 201 bp, Homo sapiens
ggggggcttaaatgttggggaaggggtggaacctgttttcccacgcatgcgcactgcttcccctggccgcaggccgcccccctgcccctctgctgcgcacyccctagggtcgcctcgccaagccgttgccttggagaccgaggttagcctgaatctctgcaggggcctcgcgccgaaggctggggtgggagagcgcatgcg

SEQ ID NO: 75499 - DNA, 201 bp, Homo sapiens
tccatgtttcataaccggcacctcttcaaggacaaggtggtgctggacgtcggctcgggcaccggcatcctctgcatgtttgctgccaaggccggggcccrcaaggtcatcggggtgagtctccagggtggccaggcggggccgggcctgagggatggaggggagcccatcagggctcagggattggatggaggtgatggg

SEQ ID NO: 75500 - DNA, 201 bp, Homo sapiens; identical to SEQ ID NO: 45993

SEQ ID NO: 75501 - DNA, 201 bp, Homo sapiens
tgaagcaggagaatggcgtgaacccgggaggcggaggttgcagtgagctgagatcacgccactgcactccagcctgggtgacagagcaagactccgtctcmaaaaaaaaaaaaaaaaaaaagtaacatcacctgatacccagtccacataaaatttctgctcctgcctcaaaaatgtccagaacgatgtatgaattttaaa

SEQ ID NO: 75502 - DNA, 201 bp, Homo sapiens
ctgcagaagagcacggggccaggctgggctccgagatgtgcctgaggtcccagctactcgggaggatcacttgggcctgggagttcaaggctgcagtgagytgtgatcacatcactgcactccagctttggtgacaatgttttgttttgttttttccttttgtttttttttacttctgagaccctgtttaaaaaaaaaaaa

SEQ ID NO: 75503 - DNA, 201 bp, Homo sapiens; identical to SEQ ID NO: 45998

SEQ ID NO: 75504 - DNA, 201 bp, Homo sapiens
ccgggaggcggagcttgcagtgagccaagatggcgccactgcactccagcctgggcgacagagcgagactccgtctcaaaaaaaaataaaataaaataaawaaataaataaataaataaataaataaataaataataaagacagaatcctgcttttatggagttctcattcgagttgggggagaaggcaataaaacagatg

SEQ ID NO: 75505 - DNA, 201 bp, Homo sapiens
gaggccatcacctggccctggcatgggactttggggcccagaatgttggcctgaggtctcagagcctgatctgccagccagaggtggtgctagaggcccasgaaagacacttcgtcctttaaatatctttgtgagcgctgctgtgtgagaaccatgcttggcacttggcttctggcggaggaaacacccaaagctggcagc

SEQ ID NO: 75506 - DNA, 201 bp, Homo sapiens
cacggcgtctctgtgccattcttgccctaggagatgctgaaggacgaggtgcgcaccctcacttaccgcaactccatgtttcataaccggcacctcttcawggacaaggtggtgctggacgtcggctcgggcaccggcatcctctgcatgtttgctgccaaggccggggcccgcaaggtcatcggggtgagtctccagggt

SEQ ID NO: 75507 - DNA, 201 bp, Homo sapiens
gccaggctaatctcgatctcctgacctcaagtgatctgcctcccaaagcgcttgggttacaggaatgagccaccgcgcccggcccaaactcctgctctgtycctgttctggaatgcgcatgcccaatgtgtaaccagcacccatgtctgtcccagggtttctggttctagaactcttgcactgtctccatacagggactcc

SEQ ID NO: 75508 - DNA, 201 bp, Homo sapiens; identical to SEQ ID NO: 46001

SEQ ID NO: 75509 - DNA, 201 bp, Homo sapiens
aacatgttggccaggctaatctcgatctcctgacctcaagtgatctgcctcccaaagcgcttgggttacaggaatgagccaccgcgcccggcccaaactcytgctctgtccctgttctggaatgcgcatgcccaatgtgtaaccagcacccatgtctgtcccagggtttctggttctagaactcttgcactgtctccatac

SEQ ID NO: 75510 - DNA, 201 bp, Homo sapiens
tggacgccgtggctcgaagggggcggggatagaacgcggggattggaaggaggcggggataaaacccgggacctgaatacccggctagggacacgagagasaggaatcggggtttctgggtgacggtgatctcggggtgggcaggactccaaaggcccgtcgacccggtggtggactccttgcactgggattggacatatg

SEQ ID NO: 75511 - DNA, 201 bp, Homo sapiens
cagagtctcactctgttgcccagactggaatgcagtggggtgatcttggctcactgcaaccacctcccaggttcaagcgattctcctgcctcagcctcccragtagctgggattacaggcatggattatacgcccagctaatttttgtatttttagtagagacggggtttcaacatgttggccaggctaatctcgatctcc

SEQ ID NO: 75512 - DNA, 201 bp, Homo sapiens
tgggccccccaaaaactacccacttccagtttctagaactccatatccttcccttatggtgaaattatcatttcttcctttcatctccagcttcttttgtrgttgttgtttctgagacacagtctcactctgtcgcccaggctggagtgcagtggcgggatctcagctcactgcaacctccgcctcctgggttcaagcaat

SEQ ID NO: 75513 - DNA, 201 bp, Homo sapiens; identical to SEQ ID NO: 46006

SEQ ID NO: 75514 - DNA, 201 bp, Homo sapiens
gctggcctcccccagtatcgccgctacttccttaactccacctccaacccccctttgcccttccctgtgtctgcccccattttccttcccctcccctcccyagctgtgggctgagctagagacggggtcagagagactggagagatggtaggcgtggctgaggtatcggggtgctcccctggatggtgctctgggggggtc

SEQ ID NO: 75515 - DNA, 201 bp, Homo sapiens
atacccagtccacataaaatttctgctcctgcctcaaaaatgtccagaacgatgtatgaattttaaaactgttagaagggttcatggcttctgctcacgcrgttctctgaactgaagtggggtccccaggctctagcccccgggggaggtgaggtgaggggcaggcctcccgggggctgacgtggccacccttgtccgccc

SEQ ID NO: 75516 - DNA, 201 bp, Homo sapiens; identical to SEQ ID NO: 46008

SEQ ID NO: 75517 - DNA, 201 bp, Homo sapiens
ctcaaaaatgtccagaacgatgtatgaattttaaaactgttagaagggttcatggcttctgctcacgcagttctctgaactgaagtggggtccccaggctstagcccccgggggaggtgaggtgaggggcaggcctcccgggggctgacgtggccacccttgtccgcccgcagtggtgaccatcatcaaggggaaggtgga

SEQ ID NO: 75518 - DNA, 201 bp, Homo sapiens; identical to SEQ ID NO: 46010

SEQ ID NO: 75519 - DNA, 201 bp, Homo sapiens
aggcagctttttgttttctgctcccctttctttttcctcctgagcacttggcaggagctgccatcacctgagatcagggggcttccgggggagctgggggrgcttctcggagacagggtctgggcagagatccagtgtggtgggtctgagcaggcaggaggatggaaggcttggagcctggagtcgccgggagtggtctgg

SEQ ID NO: 75520 - DNA, 201 bp, Homo sapiens; identical to SEQ ID NO: 46011

SEQ ID NO: 75521 - DNA, 201 bp, Homo sapiens; identical to SEQ ID NO: 46012

SEQ ID NO: 75522 - DNA, 201 bp, Homo sapiens
tccgcccgcagtggtgaccatcatcaaggggaaggtggaggaggtggagctcccagtggagaaggtggacatcatcatcagcgagtggatgggctactgcytcttctacgagtccatgctcaacaccgtgctctatgcccgggacaagtggctggtgaggccccagcgggacgggtgcagctcgcgtgggctggggtccag

SEQ ID NO: 75523 - DNA, 201 bp, Homo sapiens; identical to SEQ ID NO: 46013

SEQ ID NO: 75524 - DNA, 201 bp, Homo sapiens; identical to SEQ ID NO: 46015

SEQ ID NO: 75525 - DNA, 201 bp, Homo sapiens; identical to SEQ ID NO: 46016

SEQ ID NO: 75526 - DNA, 201 bp, Homo sapiens; identical to SEQ ID NO: 46017

SEQ ID NO: 75527 - DNA, 201 bp, Homo sapiens
ggtttccttccggggatccaggtttctgcttccgggatgtctgaggctcacttccggcatttcagctggttcatttctgggagactatcacccctttttcygagaattttgatgtctgctcccaggacccctttagcaatttctccgtggctcacttctgggatccacagccccacctgctgagaacctctgctcacttct

SEQ ID NO: 75528 - DNA, 201 bp, Homo sapiens
cgccctctagtgaccggcggtgggactgcgccccggctgctcccgccctaacagcttctgcacacttcagatctgactgaagacactgaaatcccagaacraagctggggtggcattctaaggaattttcttttccccctgaggcctttttcataaaattgtggcaaaatatgcataaaattgccattttttatttttaga

SEQ ID NO: 75529 - DNA, 201 bp, Homo sapiens; identical to SEQ ID NO: 46018

SEQ ID NO: 75530 - DNA, 201 bp, Homo sapiens
gggggcttaaatgttggggaaggggtggaacctgttttcccacgcatgcgcactgcttcccctggccgcaggccgcccccctgcccctctgctgcgcaccycctagggtcgcctcgccaagccgttgccttggagaccgaggttagcctgaatctctgcaggggcctcgcgccgaaggctggggtgggagagcgcatgcgt

SEQ ID NO: 75531 - DNA, 201 bp, Homo sapiens
gtttccttccggggatccaggtttctgcttccgggatgtctgaggctcacttccggcatttcagctggttcatttctgggagactatcacccctttttcckagaattttgatgtctgctcccaggacccctttagcaatttctccgtggctcacttctgggatccacagccccacctgctgagaacctctgctcacttctt

SEQ ID NO: 75532 - DNA, 201 bp, Homo sapiens
cagtggagtggggcgcctgcattctaggaggtctggacagagttagggtggcactgccaggtttgggtgttggagaggagggagcaaggaatctgggctcraacccacatggtttattgggagccggataggcaggatgcagagtgaaggaggagccgaggctgggtgccagtgagggagggctagcaggaaggggacagc

SEQ ID NO: 75533 - DNA, 201 bp, Homo sapiens
cagagcgagactccgtctcaaaaaaaaataaaataaaataaataaataaataaataaataaataaataaataaataataaagacagaatcctgcttttatrgagttctcattcgagttgggggagaaggcaataaaacagatgagcaaaacagaaggcaataaaacagatgagcaaaatatagggtatggtgacattctat

SEQ ID NO: 75534 - DNA, 201 bp, Homo sapiens
gcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctg

SEQ ID NO: 75535 - DNA, 201 bp, Homo sapiens
acgccctggtggcctacttcaacatcgagttcacacgctgccacaagaggaccggcttctccaccagtgaggcggggcccacagggctgggggccgttccygagccagggcggaggcgcacccacgtagtggagggggtgacagaaacgggcagaaggaaccatggggacacgcgtgttccagtgtgagctctgccatgta

SEQ ID NO: 75536 - DNA, 201 bp, Homo sapiens
gaacccggttttctcccacgctccctctccaggcgaggccagcaccaggtcccccagcaccgcgggcacgtctgctacctgggcgtatgccggacccaccrcctggcggagatcatatactggattcgctgtctccaccaaggagccctcggggaaggccagccacgagccccaggacccctacagctatgggcgccgccg

SEQ ID NO: 75537 - DNA, 201 bp, Homo sapiens
ctctcctcaggtccctcctcttacttctgactctcctcatcaagaaataacctctatccccacaggctggaatccctcatttgttacctagggcaccaggmaatcaccttttacccactaagtgaaccaaccagaccaaaatagcaatgcaaaggctttgaaaactatattgtcagctgagcacggtggctcatgcctgta

SEQ ID NO: 75538 - DNA, 201 bp, Homo sapiens
agaaatactaactcaagtaaaatggtgtaaagcttttgtaccttttataaactaaataatggatgcacacaggacaatattcaataattggactattctgktctatgagttgtaagaagcagcatcatattgcaaagtccagaaagctcacttcaaagacctctggaacactttggctcttttttctctctcttctttttg

SEQ ID NO: 75539 - DNA, 201 bp, Homo sapiens
gtggattaaaagcttaaaagactactcatgaaacaaaaaaaaaagatccatatgtaccatttcatatataaaacaatttgcgagaactctgatttttttttcttattcaaaaaacctctaatttcttttttttttaatctctactttgcaaaacttagagagataattaaattttcacagggcaaagagtggggaggtgag

SEQ ID NO: 75540 - DNA, 201 bp, Homo sapiens
aatcctgactctgttactgaatgatatctagcaagacactgtcaccttttacctgccctgcttatctcatagctttttattaaaatttgagataatagatrctcaccaagttaacccactaatttccactttgtatttgggacaaagtacacttgtcttaaaaggagttggctcaggtggttcctacttgaggtaagtgtt

SEQ ID NO: 75541 - DNA, 201 bp, Homo sapiens
tgggcatcaggagaatccagtcccatttataagtcaccctgacagtgactctgccttcctgaaacatctttccccagtgcatgcacgcgcgcacacgcgcrcacacacacacacacacacacaccccagagcctacgatagtcacatatattggcccatagttctccagtcctttgttgctttctaaaagcagcaaaggat

SEQ ID NO: 75542 - DNA, 201 bp, Homo sapiens
atgtgggcatcaggagaatccagtcccatttataagtcaccctgacagtgactctgccttcctgaaacatctttccccagtgcatgcacgcgcgcacacgygcacacacacacacacacacacacaccccagagcctacgatagtcacatatattggcccatagttctccagtcctttgttgctttctaaaagcagcaaag

SEQ ID NO: 75543 - DNA, 201 bp, Homo sapiens
ggagagagagagaaagaagagtagaaacacaaaatgagatatggcattactgtatataatcgactgcatatttaagtctttttttttttttttttttttttagacggagtctcgctctgtcaccaggctggagtgcagtggcgcaatcttggctcactacaacctccgactccctggttcaagcgattctcctgcctcagc

SEQ ID NO: 75544 - DNA, 201 bp, Homo sapiens
acttgggtatgttgaaagaatttcacattttaatgtcaaagaaaagaactaatgaaatttgccttgaagttaaaatcatgatctttagattgatttttcaytgataaaagtatatagataataaattcctttaatgtgattctcaggaggaaaaaaaaatcaggaagaaatgtctaggaaaggcataatagaagtctatta

SEQ ID NO: 75545 - DNA, 201 bp, Homo sapiens
ttgaatcaaaaattgtaagtctgtttgatgtgatgttcaatgtatgtagagaagtactcaagacaattgtactttaaaagtgggaagggaaaaaggatctraaaggaagtaaagtttctacacctcacttgacatagtaaaatgtcaataccattagactgtggtaagttatgtatgtgtattatagtacctggagcaacc

SEQ ID NO: 75546 - DNA, 201 bp, Homo sapiens
tggtgacctatgcctgtagtcccagtttctctggaggctggggtgggaagatcatttgggcctgggaggtcaagactgccatgagctgtgatcgtgccackgcactccagcctgggcaacagagcaagacctcatctaaaaaaaatcacataaaagaaattagatggagtagagtctacattttttttaaccatttaactt

SEQ ID NO: 75547 - DNA, 201 bp, Homo sapiens
acagggttacaaggtcaacggaagctattaagtcaagacagatttacagtttactttatctaccttcctgtttcccacctgtaccaccaacaatgttgtayccttccaggaactaatgagaattcactggagtgagaaaaaaaaaaaaattagccaggcatggtgacctatgcctgtagtcccagtttctctggaggctgg

SEQ ID NO: 75548 - DNA, 201 bp, Homo sapiens
ttactattgattttttctttgttttatgatgatcttttgaaaagaatataaaatttcccttagatggctggaaaatataaaacagttttactgaacaaaaycaggaaaattaaatatctcaaaattgtacgaaatgattaaattctgccaacttatttgtaataatattgtggtccttacaaatgatgtaatatttttaac

SEQ ID NO: 75549 - DNA, 201 bp, Homo sapiens
taggaactggccaagtttattaaaatgtctaacatatcctaaattacaagacataattcctatttactttacctcctttgctaccaagcttgcatcttagygtgatttctttctcatgaacttaaatccaactagctaaaagtggcaatctgtttgatcactgaagccagtctctatatttcagctcacgtgctccataaa

SEQ ID NO: 75550 - DNA, 201 bp, Homo sapiens
ctgtgtgcaaaattttcatcagattcttacaatatgggagttatggaccctcaaaagtttaagcataattgaatacaaaaccaaacataatttgaaatcaygttttcacacattaaagtaaaaattaattttaactctggaatttttgtttgtatagtcatttgccccctttttatttttgtttcttactattgatttttt

SEQ ID NO: 75551 - DNA, 201 bp, Homo sapiens
cgggaggctgaggcaggagaatggtgtgaacccgggaggtggagcttgcagtgagccgagatcgcaccactgcactccagcctgggcgacagagcaagacwctgtctaaaaaaaaaagaaagaaagagaaaaacagaaatactaactcaagtaaaatggtgtaaagcttttgtaccttttataaactaaataatggatgca

SEQ ID NO: 75552 - DNA, 201 bp, Homo sapiens
ctactcgggaggctgaggcaggagaatggtgtgaacccgggaggtggagcttgcagtgagccgagatcgcaccactgcactccagcctgggcgacagagcragacactgtctaaaaaaaaaagaaagaaagagaaaaacagaaatactaactcaagtaaaatggtgtaaagcttttgtaccttttataaactaaataatgg

SEQ ID NO: 75553 - DNA, 201 bp, Homo sapiens
agccgggcgtggtggcgggcgcctgtagtcccagctactcgggaggctgaggcaggagaatggtgtgaacccgggaggtggagcttgcagtgagccgagakcgcaccactgcactccagcctgggcgacagagcaagacactgtctaaaaaaaaaagaaagaaagagaaaaacagaaatactaactcaagtaaaatggtgt

SEQ ID NO: 75554 - DNA, 201 bp, Homo sapiens
cttacatttgggataggaattaattaaatgagttaacatgcataaagcacatagaagggtacttggtatttagcaagtgattattactgtattttataaaygcatacacatgttttagtaggtacacatggagataaagaaaaggctaagtatcatgttaaacaaattaagttctggccaggcacagtgatgcacacctgt

SEQ ID NO: 75555 - DNA, 201 bp, Homo sapiens
gaggccaaggcgggtggatcactagttcaggagattgagaccatcctggctaacacggtgaaaccccgtctctactaaaaatacaaaaaattagccgggcrtggtggcgggcgcctgtagtcccagctactcgggaggctgaggcaggagaatggtgtgaacccgggaggtggagcttgcagtgagccgagatcgcaccac

SEQ ID NO: 75556 - DNA, 201 bp, Homo sapiens
gtaatgttttttctctgattgtaaaaagaaatattaggctgggcgcggtggctcacgtctgtaatcccagcactttgggaggccaaggcgggtggatcackagttcaggagattgagaccatcctggctaacacggtgaaaccccgtctctactaaaaatacaaaaaattagccgggcgtggtggcgggcgcctgtagtcc

SEQ ID NO: 75557 - DNA, 201 bp, Homo sapiens
atttttagttactcaggtaatgttttttctctgattgtaaaaagaaatattaggctgggcgcggtggctcacgtctgtaatcccagcactttgggaggccraggcgggtggatcactagttcaggagattgagaccatcctggctaacacggtgaaaccccgtctctactaaaaatacaaaaaattagccgggcgtggtgg

SEQ ID NO: 75558 - DNA, 201 bp, Homo sapiens
agaaggaaaatactctgggatgccattcacaaactattcagttagaatgaggaatggtcttgttaggattttttatttttagttactcaggtaatgttttytctctgattgtaaaaagaaatattaggctgggcgcggtggctcacgtctgtaatcccagcactttgggaggccaaggcgggtggatcactagttcaggag

SEQ ID NO: 75559 - DNA, 201 bp, Homo sapiens
gcagcttgacttctggtatccaggtgccacccaccacgtagctgctaatatgatggtggatttccgagttagtgagaaggaatcccaagccatccagtctkccttggatcaaaataaaatgcactatgagtaagtccttggcaaatattgaaatttgttggatattcaaagttttgggagccttgaagtagaggaaagtat

SEQ ID NO: 75560 - DNA, 201 bp, Homo sapiens
attcatctgtgagtcacatcatgaattaaaaagttaatttcaaagtacatttcttgtagcttcctttgtgtaccaaaattgctagatctaccactgattcycaacccagtgctctttttccatattctacatattctactttttcaaaatttacattctgaaaaagaaaagttaagacttgtagttcataacaccagatct

SEQ ID NO: 75561 - DNA, 201 bp, Homo sapiens
agctactcgggaggctgaggcagaagactcacttgaacctgggaggcagaggttgcagtgagccgagatcgcgccactgcactccagcatgggtgacagarcaagactccatctcaaaaaaaaaaaaaaaaaaaaaaaagaaaatgtgtttttatactttcaaacatttcatagtttgatgtacagagggatcccatttta

SEQ ID NO: 75562 - DNA, 201 bp, Homo sapiens
ataataatggaatctatttcataggggtttcatgaagattgactgggatcgtaaagttgctgtctgcctggtcctttacttctatgaatacacacacacacacacacacacacacacacacacactcacacagaaacagggaataactagaggctatcaccagatgttccattttcctcccagtgaataaatgagtagtat

SEQ ID NO: 75563 - DNA, 201 bp, Homo sapiens
gacacagtgataatcaacacctaatattaatgtctaactgcctaataataatgttcagtcagatacaaattcatattccagggatatacacagtcctatcmagtgtttcaatcaaatcattctaatgtgtcattccattcatttttttcttctgcttcacatttttacgtattacttacctaagagtataacatgcatgtt

SEQ ID NO: 75564 - DNA, 201 bp, Homo sapiens
ttgttcacattttagacagtcaatttttaacattgtcttttctttgatcaaaggttaaaattagaaaataaagagttgttaatgaaaggtaactcagaaamcaactattaatataataagaaaactcaaatggtacaattaagtaaaatcttacgaggatccatataagattatgtgagaaatgcaaaagagatctatgcc

SEQ ID NO: 75565 - DNA, 201 bp, Homo sapiens
ttctgagctcatataccaaatttttgaaattgtcagctagaggaagagaaaggaaaaaaaaaatctgcacctgttaactgtcttcatgccccagacctcaracctatttcacaatcttcacaacacttcccagtggaccctcatttgccccattatttcaggagagaggagtaaaatttaaagagtcctagtaacttgccc

SEQ ID NO: 75566 - DNA, 201 bp, Homo sapiens
tcctaaatgtgtgcacaccaatttcacctatgatgtctatgccaataatttaaacattcatttttccaagctctttcttgaatgtctgattgatgttaaaygtatcactttgtcttcctttgccttttctttttcccatcccaatgctctctgagttcccatttaacagtatgttttttccagctacccagattgaaacat

SEQ ID NO: 75567 - DNA, 201 bp, Homo sapiens
gtctaaatatttagcattccaaactagcttcagaacgtgggaatgtaaatttgtttcattatacatgccatattggaattatatactcattcacacttachcaaatgagaaaggactgaaatatattctaaccctaaaattcatataaatacctctaattccattgagcctttagatggaggagataaaagagataatccc

SEQ ID NO: 75568 - DNA, 201 bp, Homo sapiens
actaaagatcaagggataagcacagtgcctaacctgtaagactccattaaaaaattgcatacatacataattacatattccttggtatttacacagtatcstattatttcactctaactttcctttctctccaggccaaagttgcaaagattggcactgatgttctatcaactcgatatgaaacccgctacatctatggcc

SEQ ID NO: 75569 - DNA, 201 bp, Homo sapiens
ctgtcaccaggctggagtgcagtggcgcaatcttggctcactacaacctccgactccctggttcaagcgattctcctgcctcagcctcccaagtagctgaractacaggcacatggcaccacccccagctaattttttgtatttttagtagagacggggtttcaccatgctagccaggatggtctccatctcctgacctca

SEQ ID NO: 75570 - DNA, 201 bp, Homo sapiens
gtttaaccatttattttattttgatcttcaaatgccaaatacctggtaaatttgacttttttcatccctagtaatttacatatttacatatatatatgtakgggctttggttttgttaaaaccaggaactgaattccggcttcaccagttgcaactaaccaggaaatagtactgtccatctcatagggttgttatgagtct

SEQ ID NO: 75571 - DNA, 201 bp, Homo sapiens
cttgcaaacagaatcgtaggattgactactcaaattttctcataagtaaaataaagttttagtgttttaactttaatatagatactagtcttcacatattyattttcacaattcatatgaagtcaaagaaggaaaatactctgggatgccattcacaaactattcagttagaatgaggaatggtcttgttaggatttttta

SEQ ID NO: 75572 - DNA, 201 bp, Homo sapiens
atgacctgggcatcaaacacacatttgcctttgagctccgagataaaggcaaatttggttttctccttccagaatcccggataaagccaacgtgcagagakaccatgctagctgtcaaatttattgccaagtatatcctcaagcatacttcctaaagaactgccctctgtttggaataagccaattaatccttttttgtgc

SEQ ID NO: 75573 - DNA, 201 bp, Homo sapiens
ttctatttccaaactccttgcaaacagaatcgtaggattgactactcaaattttctcataagtaaaataaagttttagtgttttaactttaatatagataytagtcttcacatatttattttcacaattcatatgaagtcaaagaaggaaaatactctgggatgccattcacaaactattcagttagaatgaggaatggtc

SEQ ID NO: 75574 - DNA, 201 bp, Homo sapiens
gggcatcaaacacacatttgcctttgagctccgagataaaggcaaatttggttttctccttccagaatcccggataaagccaacgtgcagagagaccatgytagctgtcaaatttattgccaagtatatcctcaagcatacttcctaaagaactgccctctgtttggaataagccaattaatccttttttgtgcctttcat

SEQ ID NO: 75575 - DNA, 201 bp, Homo sapiens
cttatgacaaaggagtttcttgctttctacatcaagtaccaaagtgttaaattacctataaaaattggttttatcaaattaaaacatgaattctacaaagyggcccaaatcagccacagttatgggaaagccaaataattagatagttacctccctcagaaatataaatatgtaaagtgataagtgcagacaagaactact

SEQ ID NO: 75576 - DNA, 201 bp, Homo sapiens; identical to SEQ ID NO: 37860

SEQ ID NO: 75577 - DNA, 201 bp, Homo sapiens
ctctttagataatacattggccacacatgtacttggaattttaatatttaagtttcctttctgagtgaaaaataactcacttttttcttttttttttttttgagatggagtctcactctgtcacccaggctggaatgcagtggtgcaatctcgtctcactgcaacctccgcctcctgggttcaagcaattctactacctca

SEQ ID NO: 75578 - DNA, 201 bp, Homo sapiens
gtctaaatccagatcctcaaattagtgtgtttttcactgtgtcttatgacaaaggagtttcttgctttctacatcaagtaccaaagtgttaaattacctayaaaaattggttttatcaaattaaaacatgaattctacaaagcggcccaaatcagccacagttatgggaaagccaaataattagatagttacctccctcag

SEQ ID NO: 75579 - DNA, 201 bp, Homo sapiens
tcctgaaatgattctgattcaactagatgtctaaatccagatcctcaaattagtgtgtttttcactgtgtcttatgacaaaggagtttcttgctttctacrtcaagtaccaaagtgttaaattacctataaaaattggttttatcaaattaaaacatgaattctacaaagcggcccaaatcagccacagttatgggaaagc

SEQ ID NO: 75580 - DNA, 201 bp, Homo sapiens
cttttttctcctttggtcctctaggcctcttctatcctgaaatgattctgattcaactagatgtctaaatccagatcctcaaattagtgtgtttttcactstgtcttatgacaaaggagtttcttgctttctacatcaagtaccaaagtgttaaattacctataaaaattggttttatcaaattaaaacatgaattctaca

SEQ ID NO: 75581 - DNA, 201 bp, Homo sapiens
tcaagtcaataaacaatctgggacatgccccatgaatcctttagggacacataaaagaaaggatggcatcaaagctacaagatgatggtgtgttctgatartcatgaggtagataaaagtttcccatgcaaaattgtccaggaaaagcaaatgtaaactaacaaaattgctttacaaggggagaaggggaaggtgacagag

SEQ ID NO: 75582 - DNA, 201 bp, Homo sapiens
tagataaaagtttcccatgcaaaattgtccaggaaaagcaaatgtaaactaacaaaattgctttacaaggggagaaggggaaggtgacagagtcaagaaastaaaagagaaaaatgtggctatgagattatattgtctgattaaaaatatggtatctatgtctaaatatttagcattccaaactagcttcagaacgtggga

SEQ ID NO: 75583 - DNA, 201 bp, Homo sapiens
tctgattaaaaatatggtatctatgtctaaatatttagcattccaaactagcttcagaacgtgggaatgtaaatttgtttcattatacatgccatattggmattatatactcattcacacttactcaaatgagaaaggactgaaatatattctaaccctaaaattcatataaatacctctaattccattgagcctttagat

SEQ ID NO: 75584 - DNA, 201 bp, Homo sapiens; identical to SEQ ID NO: 37658

SEQ ID NO: 75585 - DNA, 201 bp, Homo sapiens; identical to SEQ ID NO: 37659

SEQ ID NO: 75586 - DNA, 201 bp, Homo sapiens; identical to SEQ ID NO: 37660

SEQ ID NO: 75587 - DNA, 201 bp, Homo sapiens
aattcacgctgtgcacatgtaccctagaacttaaagtataaaaatatatatttataaaaaaaactaattgataccagcttttaacccttttaacttaatayactaagtttttctgtttttataaatcacatcattaaaattagacacttcaaaaatgtaactacaagactgcagaaatttgtattacattatctgtttaca

SEQ ID NO: 75588 - DNA, 201 bp, Homo sapiens
caaaaaacattcttattcacggctttaaagataacattctattatttgtgatggttattgatgactttttcggttttgttactgtttcaagaaggttgtgrcagaaatgtaaaagttaacaaattgaaaatatataattcacgctgtgcacatgtaccctagaacttaaagtataaaaatatatatttataaaaaaaacta

SEQ ID NO: 75589 - DNA, 201 bp, Homo sapiens
ggccatagacaataagtcagcaaatgggtgactatgtgccaataaaacctcattcacagaaacaggaggctgaccaggatttgccaactcccatactttayactaaataatatctgcaaatttttatggagtctttacaagttaggcactgtgcttaccccttgattttcacaatctcaagcttcacaacaaccctatgag

SEQ ID NO: 75590 - DNA, 201 bp, Homo sapiens
tttaattttaattcctctttagataatacattggccacacatgtacttggaattttaatatttaagtttcctttctgagtgaaaaataactcacttttttyttttttttttttttgagatggagtctcactctgtcacccaggctggaatgcagtggtgcaatctcgtctcactgcaacctccgcctcctgggttcaagca

SEQ ID NO: 75591 - DNA, 201 bp, Homo sapiens
ttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtctgaggaggagctcggcactcaattttt

SEQ ID NO: 75592 - DNA, 201 bp, Homo sapiens; identical to SEQ ID NO: 37666

SEQ ID NO: 75593 - DNA, 201 bp, Homo sapiens; identical to SEQ ID NO: 37669

SEQ ID NO: 75594 - DNA, 201 bp, Homo sapiens; identical to SEQ ID NO: 37890

SEQ ID NO: 75595 - DNA, 201 bp, Homo sapiens
cttatttttacttatgcaaataaatgtttccagtaagtcttatgactccaaactgatctttaaatgtcatatcagaggtcccttccccacatttgacacawtggatatgttctttgaccacagaagtgctcattggctaagtgaacattaggcttactgacaagagtatctgtttctcatttaacacaaacatctatgcct

SEQ ID NO: 75596 - DNA, 201 bp, Homo sapiens
aagtaggaaatattttcttaatgttgaacatactcagaatatgctgtcaacaaaaacaaaattatcttatagaactgagtaaagacttggtattggctagwatatagagtggcacataggtagcacagtacaatgattaacaacatgaactctgaagacaccacctgggcttgaatcctgattcgaccatctactagctat

SEQ ID NO: 75597 - DNA, 201 bp, Homo sapiens
gatacaatttttcagaaaacactgtatcaagtaagcaataaatgcagcacacattaagtcaccaacgtcactttatatggatccctttgggctgaaatcasatttctagtttggtacggtttcattttgatttgttctcattgaatttgttgcaaccaatattgtgccttgaaataagtaggaaatattttcttaatgttg

SEQ ID NO: 75598 - DNA, 201 bp, Homo sapiens
agccaagattgtgtcattgcattctcgcctgggtgacagagtgagactccatctcaaaagaaaaaaaaaaatactatattgtcatcagtatcacaagacasaaaagtaggccagggcctgtttactaaacctgaacagggtgattacctgctaaattgaagatttaagttacaatttattatttaatgtaatagctaaaat

SEQ ID NO: 75599 - DNA, 201 bp, Homo sapiens
ctgtcaaacagaatcttgattcatgatctacaagaagagattgagaaacagtttgatgttaaagaagatatcccaggcaggcacagctacgcaaaatacartaattgggaaaaggtacagtaaaaaatgcctgtacttttttttaagttacccttaatatttattgtcattttgttttcttttattctaatttctcaaaat

SEQ ID NO: 75600 - DNA, 201 bp, Homo sapiens; identical to SEQ ID NO: 37585

SEQ ID NO: 75601 - DNA, 201 bp, Homo sapiens
gaccagcctggccaacatggtgaaacccggtctctactaaaaatacaaaaattagctaggtgtggtggtacgcacctgtagtcccagctactcaagaggcygaggcaggagaattgcttgaacctggaaggcagaggttgcagtgagctgaaatcgtaccactccacttcagtctgggcaacaaagtgagactctatctca

SEQ ID NO: 75602 - DNA, 201 bp, Homo sapiens; identical to SEQ ID NO: 37586

SEQ ID NO: 75603 - DNA, 201 bp, Homo sapiens
aatatctaattgttgaggtgcacatctgagatgtacatctctattatgaaaaaatgaaacatcttatttttacttatgcaaataaatgtttccagtaagtsttatgactccaaactgatctttaaatgtcatatcagaggtcccttccccacatttgacacattggatatgttctttgaccacagaagtgctcattggcta

SEQ ID NO: 75604 - DNA, 201 bp, Homo sapiens
atatgtaaatatatatatatcatcattcattttccaattttcttactataaaactcactcaagaggcattgtttcatattttgaaaatgtgttcttttatrgcaatatctaattgttgaggtgcacatctgagatgtacatctctattatgaaaaaatgaaacatcttatttttacttatgcaaataaatgtttccagtaa

SEQ ID NO: 75605 - DNA, 201 bp, Homo sapiens
agaatataatcaaaaatcgcttgtaatactaaaaacaagaaaaattacagcttgaatacaaaaagataatccacagatgccaacactgagatgattgcagyttcaaacattggaaaagaatttcaaagttgccatcattaaaaaaaaaatgcctcaacaaacaattacagatggccttgaaacaaatgaagaaatggaaac

SEQ ID NO: 75606 - DNA, 201 bp, Homo sapiens
gaggatacagtgagccatgatcatgccaccgcactccagccaaggtaacagagcaagaccctgtcacatacacacacacacacacacacacacacacacayacacacacacacacacacaaattctatatttttttctcaaagtaaaaacttgcaatgttgtatttactttatgacttgatatagttttgtttgcaaattt

SEQ ID NO: 75607 - DNA, 201 bp, Homo sapiens
cataaaatattttaaaatttttaagaggttacaattttcattctgacctcagtccattgtatttagcacaacagcatttaatgttaattggagcagagacytgaatcagtcattaaaatcatctccatatatacaacaaagaagacataccagcaatatatggcccatagtcatttattatccaatgtaggtgataatctg

SEQ ID NO: 75608 - DNA, 201 bp, Homo sapiens
tgacctcagtccattgtatttagcacaacagcatttaatgttaattggagcagagacctgaatcagtcattaaaatcatctccatatatacaacaaagaaracataccagcaatatatggcccatagtcatttattatccaatgtaggtgataatctgagggcgtgagttcaattaatgcataccaatgtacagcactgtg

SEQ ID NO: 75609 - DNA, 201 bp, Homo sapiens
aaataggtgaaattactcaaaatttttggaaaaaaagaataagatacattatccagtattaaattttactgtaattaaatatgatttggtttctattaagscataagaaaaaagattaatgaagcaaatagaaaattcccagacaaaataaataaaatacttgcatatatgatgatgacattttttaaaaataaatcttga

SEQ ID NO: 75610 - DNA, 201 bp, Homo sapiens
tgaatggtttagccacatgtcatcactactgacaggtaatcggcccagatctcatgagctactggcgctggcctccttttatatatttgaattttcctgawacataaaaggagaccaaaaaaaaaagtcattggtatgtcagaaatacagcaattggtatgtcattggtatgtcagaagtacagcaattaaaaatatacaa

SEQ ID NO: 75611 - DNA, 201 bp, Homo sapiens
acagtgctgagaaaagtgcctggcacataagaaaggttcagtaaacattaaacatttgtattattcaatactcagtgataattatttatcctttcacctawatttaggaattttcttaaacaaattaagcaaattttggagctcaaaataatatttgagaaaaagtaatttggtttcatttgtttatgcctggctgctggt

SEQ ID NO: 75612 - DNA, 201 bp, Homo sapiens
agcccacatgagcaggcatgaatggtttagccacatgtcatcactactgacaggtaatcggcccagatctcatgagctactggcgctggcctccttttatrtatttgaattttcctgatacataaaaggagaccaaaaaaaaaagtcattggtatgtcagaaatacagcaattggtatgtcattggtatgtcagaagtaca

SEQ ID NO: 75613 - DNA, 201 bp, Homo sapiens
tgtacatcttttctcatgaaaatgtgtttctctcccttttgacctgggtaagtcctacttatttctcaagatccaactcaggcagtgtctcctgcaggacrtctcttctgttcatcaactctcgtgactcagttttggctgctccttgtgctcctggaatacccggttccttcctctggcattggttaacatgtgggaaac

SEQ ID NO: 75614 - DNA, 201 bp, Homo sapiens
tctgaacctcttacttgctccctgaccttgggacacagacttccatgagagttggttgattgggccaactgtgcaccaacctccgaagactaaggagagtrcagatctgacggcaatacccaaggatttcactctcatgatgaaggcactattgtacaatggctcacagctacggtgctgatgtcagaccctccaggttca

SEQ ID NO: 75615 - DNA, 201 bp, Homo sapiens
tagctagcaggctagcactttggagctttcagagataaatgagaggacttaggacacaataaactactcttaaggaagtcacattctaagtggaaggagcrgagagccaaaactaccatagctccatgccatcatgtgtcactttcaaaatggaaagatacagtcaagagggattactattctgtttaactgtgcagcatt

SEQ ID NO: 75616 - DNA, 201 bp, Homo sapiens
ctcttaagattgtggcttggactgaaaagatgatggataagtatcctgaaatggtctctcgtattaaaattggatctactgttgaagataatccactatawgttctgaaggtaaaaataactcaagaaccactaattcttattactgttgaaaaacatgaatttaaaagttactttgtaacacaactaagctaattctgag

SEQ ID NO: 75617 - DNA, 201 bp, Homo sapiens
gagattgagaaacagtttgatgttaaagaagatatcccaggcaggcacagctacgcaaaatacaataattgggaaaaggtacagtaaaaaatgcctgtacwtttttttaagttacccttaatatttattgtcattttgttttcttttattctaatttctcaaaattgattttgctcttaagattgtggcttggactgaaaa

SEQ ID NO: 75618 - DNA, 201 bp, Homo sapiens; identical to SEQ ID NO: 37593

SEQ ID NO: 75619 - DNA, 201 bp, Homo sapiens; identical to SEQ ID NO: 37594

SEQ ID NO: 75620 - DNA, 201 bp, Homo sapiens
ggtcaacaagggatcaatgtgtgagtttgttcaaaacaatatctcaagtttacttttaaatagattggggaaaagaatgaaagaagaaaggctatttttayggattgtggcattcacgcacgagaatgggtctccccagcattctgccagtggtttgtctatcaggtaagtgaatcagaagactcccaattctcctttgac

SEQ ID NO: 75621 - DNA, 201 bp, Homo sapiens
atgtgtatgtacatatatacacaaaatatatgtgtatatacatatatacaaaatacatatgtaaatatatatatatcatcattcattttccaattttcttrctataaaactcactcaagaggcattgtttcatattttgaaaatgtgttcttttatagcaatatctaattgttgaggtgcacatctgagatgtacatctct

SEQ ID NO: 75622 - DNA, 201 bp, Homo sapiens
tactttaactcaaaaggtctgcttctggctgagataaagaaagagcctgttgatgtcagtgatgttatattgcagagcaggatttactactgctcaccatwaacttgattttatttatgatattgccacaatatctcaaataaactccattgaaatttaaaaatcacgtacataagtgagcaaaaaacattcttattcacg

SEQ ID NO: 75623 - DNA, 201 bp, Homo sapiens; identical to SEQ ID NO: 37494

SEQ ID NO: 75624 - DNA, 201 bp, Homo sapiens
ttatattgaatacatttaaataatattttttaaaacgatacaatttttcagaaaacactgtatcaagtaagcaataaatgcagcacacattaagtcaccarcgtcactttatatggatccctttgggctgaaatcagatttctagtttggtacggtttcattttgatttgttctcattgaatttgttgcaaccaatattgt

SEQ ID NO: 75625 - DNA, 201 bp, Homo sapiens
actgtattttataaatgcatacacatgttttagtaggtacacatggagataaagaaaaggctaagtatcatgttaaacaaattaagttctggccaggcacrgtgatgcacacctgtagtcccagctactcaggaggctgaggtggaagtatcacttcagcctgggacgtcgaggatacagtgagccatgatcatgccaccg

SEQ ID NO: 75626 - DNA, 201 bp, Homo sapiens
aacatggatatactaacaaacccaaacagactggcaaacaaatatcaaagggaaggcacgtccatcggactgagcctctggggcagacactatacttggaytcagcagttaaaaatcctagtgtttttaacattgttcacattttagacagtcaatttttaacattgtcttttctttgatcaaaggttaaaattagaaaat

SEQ ID NO: 75627 - DNA, 201 bp, Homo sapiens
atcaccttttacccactaagtgaaccaaccagaccaaaatagcaatgcaaaggctttgaaaactatattgtcagctgagcacggtggctcatgcctgtaaycttagcactttgggaggccaaggtgggaggatcacctgagaacaggagtccgagaccagcctggccaacatggtgaaacccggtctctactaaaaataca

SEQ ID NO: 75628 - DNA, 201 bp, Homo sapiens
gattatgaattatgtatagacatttaaggatatgtcccatggtcccttctgagaacaatatgtgcatacatggttctcattcaacaatagacaggggaaakaattgctttgagaatatgaatgagttattggtcaacaagggatcaatgtgtgagtttgttcaaaacaatatctcaagtttacttttaaatagattgggga

SEQ ID NO: 75629 - DNA, 201 bp, Homo sapiens
tatggtgtacctagctagcaggctagcactttggagctttcagagataaatgagaggacttaggacacaataaactactcttaaggaagtcacattctaastggaaggagcggagagccaaaactaccatagctccatgccatcatgtgtcactttcaaaatggaaagatacagtcaagagggattactattctgtttaac

SEQ ID NO: 75630 - DNA, 201 bp, Homo sapiens
aggagtccgagaccagcctggccaacatggtgaaacccggtctctactaaaaatacaaaaattagctaggtgtggtggtacgcacctgtagtcccagctaytcaagaggccgaggcaggagaattgcttgaacctggaaggcagaggttgcagtgagctgaaatcgtaccactccacttcagtctgggcaacaaagtgaga

SEQ ID NO: 75631 - DNA, 201 bp, Homo sapiens; identical to SEQ ID NO: 37911

SEQ ID NO: 75632 - DNA, 201 bp, Homo sapiens
tctgaaacaaccttcacataacctacaaatgtaacttttcttcaatgagctcaaaacatagatatttaattttaattcctctttagataatacattggccrcacatgtacttggaattttaatatttaagtttcctttctgagtgaaaaataactcacttttttcttttttttttttttgagatggagtctcactctgtca

SEQ ID NO: 75633 - DNA, 201 bp, Homo sapiens; identical to SEQ ID NO: 37914

SEQ ID NO: 75634 - DNA, 201 bp, Homo sapiens
gaccaaactcttggaccgaatgaatttttacattcttcctgtgttcaatgttgatggatatatttggtcatggacaaaggtactgctctctactctcttgyttgcatttagatattatttgctggctttaatacacaatgttatgcattcagcttagggtttaggtaactagttaattctaattcagaaaagtatattttt

SEQ ID NO: 75635 - DNA, 201 bp, Homo sapiens; identical to SEQ ID NO: 8285

SEQ ID NO: 75636 - DNA, 201 bp, Homo sapiens
ctgaaatatattctaaccctaaaattcatataaatacctctaattccattgagcctttagatggaggagataaaagagataatcccaattgcagaatattrtcccatgtccatccattattcagtttataaagacacaaaagttgaacacactatttgaattattatgcagcttaatattttttctcaatcagaaaaaaaa

SEQ ID NO: 75637 - DNA, 201 bp, Homo sapiens
aacaatagacaggggaaataattgctttgagaatatgaatgagttattggtcaacaagggatcaatgtgtgagtttgttcaaaacaatatctcaagtttayttttaaatagattggggaaaagaatgaaagaagaaaggctatttttatggattgtggcattcacgcacgagaatgggtctccccagcattctgccagtgg

SEQ ID NO: 75638 - DNA, 201 bp, Homo sapiens
attcttcccttttcatttctcatctatcagtaaaagggctttgtacccaagttacaagttgtgctatcacataacaatattcttgacagaggccaggcacrgtggctcatacctgtaatcccaacattttgggaggccaaggtgggaggatcacttgagcccaggagttcaagacaagtctgggtgataaagtgagaccct

SEQ ID NO: 75639 - DNA, 201 bp, Homo sapiens
tttctcacagattttcaccatgtggcttcatcaatttatgtgctaatacaataaaataaaatgcacttaatgctttaaaattcatctttttatgataaacwatattctctgtatttctctatagcattaataatcaatattaatgccattcattcagtctgttaataagaaataatatcttcaattttcaaaaacataatt

SEQ ID NO: 75640 - DNA, 201 bp, Homo sapiens
gagaaatgtcagtggctaaaagcaacatacagacagtttttcagatatttagtgaaaagagtcatctggagcaaagaaagtgaaaaagtttaacagaaatmcgatgataagcagaggcctgctacatcagacgatgctttagttgctatacaactatgacttcatcactgcacactttcaaggagaaattaccattgcccc

SEQ ID NO: 75641 - DNA, 201 bp, Homo sapiens
atattccttggtatttacacagtatcctattatttcactctaactttcctttctctccaggccaaagttgcaaagattggcactgatgttctatcaactcratatgaaacccgctacatctatggcccaatagaatcaacaatttgtaagtcattcctcttatttactgagcccttttccctaattattttttacaaatat

SEQ ID NO: 75642 - DNA, 201 bp, Homo sapiens
ttacacttctttctactcctttttaacacaattgtatttcatgattaaaatgccaagccatttttctataatgagtcataatagcatcttgaaaatttcgkcagcatatatataggctactgtcagaattttcttaggcaaagcttttgggagactctcttgcatttcattgtcacaagatccattataccaggacagatc

SEQ ID NO: 75643 - DNA, 201 bp, Homo sapiens
aaatgactttgctgggggtctatgccaactgtttgatacaatatcttgtatcaggatttccagagtttatagggacatcaggttttgaggactaactaacyagatatttaacttaaatttccaattagaggcagattctgtggctagatgaattgtgatcccattcaatcccaaaattgtggaagaaaaaaattaaccaaa

SEQ ID NO: 75644 - DNA, 201 bp, Homo sapiens
aaatgatgtaatatttttaactgggcatgctatgatattttgagggatccttacatgtttccctcaaaaaacattaacccaccgaaatgggaaaagcagtrttctattattagggaagaacaaactcatggagaattatgtaaagttcagattacctctggttgcataagatgcctccttttcattcaattggtgacatac

SEQ ID NO: 75645 - DNA, 201 bp, Homo sapiens
tattgacttataccttgacttctgcctcctaaattgtaagttactgaagacaccagtggcatcttctgcatttttgtaccctgcaacaattactctccccrgtgccaagaaatgtgtcttgtaaatattaaaggtttaataaatatttggtgaccaatttaagagccaacactatctcttcatcaaaatatcccttctctc

SEQ ID NO: 75646 - DNA, 201 bp, Homo sapiens; identical to SEQ ID NO: 37507

SEQ ID NO: 75647 - DNA, 201 bp, Homo sapiens
gaataataatggaatctatttcataggggtttcatgaagattgactgggatcgtaaagttgctgtctgcctggtcctttacttctatgaatacacacacamacacacacacacacacacacacacactcacacagaaacagggaataactagaggctatcaccagatgttccattttcctcccagtgaataaatgagtagt

SEQ ID NO: 75648 - DNA, 201 bp, Homo sapiens; identical to SEQ ID NO: 37508

SEQ ID NO: 75649 - DNA, 201 bp, Homo sapiens
ttgaggtgcacatctgagatgtacatctctattatgaaaaaatgaaacatcttatttttacttatgcaaataaatgtttccagtaagtcttatgactccamactgatctttaaatgtcatatcagaggtcccttccccacatttgacacattggatatgttctttgaccacagaagtgctcattggctaagtgaacattag

SEQ ID NO: 75650 - DNA, 201 bp, Homo sapiens
ttgacttccagtaaacttacttctcagaacaccccagacagttttcaacgactgggaaaggtcctgagaagtcaagtcaataaacaatctgggacatgccycatgaatcctttagggacacataaaagaaaggatggcatcaaagctacaagatgatggtgtgttctgataatcatgaggtagataaaagtttcccatgca

SEQ ID NO: 75651 - DNA, 201 bp, Homo sapiens
tagaggaaagtattacaatggacctatttttaattgggccccccagaacgaaagctctttctgtaagatacagatcacagttacttccaaacacattatcraagcctgtttacagaggtgatagaatcaaacttggcagttcaacatctaccttacatttgctcttagctataagaataacaattacctatatctaccatc

SEQ ID NO: 75652 - DNA, 201 bp, Homo sapiens
catttgtcagagattgcacagtggacaaacccaaacaaatatttcatcccacagctttattacaagagtccatgatgtctctggtataaaaaaaccctcaycccttaaaatgcagtgaaactgatgaatgaatgtcatgaagggaatttaaatatcatagcatcataggactgtagaacagtgtgttaggcatttcaacca

SEQ ID NO: 75653 - DNA, 201 bp, Homo sapiens
tgaaggtaaaaataactcaagaaccactaattcttattactgttgaaaaacatgaatttaaaagttactttgtaacacaactaagctaattctgagctaawacatattatctctgaaagaatatttaagctctagacatccattaaagaatagaaatgacaagcggttttggtggaaccaagaaagtgtctggataaacat

SEQ ID NO: 75654 - DNA, 201 bp, Homo sapiens
gaatacagtttaaatcaaagagaaaagaatctcaaatagccaaagatgcagaaatgagtcattctggccccacagagaagtaagagaaaatctgaatataytgagcagcaaccatgggccatgcccagtctgggccctgggcagtgaatgagaaggaagcccagcaatgaatatcataaatcaatgtgtaatttagaaaat

SEQ ID NO: 75655 - DNA, 201 bp, Homo sapiens
actccatctcaaaaaaaaaaaaaaaaaagaatcatcaggaagcttttaaaatacatgaatgattatacccccagcccccagagattctgatttcatcagtytgaggaggagctcggcactcaatttttttttaagtaccttaagtgattctaagatgaaactagggttgagaatcgctgatctaagcaaaacttctcattt

SEQ ID NO: 75656 - DNA, 201 bp, Homo sapiens
aaaatgccggaatcaacatatacagtttctaggacttacttattagatgcttctttggcagaactggaaaatgactaaaaaatggacaagtccctttcctygagcacattcattaacaatcacctatcaaccagtcactgttaaggtgctgaagaaaaagtgtagtgatacagatgatccccagcatccacatagatcttg

SEQ ID NO: 75657 - DNA, 201 bp, Homo sapiens
cactgttaaggtgctgaagaaaaagtgtagtgatacagatgatccccagcatccacatagatcttgctacaacctagccatgctggggactcattacacayacaggtggatgaccacaagatttcaaaatacatgttatgtacccagctatgtgagtggacaaaaagtaagcaaagtaaagaacaagaagacagactagaa

SEQ ID NO: 75658 - DNA, 201 bp, Homo sapiens
tttaaaataactaaattacattttcttggtcttttgactatgaaatagtttaccctagcaacatgaaaaacaagagacctaagctattagaagaaatgcarttctatgtatcttgtgtgtatagtttttccctggtggttttcaacgaccagtgactccttagctggtttcctcagctgctagcacttgctctgggtactt

SEQ ID NO: 75659 - DNA, 201 bp, Homo sapiens
tgtatcttgtgtgtatagtttttccctggtggttttcaacgaccagtgactccttagctggtttcctcagctgctagcacttgctctgggtacttgtcctsaacacgtccatctgcaacaatgtgtgcctaggaaataaactcaacttactactcacccaaccaaaatgtaattttttaaacgcagcacacactgggtgga

SEQ ID NO: 75660 - DNA, 201 bp, Homo sapiens
ttttaactacctttctttgctccaagtgaagtttggacccagcagaaagcattattttgaaaggtgatatacagtggggcacagaaaacaaatgaaaaccytcagtttctcacagattttcaccatgtggcttcatcaatttatgtgctaatacaataaaataaaatgcacttaatgctttaaaattcatctttttatgat

SEQ ID NO: 75661 - DNA, 201 bp, Homo sapiens
ggataagcacagtgcctaacctgtaagactccattaaaaaattgcatacatacataattacatattccttggtatttacacagtatcctattatttcactmtaactttcctttctctccaggccaaagttgcaaagattggcactgatgttctatcaactcgatatgaaacccgctacatctatggcccaatagaatcaac

SEQ ID NO: 75662 - DNA, 201 bp, Homo sapiens
cttcattctattctcccttataataggtctcccagttttgaagcaggcacatggccatacaaataaaggttctatttccaaactccttgcaaacagaatcrtaggattgactactcaaattttctcataagtaaaataaagttttagtgttttaactttaatatagatactagtcttcacatatttattttcacaattcat

SEQ ID NO: 75663 - DNA, 201 bp, Homo sapiens
cctctttcttcattctattctcccttataataggtctcccagttttgaagcaggcacatggccatacaaataaaggttctatttccaaactccttgcaaayagaatcgtaggattgactactcaaattttctcataagtaaaataaagttttagtgttttaactttaatatagatactagtcttcacatatttattttcac

SEQ ID NO: 75664 - DNA, 201 bp, Homo sapiens
catgttggtcaggctggtctcgaactcccgacctcaggtgatccgcacctcagccttccaaagtgctgggattacagtcgtgagccacaacacccagcctsgaaattattttgatctgaatgctatacttctgagctcatataccaaatttttgaaattgtcagctagaggaagagaaaggaaaaaaaaaatctgcacctg

SEQ ID NO: 75665 - DNA, 201 bp, Homo sapiens
aaaaaaatcaggaagaaatgtctaggaaaggcataatagaagtctattacaacacagctcattgtggggtttaacatttaccatgggttgtacggtaaaaycatgcacggaaaaagcccaatagaatagcaaagacatttactagtcctgccccccagatatcagatttaagaagatacattgtatttttatcctgatcaa

SEQ ID NO: 75666 - DNA, 201 bp, Homo sapiens
gggtgataaagtgagaccctatctctacaaaaaaataaaaataaaaaattagccagctgtgatggcacatacctgtggtcccagctacttgggaagttgargcaaaaggattgcttgagcccaggaggtcgaggctgcagcgagccaagatcacaccactgcactccaacttggatgacagagcaaaactctgactcaaat

SEQ ID NO: 75667 - DNA, 201 bp, Homo sapiens
aatggctcacgcctgtaatcccagcacttcaggaggctgaggtgggcagatcacctgaggtcaggagttcgaggccagcctgatcaacatggagaaacccygtctctactcaaaatacaaaattagctggcgtagtggcacatgcctgtaattccagctgctcaggagaccaaagcaggagaatcacttgaacccgggagg

SEQ ID NO: 75668 - DNA, 201 bp, Homo sapiens
actgatgtagcaagccagaaacaacaggtataacagttccagatgtgtcacagatggaaatccttggaggataatgtagtgttatgcaaaatcacagagckagaaatcaggaggtttgggcttgaatcctgactctgttactgaatgatatctagcaagacactgtcaccttttacctgccctgcttatctcatagctttt

SEQ ID NO: 75669 - DNA, 201 bp, Homo sapiens
  misc_feature (1)...(201): n = A,T,C or G, or insertion/deletion polymorphism (see Tables 1-2)
cagtggctcatacctgtaatcccaacattttgggaggccaaggtgggaggatcacttgagcccaggagttcaagacaagtctgggtgataaagtgagaccntatctctacaaaaaaataaaaataaaaaattagccagctgtgatggcacatacctgtggtcccagctacttgggaagttgaggcaaaaggattgcttgag

SEQ ID NO: 75670 - DNA, 201 bp, Homo sapiens
gatcacaccactgcactccaacttggatgacagagcaaaactctgactcaaatatacatatacacacatacacacacacatacatatgtgtatgtacatakatacacaaaatatatgtgtatatacatatatacaaaatacatatgtaaatatatatatatcatcattcattttccaattttcttactataaaactcactc

SEQ ID NO: 75671 - DNA, 201 bp, Homo sapiens
attgcttgagcccaggaggtcgaggctgcagcgagccaagatcacaccactgcactccaacttggatgacagagcaaaactctgactcaaatatacatatrcacacatacacacacacatacatatgtgtatgtacatatatacacaaaatatatgtgtatatacatatatacaaaatacatatgtaaatatatatatatc

SEQ ID NO: 75672 - DNA, 201 bp, Homo sapiens
attctctgtatttctctatagcattaataatcaatattaatgccattcattcagtctgttaataagaaataatatcttcaattttcaaaaacataatttgyctatctttttctgatagaagtagacattgtttatatcttcaaaaaagcaaaaggatgtcctagcaggaaataaagtggttcatatagagatgaatctcag

SEQ ID NO: 75673 - DNA, 201 bp, Homo sapiens
aaaataacatctggccccagttcttaatttccagccttaggcttaatttctagtccctatcagcaacaatctggcaccgttctgatgttctcatgcagctrcatcatttgtggaaaggttgtacttcaactcacactgttttttttgctttgttttgtttggttttgttttgctgctgttatcataagagctaaattgata

SEQ ID NO: 75674 - DNA, 201 bp, Homo sapiens
tgtaccatttatactcctattatttaagatagtattattggatagcttctccccaacaccaatacctcaatgtgtgatcaagtggcaacagtggcagtgtytacattcccagaatccagacacagatgcccaccacaggactgactataatttgagggacaagtagagagttccttgacttccagtaaacttacttctcag

SEQ ID NO: 75675 - DNA, 201 bp, Homo sapiens
gaaaaaaaattagcctgagtggctaaaaataaaaaatcctaacaagatctcatcctaattaaatagtttttgaatggcatctgagggcatttacttctttsactgcatatgaattgtgaaaataaatatgtgaagacaaatatctacattaaagttaaaaaactaaaattttaccttatttatgagaaagtttgagtggca

SEQ ID NO: 75676 - DNA, 201 bp, Homo sapiens
ccagctacttgggaagttgaggcaaaaggattgcttgagcccaggaggtcgaggctgcagcgagccaagatcacaccactgcactccaacttggatgacasagcaaaactctgactcaaatatacatatacacacatacacacacacatacatatgtgtatgtacatatatacacaaaatatatgtgtatatacatatata

SEQ ID NO: 75677 - DNA, 201 bp, Homo sapiens
ttacagagaaaatatttcagtgtatgcccatgtatctctggcttcagctcttgcttctaatataattttcacttagtattaatataaaagtacaggttatyatattgaatacatttaaataatattttttaaaacgatacaatttttcagaaaacactgtatcaagtaagcaataaatgcagcacacattaagtcaccaac

SEQ ID NO: 75678 - DNA, 201 bp, Homo sapiens
caatcaaatggaatcctaaaaatgtcatgtaaccaagaggaaggtgtaaagcaagaaaaaaaagataaagggataaaaacagaaagaacaaaaaaaaaaaaagaaataatggcatgtttaagtcatatcaataatttacctacacgcactaattaaagacacatgggcagaatgaattttttaaattataattcaacaata

SEQ ID NO: 75679 - DNA, 201 bp, Homo sapiens
cctgtctctactaaaaatacaaaagttagccaggtgtggtggcaggcgcctgtagagaggagaagcacttggacctgggaggcagaggttgcagtgagccragattgtgtcattgcattctcgcctgggtgacagagtgagactccatctcaaaagaaaaaaaaaaatactatattgtcatcagtatcacaagacacaaaa

SEQ ID NO: 75680 - DNA, 201 bp, Homo sapiens
cacctgctaaaacatctgtttgccggtacagacacagacaagacagtctggtcagctgtgacccctgccctcctaatggatagaaaggaaacctggaaacrtactgtaagttgaggacggaaagtcatgttgaccaaaggcaatcagggtaacttgctgcatttgtaccatttatactcctattatttaagatagtattat

SEQ ID NO: 75681 - DNA, 201 bp, Homo sapiens
atcgctgatctaagcaaaacttctcatttatagactgaaattcagatacagaaatatttcatcactttagggcagaagaaaaacaaaaatcagcattcaasaccagagttaaaatggtatacctaccactttgccccaaagcagcaatattgagatggcacaaaaaagtaaatagtaatgtttaatgtgaaatgattatat

SEQ ID NO: 75682 - DNA, 201 bp, Homo sapiens
cctgaccaatatggtgaaaccctgtctctactaaaaatacaaaagttagccaggtgtggtggcaggcgcctgtagagaggagaagcacttggacctgggakgcagaggttgcagtgagccaagattgtgtcattgcattctcgcctgggtgacagagtgagactccatctcaaaagaaaaaaaaaaatactatattgtcat

SEQ ID NO: 75683 - DNA, 201 bp, Homo sapiens; identical to SEQ ID NO: 8947

SEQ ID NO: 75684 - DNA, 201 bp, Homo sapiens; identical to SEQ ID NO: 8948

SEQ ID NO: 75685 - DNA, 201 bp, Homo sapiens; identical to SEQ ID NO: 48174

SEQ ID NO: 75686 - DNA, 201 bp, Homo sapiens; identical to SEQ ID NO: 48176

SEQ ID NO: 75687 - DNA, 201 bp, Homo sapiens; identical to SEQ ID NO: 8949

SEQ ID NO: 75688 - DNA, 201 bp, Homo sapiens
aaggagaaactcaagattgactcatgaggacctgaagggtgacatcccaggaggggcctctgaaatttcccacaccccagcgcctgtgctgaggactccckccatgtggccccaggtgccaccaataaaaatcctacagaaaattctctcctgagtgcttctttactctggggaaggggctgcgggagagggtaggggctt

SEQ ID NO: 75689 - DNA, 201 bp, Homo sapiens; identical to SEQ ID NO: 48183

SEQ ID NO: 75690 - DNA, 201 bp, Homo sapiens; identical to SEQ ID NO: 8951

SEQ ID NO: 75691 - DNA, 201 bp, Homo sapiens
tttggtttttttgttttgttttgttttgttttttgagatggaggtttgctctgtcgcccaggctggagtgcagtgacacaatctcatctcaccacaacctkcccctgcctcagcctcccaagtagctgggattacaagcatgtgccaccacacctggctaattttctatttttagtagagacgggtttctccatgttggtc

SEQ ID NO: 75692 - DNA, 201 bp, Homo sapiens; identical to SEQ ID NO: 8961

SEQ ID NO: 75693 - DNA, 201 bp, Homo sapiens; identical to SEQ ID NO: 48195

SEQ ID NO: 75694 - DNA, 201 bp, Homo sapiens; identical to SEQ ID NO: 8946

SEQ ID NO: 75695 - DNA, 201 bp, Homo sapiens; identical to SEQ ID NO: 48199

SEQ ID NO: 75696 - DNA, 201 bp, Homo sapiens
gggaattgcttgaaccaggaaggtgggagttacagtgagccaacattgtgccagcctgggtgacagaaggagactctgtctcaaaaaaaaaaaaaaaaaamaaaaaaacaagatggtcttgcccaggtatggtggctcacacctgtaattccagcactatgggaggctgagatgggaggattgcttgagcccaggagttcg

SEQ ID NO: 75697 - DNA, 201 bp, Homo sapiens; identical to SEQ ID NO: 48200

SEQ ID NO: 75698 - DNA, 201 bp, Homo sapiens
tcagtgctgagtaaggcaattcccagcagcttgagccccaccaggtcactccagtattcctccccattctttttttttttttttttttttctcttgagacrgagtctcgctctgtcgccgaggctggagtgcagtggcgcgatctcggctcactgcaagctccgcctccctggttcacgccattctcctgcctcagcagga

SEQ ID NO: 75699 - DNA, 201 bp, Homo sapiens
cctgcctcagcaggactacaggcgcccgccaccgcgcccggctaattttttgtattttcagtagagacagggtttcaccgtggtctcgatctcctgacttygtgatccgcctgcctcgacctcccaaagtgctgggattacaggcgtgagccaccgcgtccggccattcctccccattctaaccacatgatccccaaggat

SEQ ID NO: 75700 - DNA, 201 bp, Homo sapiens
gcttgaaccaggaaggtgggagttacagtgagccaacattgtgccagcctgggtgacagaaggagactctgtctcaaaaaaaaaaaaaaaaaaaaaaaaamcaagatggtcttgcccaggtatggtggctcacacctgtaattccagcactatgggaggctgagatgggaggattgcttgagcccaggagttcgagaccag

SEQ ID NO: 75701 - DNA, 201 bp, Homo sapiens
ccgggaggcggaggttgcagtgagccgagatcatgccactgcactccagcctgggcgacaaggcgagactccatgccaaaaaagaaaaaaaactcctggcrcggtggctcacgccagtaatcccagcactgtgggaggctgagcaggcggatcacgaggtcaggagttcgagactagcctgctcaacataatgaaaccctc

SEQ ID NO: 75702 - DNA, 201 bp, Homo sapiens
caggccttgaaagccaggccagggtgaagtgtttctttttttttttttttttttttctttttaaatttttttttttgagacggagtctcgctctgtcaccmaggctggattgcagtggcctgatctcggctcactgcaagttccgcctcccgggttcatgccattctcctgcctcaccctcccgagtagctgggactacag

SEQ ID NO: 75703 - DNA, 201 bp, Homo sapiens
agtctcgctctgtcacccaggctggattgcagtggcctgatctcggctcactgcaagttccgcctcccgggttcatgccattctcctgcctcaccctccckagtagctgggactacaggcacctgccaccacgccagctaattttttgtattcttagtagaatgtagaatttacttagtagaattttttgtattcttagcc

SEQ ID NO: 75704 - DNA, 201 bp, Homo sapiens
ccagctaattttttgtattcttagtagaatgtagaatttacttagtagaattttttgtattcttagccagcatggtctcgatctcctgacctggtgatccrcccgcctcggcctcccaaagtgctgggattacaggcgtgagccacggcgcccggccttattttttctttttgagatgtacccagactggagtacagtggt

SEQ ID NO: 75705 - DNA, 201 bp, Homo sapiens; identical to SEQ ID NO: 48203

SEQ ID NO: 75706 - DNA, 201 bp, Homo sapiens; identical to SEQ ID NO: 48205

SEQ ID NO: 75707 - DNA, 201 bp, Homo sapiens; identical to SEQ ID NO: 48207

SEQ ID NO: 75708 - DNA, 201 bp, Homo sapiens; identical to SEQ ID NO: 48209

SEQ ID NO: 75709 - DNA, 201 bp, Homo sapiens; identical to SEQ ID NO: 48211

SEQ ID NO: 75710 - DNA, 201 bp, Homo sapiens; identical to SEQ ID NO: 48213

SEQ ID NO: 75711 - DNA, 201 bp, Homo sapiens; identical to SEQ ID NO: 8958

SEQ ID NO: 75712 - DNA, 201 bp, Homo sapiens; identical to SEQ ID NO: 8959

SEQ ID NO: 75713 - DNA, 201 bp, Homo sapiens
gccctgtgctgaggatgttttaactccatggtctcaaaagagtcttcctaagaaccctgcaaactgggccttattaatcccataagggcattgaggcccaragaggtgaagttacttgtataaggtcacacagccaggaagtagagaactggaactagattgaaccctcagcctagcaatgtcactatgctacacttttcc

SEQ ID NO: 75714 - DNA, 201 bp, Homo sapiens; identical to SEQ ID NO: 8963

SEQ ID NO: 75715 - DNA, 201 bp, Homo sapiens
ggaagtaaaggagcaggcctacagggtgtctggtacatgtagatgctcagtatatcatgaaacccacccttgccccctttggcaagttagagagtcattcrttctttcaaaaatatttactgagcatctgctaagtgctggaaactgtttcaatgtggggaataaaacagtgaagaacgtgccgagcacggtggctcacac

SEQ ID NO: 75716 - DNA, 201 bp, Homo sapiens
aggacctgaagggtgacatcccaggaggggcctctgaaatttcccacaccccagcgcctgtgctgaggactccctccatgtggccccaggtgccaccaatraaaatcctacagaaaattctctcctgagtgcttctttactctggggaaggggctgcgggagagggtaggggcttccagagagggcagggtctgcaggaga

SEQ ID NO: 75717 - DNA, 201 bp, Homo sapiens
cagaagaatttttcttagtatagaacaaaatgaaaagtctcccatgtctacttctttctacacagacacggcaaccatccgatttctcaatcttttccccaacttttcccccctttctattccacaaagccgcgattgtcatcctggccggttctcaatgagctgttgggcacacctcccagacagggtggtggccgggca

SEQ ID NO: 75718 - DNA, 201 bp, Homo sapiens
aagaatttttcttagtatagaacaaaatgaaaagtctcccatgtctacttctttctacacagacacggcaaccatccgatttctcaatcttttccccaacytttcccccctttctattccacaaagccgcgattgtcatcctggccggttctcaatgagctgttgggcacacctcccagacagggtggtggccgggcagag

SEQ ID NO: 75719 - DNA, 201 bp, Homo sapiens
aggtagtgtgagagggtccgggttcaaaaccacttgctgggtggggagtcgtcagtaagtggctatgccccgaccccgaagcctgtttccccatctgtacratggaaatgataaagacgcccatctgatagggtttttgtggcaaataaacatttggtttttttgttttgttttgttttgttttttgagatggaggtttgc

SEQ ID NO: 75720 - DNA, 201 bp, Homo sapiens; identical to SEQ ID NO: 48221

SEQ ID NO: 75721 - DNA, 201 bp, Homo sapiens
gatggttttgtgaggtaatgaaaatgaaggccccaagcttggccagacctgggtccccaggctggagtagcaccccttcctgtgtgatcttgacagagggrcattactgtgagcctcagtttcctctcctataaactggtggttctacagggaagtaaaggagcaggcctacagggtgtctggtacatgtagatgctcagt

SEQ ID NO: 75722 - DNA, 201 bp, Homo sapiens; identical to SEQ ID NO: 48222

SEQ ID NO: 75723 - DNA, 201 bp, Homo sapiens; identical to SEQ ID NO: 48224

SEQ ID NO: 75724 - DNA, 201 bp, Homo sapiens
cttgaaagtgggtaagctgggtggggggctctgggagaggtcagtgctgagtaaggcaattcccagcagcttgagccccaccaggtcactccagtattccyccccattctttttttttttttttttttttctcttgagacggagtctcgctctgtcgccgaggctggagtgcagtggcgcgatctcggctcactgcaagct

SEQ ID NO: 75725 - DNA, 201 bp, Homo sapiens
ttttcagtagagacagggtttcaccgtggtctcgatctcctgactttgtgatccgcctgcctcgacctcccaaagtgctgggattacaggcgtgagccacygcgtccggccattcctccccattctaaccacatgatccccaaggatctctatccatcccggtatcccaacctaagggggttccaataacaaatttttggc

SEQ ID NO: 75726 - DNA, 201 bp, Homo sapiens; identical to SEQ ID NO: 48226

SEQ ID NO: 75727 - DNA, 201 bp, Homo sapiens
ccccattctaaccacatgatccccaaggatctctatccatcccggtatcccaacctaagggggttccaataacaaatttttggccgggcagggtggctcaygcctgtaatcccagcactttgggaggccgaggcgggcagatcacttgaggtcaggagttcgaaaccagcctggccaacatggtgaaacttcgtctctact

SEQ ID NO: 75728 - DNA, 201 bp, Homo sapiens; identical to SEQ ID NO: 8953

SEQ ID NO: 75729 - DNA, 201 bp, Homo sapiens
tgaggtcaggagttcgaaaccagcctggccaacatggtgaaacttcgtctctactaaaaatacaaaaaaattagccaggtgtggaggcacgcgcctgtagkcccagctactcgggaggctgaggcaggagaatcacttgaacccgggaggcggaggttgcagtgagccgagatcataccactgcactccagcctggctgac

SEQ ID NO: 75730 - DNA, 201 bp, Homo sapiens
cctcatgagtacttggaactacaggtgtgtgacaccacacatggtattttttgtatttttagtgaagatgacatttcaccatgttgcccaggttggtctcraactcctgacctcaagtgatcagcctacctcggcctcccaaagtgttgggattacaggcgtgagccaaatgcccagccaagggtaaagtgtttagacttc

SEQ ID NO: 75731 - DNA, 201 bp, Homo sapiens
gtgtgtgacaccacacatggtattttttgtatttttagtgaagatgacatttcaccatgttgcccaggttggtctcgaactcctgacctcaagtgatcagsctacctcggcctcccaaagtgttgggattacaggcgtgagccaaatgcccagccaagggtaaagtgtttagacttcaacgtgctttggtccatctgggaa

SEQ ID NO: 75732 - DNA, 201 bp, Homo sapiens
cccagcgcctgtgctgaggactccctccatgtggccccaggtgccaccaataaaaatcctacagaaaattctctcctgagtgcttctttactctggggaakgggctgcgggagagggtaggggcttccagagagggcagggtctgcaggagagggcaggggctaaaccttaggtactcctcacaagccctccaatgcccta

SEQ ID NO: 75733 - DNA, 201 bp, Homo sapiens
cgggcagaggggctcctcacttcccagtaggggcggccgggcagaggcgcccctcacctcccggacggggtggctgccgggcggagaggctcctcacttcycagacagggcggttgccaggcagagggtctcctcacttctcagacggggtggccgggcagagacgctcctcacctcccagacggggtcgcggccgggcag

SEQ ID NO: 75734 - DNA, 201 bp, Homo sapiens; identical to SEQ ID NO: 8956

SEQ ID NO: 75735 - DNA, 201 bp, Homo sapiens; identical to SEQ ID NO: 8957

SEQ ID NO: 75736 - DNA, 201 bp, Homo sapiens
tcctcacttctcagacggggtggccgggcagagacgctcctcacctcccagacggggtcgcggccgggcagaggcgctcctcacatcccagacggggcggyggggcagaggcgctccccacatctcagacgatgggcggccgggaagaggcgctcctcacttcctagatgggatggcggccggacggagacgctcctcact

SEQ ID NO: 75737 - DNA, 201 bp, Homo sapiens
ccaccgcacctggccaaatttttaatttttttctagagatagggtcttactgtgttgcccaggctggtgtcaaactcctgggctcaagcagatcctcctgyctcagcttcccaaagtggtgggattataggtgtgagccactgcgcccagtcagtagccccctctttgcccctcactgagccctactggatgttcttggtt

SEQ ID NO: 75738 - DNA, 201 bp, Homo sapiens; identical to SEQ ID NO: 8964

SEQ ID NO: 75739 - DNA, 201 bp, Homo sapiens
gggtaaattttatggaatgtgaatcataattcaatttttcaacatgcgttaggagggacatttcaaactcttttttaccctagactttcctaccatcaccsagagtatccagccaggaggggaggggctagagacaccagaagtttagcagggaggagggcgtagggattcggggaatgaagggatgggattcagactagg

SEQ ID NO: 75740 - DNA, 201 bp, Homo sapiens
ttctgggctcaccctgcccccttccaacccctcagttcccatcctccagcagctgtttgtgtgctgcctctgaagtccacactgaacaaacttcagcctastcatgtccctaaaatgggcaaacattgcaagcagcaaacagcaaacacacagccctccctgcctgctgaccttggagctggggcagaggtcagagacctc

SEQ ID NO: 75741 - DNA, 201 bp, Homo sapiens; identical to SEQ ID NO: 8952

SEQ ID NO: 75742 - DNA, 201 bp, Homo sapiens; identical to SEQ ID NO: 48248

SEQ ID NO: 75743 - DNA, 201 bp, Homo sapiens
gaggtgaagttacttgtataaggtcacacagccaggaagtagagaactggaactagattgaaccctcagcctagcaatgtcactatgctacacttttcctrgtgtggtctacccgagatgaggggctgaggtttttttttgtttttgtttctgttttgaggcagactcactctctcccccaggatggagtacagtggtgcg

SEQ ID NO: 75744 - DNA, 201 bp, Homo sapiens; identical to SEQ ID NO: 48250

SEQ ID NO: 75745 - DNA, 201 bp, Homo sapiens
aaaaattagccgggtggggtggcacatgcctgtaatcccagctgcttgggaggctgaggcaagagaatcccttgaacccaggagtcgaaggttgcagtgarccaagatggcgccactgccctccagcctgggagacagagtgggactccatctcaaaaaaaaaaaaaattcaaaatgtataatatacaatcctagttggga

SEQ ID NO: 75746 - DNA, 201 bp, Homo sapiens
ggtcaaggaaatgtggtctctacatgtaatggaatgtaacgcatccttaaaaaggaaaccctaaggccgggctctgtggctcacacatgtttttttttttwaattttatttatttatttatttatttatttattttttattgatcattcttgggtgtttctcacagagggggatttggcagggtcataggacaatagtgga

SEQ ID NO: 75747 - DNA, 201 bp, Homo sapiens
cagagggggatttggcagggtcataggacaatagtggagggaaggtcagcagataaacaagtgaacaaaggtctctggttttcctaggcagaggaccctgmggccttccgcagtgtttgtgtccctgggtacttgagattagggagtggtgacgactcttaacgagcatgctgccttcaagcatctgtttaacaaagcaca

SEQ ID NO: 75748 - DNA, 201 bp, Homo sapiens
agatttcataagaaaaatatttgtaagccacatatctaataaccggttaatattcaggctgggtgaagtggctcatgcctgtaatcccagcactttgggargacaaggcgggcggattacctgaagtcaaaagtttgagacctgcctggccaacatggtgaaaccctgtctctactaaaaatacaaaaaaattagccgggt

SEQ ID NO: 75749 - DNA, 201 bp, Homo sapiens
cagtgtttgtgtccctgggtacttgagattagggagtggtgacgactcttaacgagcatgctgccttcaagcatctgtttaacaaagcacatcttgcaccrcccttaatccatttaaccctgagtggacacagcacatgtttcagagagcacagggttgggggtaagatcacagatcaacaggatcccaaggcagaagaat

SEQ ID NO: 75750 - DNA, 201 bp, Homo sapiens
cgctcctcacctcccagacggggtcgcggccgggcagaggcgctcctcacatcccagacggggcggcggggcagaggcgctccccacatctcagacgatgkgcggccgggaagaggcgctcctcacttcctagatgggatggcggccggacggagacgctcctcacttcccagactgggcagccaggcagaggggctcctc

SEQ ID NO: 75751 - DNA, 201 bp, Homo sapiens
atttttgtatttgtagtagagacggggtttcaccatgttgcccaggttggtctcgaactcctgagctctagcaattagccctccttggcctcccaaagtgytggggttacaggcatgagccaccatggccggcctcaagtcagattatgctcttcctctgctcagaactctcctgattctctcagagtaaacccagaagca

SEQ ID NO: 75752 - DNA, 201 bp, Homo sapiens
gcaagaccccatccgttctaaaaataaaaataaataaaaaataaaaaataaaaattagctgagcatggtagtggacaccttggggttccagccacgtggcmggctgaggtaggaggatggctttgaatcagggaggttgaggctgcagtgagccatgttctgaattagatactggtgatgatcgtgcaaccttcccaatat

SEQ ID NO: 75753 - DNA, 201 bp, Homo sapiens; identical to SEQ ID NO: 48253

SEQ ID NO: 75754 - DNA, 201 bp, Homo sapiens
gatgatcgtgcaaccttcccaatataggaaaaaccactgaacagtacattttcaaagggtaaatttagccggacacggtggctcatgtctgtaatcccagyacttttggagtccgaggcgggcagatcacctgaggctgggagttcaagaccagcctgaccaacatggagaaaccccgtctctactaaaaatacaaaaaat

SEQ ID NO: 75755 - DNA, 201 bp, Homo sapiens
agaccatcttggccaacatggtgaaaccccgtctctactaaaaatacaaaaaattagccaggcgtgcgcctgtaatcccagctactcagtaggctgaggcrtgagaatcgcttgaacccaggaggtggaggctgcagtgagccgagatcatgccactgcactccagccggggcatcagagcaagactcaatctcaaaacat

SEQ ID NO: 75756 - DNA, 201 bp, Homo sapiens; identical to SEQ ID NO: 48254

SEQ ID NO: 75757 - DNA, 201 bp, Homo sapiens; identical to SEQ ID NO: 8962

SEQ ID NO: 75758 - DNA, 201 bp, Homo sapiens
ggggtaagatcacagatcaacaggatcccaaggcagaagaatttttcttagtatagaacaaaatgaaaagtctcccatgtctacttctttctacacagacmcggcaaccatccgatttctcaatcttttccccaacttttcccccctttctattccacaaagccgcgattgtcatcctggccggttctcaatgagctgttg

SEQ ID NO: 75759 - DNA, 201 bp, Homo sapiens
cttttcaggattaaaaaaaaaatcaaaacttaaaaaaaaaaaagtttaaaaagcaaaatggggagggggaggaagcagtgacttttttttggtaattatgygcttttttttaatttttagaatttgtctttttactgtgggtgggctgttgatatttcatcaagataagcatttctttcctgagttcaggtgactgaggaa

SEQ ID NO: 75760 - DNA, 201 bp, Homo sapiens
ttgagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatga

SEQ ID NO: 75761 - DNA, 201 bp, Homo sapiens
tgagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgac

SEQ ID NO: 75762 - DNA, 201 bp, Homo sapiens
gagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgacg

SEQ ID NO: 75763 - DNA, 201 bp, Homo sapiens
gcagcggtgcacccggacccggaacattctcaggcgaaagtgtctcttgcgtgcgtgggccggaggttagtgtgcggggcccgccgggcggttgaaaagtycgagagaatcaggatggaggccgtggcgacggcgacggcggcgaaggaacccgataagggtgagatcttggtcacgcgcaggcggcgggtgggtgcggtt

SEQ ID NO: 75764 - DNA, 201 bp, Homo sapiens
caacttctgctgcattgtcctgcatgctgacacccagacagacaggtgtctgtgggcatatgctgggcctcacaggacatgtgtgtgtacataggccatgyacacgtccatgggcaggagcttgtgcatcgtgcctggacacagttgtacacgagctccagaccgtcagagcctcagaggccaggatgtagccaggtctgc

SEQ ID NO: 75765 - DNA, 201 bp, Homo sapiens
cagcagcgtctgctccaacagcaggaggaggaggaggcctgcttggaggaagaggaagaggaggaggacagtgacgaggaaggtgagggccagtagcaggragaccccagattccagacaccccagccctaggcctgtctgtctccacttcatggcagcaggctgggcccccaacctgcaaaagccgacattgcgtccctc

SEQ ID NO: 75766 - DNA, 201 bp, Homo sapiens
tccaggatgtggggttgaacagccaaaggaagaggctgggtgacctcggactagccttgtccatctcagaccctcagtctcctcacctctaaggcaggggrtggacagggatgacatatagctcagtatcaatgaaaccctgaaacacttccctcctggcaatggcagaggctactaccccaagccccccaagtctcccta

SEQ ID NO: 75767 - DNA, 201 bp, Homo sapiens
gagactgagacagaaatgtaaagtaagggggagagatagacaggggtccagggaagagaatgggacagacaatgagaatagatcagaatttagtagatgtyagaagtggcatttcagattggtaggctgaggacacagtacacagtgctgtgataattggtcatacctaaggaacaaaacatgagatccctacctcatacc

SEQ ID NO: 75768 - DNA, 201 bp, Homo sapiens
acataagcggaccctacgtccgtcctgaggtgggctcatcaggaaagtgggaattgtgattgcccctgccgtggggcccagccatggtcaccagagcctcytcccattctgggatccctggctcttgaatggaatctggctgctccacttccagccaggcaggcctgctcagagccccagttcctgcacgcaaagtggtga

SEQ ID NO: 75769 - DNA, 201 bp, Homo sapiens
cagcatccccatcccccactctgaggcaccaaatgaaccctcgcctccaggtctggacaggctgttccctccgccaggaatgcctctcctcccacccttcmggtctcagatcctgacccgaggatacagtctccagagcactatatggtcatgtgttttatgcgtgtccctggagggcagggaccagggccatctctgtca

SEQ ID NO: 75770 - DNA, 201 bp, Homo sapiens
cgcctgcagaggcaggggcggggcagggggaggaagcggggagccccaaaccccctgccctgcccctgcggtcggccacaggcgggggcagacttgtcccracggggctgagccacccatcgggcctgggtgccagggtggcagggcaggggcagtgcgcacgcggccagaggaaggtgctgagcccacagtttcccctcc

SEQ ID NO: 75771 - DNA, 201 bp, Homo sapiens
tatggcttatgaggccctgcatggcctagcacctggtaacatcgctggcgccctctctttctgctccccctttgaatatcaaatcagtgtttattttgttmtgaggagccataagtcctttttggaacccacaaatgatgccatgaaccactgcattggagaatacagaggtacatggaattttgcataaaaattcatgag

SEQ ID NO: 75772 - DNA, 201 bp, Homo sapiens
cgcatgcgcaatgcaacgtctgccttaggcccggaacttcggtgcctgggcgcagcggtgcacccggacccggaacattctcaggcgaaagtgtctcttgygtgcgtgggccggaggttagtgtgcggggcccgccgggcggttgaaaagtccgagagaatcaggatggaggccgtggcgacggcgacggcggcgaaggaa

SEQ ID NO: 75773 - DNA, 201 bp, Homo sapiens
ttctctagggggacatcagggcagtgccccacaacccacacacaccaccatctcactgggtctagtctcatctcagacaacccccacccccactgtttctsgggttccctttctcatctctcccaccctgtctcctgcctctgtctttcttggtgtctgtctgggcttctttctgtctctttctgtctttctgtctctctc

SEQ ID NO: 75774 - DNA, 201 bp, Homo sapiens
attttggtgctaaaaatgcacgcttaaacaagggtccctggtttaaaatccactagttcatttttaaagtgcttctcttgttctctacctctcacagtctraaatccctccaggagtttttgagtaaaggacatggaacaggcctctaggtggagggatgggtgggactgatggggcagagaccagggctggtttgtttgg

SEQ ID NO: 75775 - DNA, 201 bp, Homo sapiens
cagcaggcatcactgctgttcccaagccagggcccaggaggaaattgggggtggcagggaccacagtgtgttgcctcgggagggcagcagtggccccgacktgtcccccatccgtgcattcagttggcatgtgctgagcatctgtgatgtccacaggctctggggataaggcggggaccaaaaccaacgaaaggcttccct

SEQ ID NO: 75776 - DNA, 201 bp, Homo sapiens
gtgccccaggcctttgacctgggcatccgagggtcccagggagacccagtccttgacagcctcctcctcctgcagcacagtagacgacaaccccgacttckacaacctcgacatcgtggcacgggatgaggaggagaggtactttgatgaggaagaacctgaggatgcgcccagcccagagctggatggggactgatggcc

SEQ ID NO: 75777 - DNA, 201 bp, Homo sapiens
tgtctcttacctgcctgtatttgtgccccatttttaaagagcagagggcctgggccacaggaaaggtatcagcccttggtgataggcacattttttaccartctatcatttggtcattaaatttgtttacaatatactttgctatacgtaaatttgttgtgtaggtttttaaaaagcgatgagagacacagaaattgagtc

SEQ ID NO: 75778 - DNA, 201 bp, Homo sapiens
accttttattccgggcgtcttggtagtttctggtgggattcagtgggtgagagggaagaaggggaggttggggggctccttcccttcagaacttgaagttyctcccactgcctcctctccagtggtctcccaggtgccagacccaaaagcttttcctacagtgataccctttatttttacttccccttgactcatatgttt

SEQ ID NO: 75779 - DNA, 201 bp, Homo sapiens
cctcgtttccccatccctttctctgctggagtctccctctggggggctctgtcctctcctcactttgccctttccctctcgctgctgtgtgtcttggcccsccccccgtgccccccatctcctctgtctcccacactctgggaagcccggctgggatatccaggttggagcctcactggcggccactggaaacccagaatg

SEQ ID NO: 75780 - DNA, 201 bp, Homo sapiens
acacagccccaccgcctccacctccaccaccacctgcctacaactatgggagctacggcggttacaacccggccccctataccccaccgccaccccccacygcacagacctaccctcagcccagctataaccagtatcagcaggtaggtgccagactgggggccaactggatggagagacttccatgggcccctcctgggt

SEQ ID NO: 75781 - DNA, 201 bp, Homo sapiens
ccaacaaggcagctgattccaggcctgctcagtgaccctttctctagggggacatcagggcagtgccccacaacccacacacaccaccatctcactgggtstagtctcatctcagacaacccccacccccactgtttctggggttccctttctcatctctcccaccctgtctcctgcctctgtctttcttggtgtctgtct

SEQ ID NO: 75782 - DNA, 201 bp, Homo sapiens
tacaacagcttgcccagcagaaatacaaaatgcagacgcacaccccagaaatgcagcgcagccacaaacacacggagctaacacgtgctggggacacacayagacaagaccatccataccaaacagcacacaggcccccagaacacccatgccagacgcagctcacgccacaaagcttggaatcacgcacacaataagttc

SEQ ID NO: 75783 - DNA, 201 bp, Homo sapiens
gcctcttctttctacttgtacatttccacctctctaggcctctgctctcactgtccctctctgtctgtctctcagcctttatctctgggttttgatccccsactccaggctctgggccccttcttcccccttccctcaaacctggctgctataggcagcagaaccctgaccactgagtaatacagccccaggggagggagg

SEQ ID NO: 75784 - DNA, 201 bp, Homo sapiens
gtggtggctatagccagaaccgctggggtaacaacaaccgggataacaacaactccaacaacagaggcagctacaaccgggctccccagcaacagccgccrccacagcagcctccgccaccacagccaccaccccagcagccaccgccaccacccagctacagccctgctcggaaccccccaggggccagcacctacaata

SEQ ID NO: 75785 - DNA, 201 bp, Homo sapiens
gccagcttgagtgtagagggaggggggactctacccttctcagccccaccagcccccctctgcccaaccacaattttcccttcctccgccttcctctcccwctcctgtttacactccccaaatgcgcacaggctgttatcatgggtcctgagtcatcccacacacagcctgccccagcgtccctgcccccagctggccgca

SEQ ID NO: 75786 - DNA, 201 bp, Homo sapiens
tcactgggtgtggggaagtgaaacctaggagaaagagcagaaactgagaggcaggagaaagaggaagcaggagagaattcacaagcaggaccatagcagakgggaagaaatggagacagcagagggagacccacctgtggctgctgccatttcttgcctggacagctggtctgtctgtgctcaccctcaccctgacacttc

SEQ ID NO: 75787 - DNA, 201 bp, Homo sapiens
ggactctacccttctcagccccaccagcccccctctgcccaaccacaattttcccttcctccgccttcctctcccactcctgtttacactccccaaatgcrcacaggctgttatcatgggtcctgagtcatcccacacacagcctgccccagcgtccctgcccccagctggccgcagggcccgccccatggagccccctgc

SEQ ID NO: 75788 - DNA, 201 bp, Homo sapiens
taggtggagggatgggtgggactgatggggcagagaccagggctggtttgtttggcatcatcactgggcatccacagaccacctgcctcaggcctggcctstgtgcagcacggaggacagttcctgcctgttctgtgtttggggctcatggggattccaggagcttcatgtttcagccagtgtgtgtgagccacctgctgt

SEQ ID NO: 75789 - DNA, 201 bp, Homo sapiens
gtgttcctggctccttgtgagagacaatgctgggccacaggagaagccaattcagccccaatcttccctggtgggagctcagagccttgtgaaggggagaygggcaacaaaaacaagggagggaaactgactagtctcagaatctcgggtagggcatcagaacgtgagaaggaaccaaggttggtggctaaaagggaccct

SEQ ID NO: 75790 - DNA, 201 bp, Homo sapiens
tgcagatttcctctatttcacagagctttggcttttttccctccactttccagccgagttacagccagccaccctacaaccagggaggttacagccagggytacacagccccaccgcctccacctccaccaccacctgcctacaactatgggagctacggcggttacaacccggccccctataccccaccgccacccccca

SEQ ID NO: 75791 - DNA, 201 bp, Homo sapiens
tcctctatttcacagagctttggcttttttccctccactttccagccgagttacagccagccaccctacaaccagggaggttacagccagggctacacagscccaccgcctccacctccaccaccacctgcctacaactatgggagctacggcggttacaacccggccccctataccccaccgccaccccccaccgcacag

SEQ ID NO: 75792 - DNA, 201 bp, Homo sapiens
cttcctgagtagcagggattacaggtgcccaccaccatgcccagctgatttttgtatttttaatagagagagggtttcaccatgttggccaggctggtctygaatttgtggcctcaagtgatctgcccacctcggcctcccaaagtgctggattacaggcatgagccatggtgcccagccagctttcctgttttctttgcc

SEQ ID NO: 75793 - DNA, 201 bp, Homo sapiens
tggtatgcacaggctcctgtaaaccagagaggttttcagttatcgcacagccatttcccaagcactttcctcatgccgggcctggaatcagctgccaggaraccaatggatggttcccaggcccagctaactagaatatttcttagaacaagagttgggcaggcacagatccaaacccccagccccacaacatcctgtttc

SEQ ID NO: 75794 - DNA, 201 bp, Homo sapiens
gcaggaaggaagcagggttgaaaccctgaagtgttactgcagttggccgttaattggggtgggggcctctttaaagggaaattatttactcattcattaamcaacttaactgagggattcatgtgcctggccccgattttggtgctaaaaatgcacgcttaaacaagggtccctggtttaaaatccactagttcattttta

SEQ ID NO: 75795 - DNA, 201 bp, Homo sapiens
cgcctgtagtcccaagtactccaaaggctgaggcaggaggatcacttgagcacaggaatgtgaggttacttgaactgtgatcgcgccactgcattcgtctrggcgacaaagcgagaccctgtctcaaaaaaaaaaaaaaaaaaaaaaagagtcaaggcttagtaatattcctgaattcctgaaggagttaagaaaggaaaa

SEQ ID NO: 75796 - DNA, 201 bp, Homo sapiens
gtccgaaatccagccaggctcctttcaaagtccttactcaatttctgtgctttcccacaaccttcaaagtaatccgacgtcgggtgaggtgtgattggaakcgtggctccaacaccactggccaagaattggtaattgtggaagccagatggagatgattggtatatggaggtagggggagaattgtcgttgtactttcta

SEQ ID NO: 75797 - DNA, 201 bp, Homo sapiens
ccagcctgggcaagagagagaaacctgatctctataaacatttaaaaattagccaggcctggtggctagggagtagctaggacaagctactcaggagactmaggtgggagtgtcactcgaatcctttgagattgcagtgacctaagattattacaccactgcactccagcctctgcagcagagtgagacttgagcccagga

SEQ ID NO: 75798 - DNA, 201 bp, Homo sapiens
actccccaaatgcgcacaggctgttatcatgggtcctgagtcatcccacacacagcctgccccagcgtccctgcccccagctggccgcagggcccgccccrtggagccccctgccgccctgggctaatgggagccagatggccgcctggtgactcagccaccgggcctgtgggaacccaggcgtcccgccttcccatgccc

SEQ ID NO: 75799 - DNA, 201 bp, Homo sapiens
tccgggcccccctgctatatgagcagtacatcgggcagtatctcacccaggaggagctcagtgcccgcaccccaacccaccagccccccaagcccgggtcycccgggagacctgcttgcccgctctccaacttgctgctccagtcctacgaggagcgggagctacagcagcgtctgctccaacagcaggaggaggaggagg

SEQ ID NO: 75800 - DNA, 201 bp, Homo sapiens
cagagtgagacagcattggagggacaagtgtgcatgcagatgtcctcagacgggaaggtttgagaagggtcagatggtaggcgggcctaacaagggctccstgctagccactgtcccgcacacagacaggatcaggtcatcttgatatggagatcagtccccaaatcactgaattgtcccagcagtgctatgccctaggta

SEQ ID NO: 75801 - DNA, 201 bp, Homo sapiens
gaattgtcccagcagtgctatgccctaggtactaccaatatcactcctctatttcccagaggaggaagcagcagctagactccaggaccttggggtcatayctctcagaaagccaagagtgcaggatgagagctgtctgtctcttacctgcctgtatttgtgccccatttttaaagagcagagggcctgggccacaggaaa

SEQ ID NO: 75802 - DNA, 201 bp, Homo sapiens
gagccagcgtggcaccagccggcaaggggacgcgccgcagacacagcctgcgctgggtatggaggccaacaggcactggccgctcatgatgcaggcggctycatggacgcaccctgtccccctcccctgaaaacaccagcacacaatgtggacccacactcgcagctgctcacaaacacacatccacccctgctgagaacg

SEQ ID NO: 75803 - DNA, 201 bp, Homo sapiens
tgttccctccgccaggaatgcctctcctcccacccttcaggtctcagatcctgacccgaggatacagtctccagagcactatatggtcatgtgttttatgygtgtccctggagggcagggaccagggccatctctgtcactagtgtgttcccagagccacccagcgcaaggctgggcacaggagcagcagctctctgtgga

SEQ ID NO: 75804 - DNA, 201 bp, Homo sapiens
tctttgtcttttggacataataaccagggcactaaggttgctgaggacttgccctctgcacagagagcttcaatcctgagcagctccaggctcagttcccrttcttggaaagccagtgccctggctctggtatgcacaggctcctgtaaaccagagaggttttcagttatcgcacagccatttcccaagcactttcctcat

SEQ ID NO: 75805 - DNA, 201 bp, Homo sapiens
gtcctttttccttggcccagaaatttcatcttgagcctcagtttctttctctttaaaatggggctagtgggacctacccctaggttctatatggagattawatgatgtaatgatccaacctgtacttgggaagcacttagtcaattgccactactgtttctcagcagatcttccagtaacaactaccaccacctgttgagt

SEQ ID NO: 75806 - DNA, 201 bp, Homo sapiens
catgtgggaacacagcatgcagacaccaccttagcacctgctcacagcacccacaggctgggaacaccagtccctgagatggacacacagccccgaagtayagccctccctcacacagacaaacactgagaaccacaggaagcatgctggatgcacaccacgtagacaaacatgctcagaataccagcgacacatgcactg

SEQ ID NO: 75807 - DNA, 201 bp, Homo sapiens
gcattattcacacgcacgcctcaggcgcctgcatgagtactcacgcgcacctcaggtgcctgcatgttttcctgtgtttttgaatgtgtgcatacacacasttggactgtgtatgcacatcatcccacaagcatgatcacacacatacccacatggacactatctgctcagtcgctcaccccatgcccaccctgtctctcc

SEQ ID NO: 75808 - DNA, 201 bp, Homo sapiens
aggctggtcttgaaatcccgacctcaggtgatccacctgccacagcctcccaaagtgctgggattacaggcgcaagccaccgcgcccggcctaagatttakagttattaaagagtggttgggtgaacgcatgaatgcatgagagagtgaatgaatgagtaaacaaattagcaaatgtattaacgatttaaagaattgagtg

SEQ ID NO: 75809 - DNA, 201 bp, Homo sapiens
acgatcttggctcaccgcaacctctgcctcccaggttcaagctattctcctgcctcagcctcccgagtagctgggattacaggcatgtgccacaatggctrattttgtatttttagtagagacggggtttctcccagttggtcaggctggtcttgaaatcccgacctcaggtgatccacctgccacagcctcccaaagtgc

SEQ ID NO: 75810 - DNA, 201 bp, Homo sapiens
cctactgaaatgtcaacttttgctcactgtggtttctctagtgcccagaacagtgcccagaatatagtcagtgcccagtaaatgtgagctgagtgagtgamtaagcccccagtcccttcccacactcccatctctgaactaaccaatctctcctttcctcaggctgcatagagcctggacctgggcactggggtgagctga

SEQ ID NO: 75811 - DNA, 201 bp, Homo sapiens
tgagatccctacctcataccatatacagaggcatcaggggaaaccaaaaggagtatgtacatgaccttggggacacagaagccttctgaacaagacacackgtgaaaaccatgaaggaaaaaaaagatagctttttgaccatgacataattaaaagcatccttgtgaccacaacaccagaaccaaagttaaaagatgagag

SEQ ID NO: 75812 - DNA, 201 bp, Homo sapiens
ccagcctgggcaacagagcgagactccatctcaaaaaactgagtctgctagaggatgccacaaacagctgggggtaagattgctggcaggagtggggaagytgagcaggacagggacagtcacagcctatggtgctgcagaggccaggagtccgagcagtttctttgccctggactctgaagacacggctaggaccagtgg

SEQ ID NO: 75813 - DNA, 201 bp, Homo sapiens
gtgggtagattacttgagctcatgagttcaagaccagcctgggcaacatggcgaaatgctgtctctacaaaaaatacaaaaattagctgggtgtggtggcrccctagctactcagaaggctgaggtgggagaattgcttgagcctgggaggtggaagttgtgtgagctgagatcccaccactaagctctagcctgggcgat

SEQ ID NO: 75814 - DNA, 201 bp, Homo sapiens
gggcgggccccgctgggagacaacccctaggtgggcatccggcccccacccccgtgtctcctgtccgtcctggccctggcctggctcgctggcctggccgmcaccccgccccccacgtctgacacctccatgcgtcctgccaaagcaagctgcctccctgcactcttccccctccagctccagtcactctgtccctctgtc

SEQ ID NO: 75815 - DNA, 201 bp, Homo sapiens
tctccccgtgactttccgtctcccctctctctcctcccttgtttttcccatgcctctccctccctccctccctccctctcctccccaccttttccactccrtgtccccagccattctccatctctgttctcagctcctgtcacctcgtttccccatccctttctctgctggagtctccctctggggggctctgtcctctcc

SEQ ID NO: 75816 - DNA, 201 bp, Homo sapiens
tttacgtgatgggctgacactttctctatttgtatctgtgtatatgtgggctgcagctgctgccaaatgacacagcccatgtgttacgggccctgcaggartctctgtgtgtccacggcggctctgagaggtgaatatttgtgtagtgtggggcaccgtccgtgtttcccgccgtgtgagtgtgtctgcatgtgtacacgc

SEQ ID NO: 75817 - DNA, 201 bp, Homo sapiens
ggcaccgtccgtgtttcccgccgtgtgagtgtgtctgcatgtgtacacgcaccacatcctcatagggctgcagcgattacagccgagtcactgtgtcctakcttgtgactctgcctcttggggccagacctcagcatctctatacctatccatttgttggcatgtccttgcatagtgaactcctgcctccccactcctccc

SEQ ID NO: 75818 - DNA, 201 bp, Homo sapiens
tgcctcccctgttcatgcgattctcctgcctcaggcccctgagtagctgggactacaggtgtgcaccacaatgccagactaatttttttttgtattttttwtttttatttatttatttgagatggagtctcactctgtctcccaggctggagtgaagtggcgtgatctcggctcactgcaacctccacctcccaggttcaa

SEQ ID NO: 75819 - DNA, 201 bp, Homo sapiens
cacagtggctcagacctgtaatcccagcactttgggaggccgaggcaggcaaatcacttgagataaggagttcaagaccagcctggccaacatggtgaaascccggctctactaaaaatacaaaaaaaattagccaggcactgtggcaggtgcctataatcccagctactcaggaggctgaggcaggagaatcacttgaac

SEQ ID NO: 75820 - DNA, 201 bp, Homo sapiens
aactgagtctgctagaggatgccacaaacagctgggggtaagattgctggcaggagtggggaagctgagcaggacagggacagtcacagcctatggtgctrcagaggccaggagtccgagcagtttctttgccctggactctgaagacacggctaggaccagtggaggggagggaccagggcaggtttaactgttatttga

SEQ ID NO: 75821 - DNA, 201 bp, Homo sapiens
cacgtggatgtacacacatacacgccccacagtgaaggcgtgtccactgccagccagactagggccccacaaacaggcacacaacctagagacacacaacytctgctgcattgtcctgcatgctgacacccagacagacaggtgtctgtgggcatatgctgggcctcacaggacatgtgtgtgtacataggccatgtacac

SEQ ID NO: 75822 - DNA, 201 bp, Homo sapiens
atggacgcaccctgtccccctcccctgaaaacaccagcacacaatgtggacccacactcgcagctgctcacaaacacacatccacccctgctgagaacgcraaatcccctcaacgatgatgcaaaacagacccacacaactccacacactgcagtcaccagcctacatgtgggaacacagcatgcagacaccaccttagca

SEQ ID NO: 75823 - DNA, 201 bp, Homo sapiens
ggaacaccagtccctgagatggacacacagccccgaagtacagccctccctcacacagacaaacactgagaaccacaggaagcatgctggatgcacaccaygtagacaaacatgctcagaataccagcgacacatgcactgatcacagtgcaacccagaaacaactcaactcatctgcctcatatgtaagaaacacacacg

SEQ ID NO: 75824 - DNA, 201 bp, Homo sapiens
ggacaggaagctggggctccagccggaacccaggctccccccacgacttccctctgtggccccgggccgcctgcagaggcaggggcggggcagggggaggragcggggagccccaaaccccctgccctgcccctgcggtcggccacaggcgggggcagacttgtcccgacggggctgagccacccatcgggcctgggtgcc

SEQ ID NO: 75825 - DNA, 201 bp, Homo sapiens; identical to SEQ ID NO: 48461

SEQ ID NO: 75826 - DNA, 201 bp, Homo sapiens; identical to SEQ ID NO: 8984

SEQ ID NO: 75827 - DNA, 201 bp, Homo sapiens
atgacgcatgcgctgcgcttagaggcggggttaagtcggacctgaactcataacgcatgcgccttatggagcttgctgggggagggaagcggggtggctgrcgtgacgcggaaggcgggtcttttgcgctcgtgggcggagccatagccccttcgggcggggctttccgccgacctgaacccgaaaaggttattttggact

SEQ ID NO: 75828 - DNA, 201 bp, Homo sapiens
cactgcactccagcctgggcgacagagggagactctgtcaaaaaaaaaaaaaaaaaaaaaacccggccggtcacggtggctaacgcctgtaatcccagcaytttgggaggctgaggcgggtggaccacctgaggtcaggagtttgagaccggtctggccaatatggtgaaaacccgtctctactaaaaatacaaaaattag

SEQ ID NO: 75829 - DNA, 201 bp, Homo sapiens; identical to SEQ ID NO: 48462

SEQ ID NO: 75830 - DNA, 201 bp, Homo sapiens; identical to SEQ ID NO: 48463

SEQ ID NO: 75831 - DNA, 201 bp, Homo sapiens; identical to SEQ ID NO: 48464

SEQ ID NO: 75832 - DNA, 201 bp, Homo sapiens; identical to SEQ ID NO: 48465

SEQ ID NO: 75833 - DNA, 201 bp, Homo sapiens; identical to SEQ ID NO: 48466

SEQ ID NO: 75834 - DNA, 201 bp, Homo sapiens; identical to SEQ ID NO: 48467

SEQ ID NO: 75835 - DNA, 201 bp, Homo sapiens; identical to SEQ ID NO: 48468

SEQ ID NO: 75836 - DNA, 201 bp, Homo sapiens; identical to SEQ ID NO: 8995

SEQ ID NO: 75837 - DNA, 201 bp, Homo sapiens; identical to SEQ ID NO: 48543

SEQ ID NO: 75838 - DNA, 201 bp, Homo sapiens
cactccagcctggatgacagggggagacgccatctcaaaaagtaaaaaaccaaaattataacgagggtacaacatttcaataggataacatttatattaawcaattcaacggaatacttcactagttgatatatgcattattaatggggtctccctatattcgaacttctggcctcaagagctcttcccgcctcagccttc

SEQ ID NO: 75839 - DNA, 201 bp, Homo sapiens
caattaggatctgtggtcaagacctcagcctcaggggtgtgacgaagctagcttggaatcctagtactaccctttacttgctgggcctcagtttccccccytgtcaaatggagataatacagttacctcacagggttgtgattatatttttcccctcccagggccatggctgaggtgcacgtgatcgggcagatcatgggg

SEQ ID NO: 75840 - DNA, 201 bp, Homo sapiens; identical to SEQ ID NO: 9000

SEQ ID NO: 75841 - DNA, 201 bp, Homo sapiens; identical to SEQ ID NO: 48546

SEQ ID NO: 75842 - DNA, 201 bp, Homo sapiens; identical to SEQ ID NO: 48471

SEQ ID NO: 75843 - DNA, 201 bp, Homo sapiens; identical to SEQ ID NO: 48472

SEQ ID NO: 75844 - DNA, 201 bp, Homo sapiens; identical to SEQ ID NO: 48473

SEQ ID NO: 75845 - DNA, 201 bp, Homo sapiens; identical to SEQ ID NO: 48474

SEQ ID NO: 75846 - DNA, 201 bp, Homo sapiens; identical to SEQ ID NO: 48475

SEQ ID NO: 75847 - DNA, 201 bp, Homo sapiens; identical to SEQ ID NO: 48477

SEQ ID NO: 75848 - DNA, 201 bp, Homo sapiens
ttttttttagaggtgcagtcttactttgttgcccaggctggagtgcagggtgccatcatagctcactgcagcctggacttcctgcactcaaggcatcctcyggcttcagcctccaaagtagccgggatggccaggcgcggccatacatggcaaaaccccatctctactaattagctgggcgtggcggcaggtgccttcaat

SEQ ID NO: 75849 - DNA, 201 bp, Homo sapiens; identical to SEQ ID NO: 48479

SEQ ID NO: 75850 - DNA, 201 bp, Homo sapiens; identical to SEQ ID NO: 8987

SEQ ID NO: 75851 - DNA, 201 bp, Homo sapiens
gggaggctgaggcaggagaattgcttgagcctgggaggcagaagttgctgtgagccctggcccacagaacgagactctgtctcaaaaaaacccaataaccmccccccccaaaaaaaaggtgacaggttttcactctgtcacccaggctgaagtaccttggcatgatcacagctcactgcagcctcaaactcctgggctcaa

SEQ ID NO: 75852 - DNA, 201 bp, Homo sapiens; identical to SEQ ID NO: 8989

SEQ ID NO: 75853 - DNA, 201 bp, Homo sapiens; identical to SEQ ID NO: 8990

SEQ ID NO: 75854 - DNA, 201 bp, Homo sapiens
cccctgtcaaatggagataatacagttacctcacagggttgtgattatatttttcccctcccagggccatggctgaggtgcacgtgatcgggcagatcatrggggccagcggtttctcggaaagtagcctcttctgcaagtggggcattcacacaggtattcccccaagcctggttcatttccacaccaagacccctagcc

SEQ ID NO: 75855 - DNA, 201 bp, Homo sapiens; identical to SEQ ID NO: 48485

SEQ ID NO: 75856 - DNA, 201 bp, Homo sapiens; identical to SEQ ID NO: 8991

SEQ ID NO: 75857 - DNA, 201 bp, Homo sapiens; identical to SEQ ID NO: 48488

SEQ ID NO: 75858 - DNA, 201 bp, Homo sapiens; identical to SEQ ID NO: 48551

SEQ ID NO: 75859 - DNA, 201 bp, Homo sapiens; identical to SEQ ID NO: 48491

SEQ ID NO: 75860 - DNA, 201 bp, Homo sapiens; identical to SEQ ID NO: 48493

SEQ ID NO: 75861 - DNA, 201 bp, Homo sapiens
ctagttgatatatgcattattaatggggtctccctatattcgaacttctggcctcaagagctcttcccgcctcagccttccaaagggctgggattacagtyatgagccaccgcgcctagccaatggtagcttgtaaatactttgtatctattggcctggctgggtggctcacgcctgtaatcccggcagtttgggagggag

SEQ ID NO: 75862 - DNA, 201 bp, Homo sapiens
ctggatgacagggggagacgccatctcaaaaagtaaaaaaccaaaattataacgagggtacaacatttcaataggataacatttatattaaacaattcaayggaatacttcactagttgatatatgcattattaatggggtctccctatattcgaacttctggcctcaagagctcttcccgcctcagccttccaaagggct

SEQ ID NO: 75863 - DNA, 201 bp, Homo sapiens; identical to SEQ ID NO: 48494

SEQ ID NO: 75864 - DNA, 201 bp, Homo sapiens; identical to SEQ ID NO: 8996

SEQ ID NO: 75865 - DNA, 201 bp, Homo sapiens; identical to SEQ ID NO: 48496

SEQ ID NO: 75866 - DNA, 201 bp, Homo sapiens; identical to SEQ ID NO: 48563

SEQ ID NO: 75867 - DNA, 201 bp, Homo sapiens
gaataaactctatagttaatcatattttcctttcttttcttttttttcttttttgagagtagaagtctggctctgtcgcccaggctgaagtgcggtggcgygatctcggctcactgcaactgctgcctcccaggttcaagtgatgctcctgcctcagcttcccaaatagctgacaccacaggcatgtgccaccacacccat

SEQ ID NO: 75868 - DNA, 201 bp, Homo sapiens; identical to SEQ ID NO: 48565

SEQ ID NO: 75869 - DNA, 201 bp, Homo sapiens; identical to SEQ ID NO: 8982

SEQ ID NO: 75870 - DNA, 201 bp, Homo sapiens; identical to SEQ ID NO: 48500

SEQ ID NO: 75871 - DNA, 201 bp, Homo sapiens; identical to SEQ ID NO: 48501

SEQ ID NO: 75872 - DNA, 201 bp, Homo sapiens; identical to SEQ ID NO: 48502

SEQ ID NO: 75873 - DNA, 201 bp, Homo sapiens; identical to SEQ ID NO: 48503

SEQ ID NO: 75874 - DNA, 201 bp, Homo sapiens; identical to SEQ ID NO: 48504

SEQ ID NO: 75875 - DNA, 201 bp, Homo sapiens; identical to SEQ ID NO: 48505

SEQ ID NO: 75876 - DNA, 201 bp, Homo sapiens; identical to SEQ ID NO: 48506

SEQ ID NO: 75877 - DNA, 201 bp, Homo sapiens; identical to SEQ ID NO: 48508

SEQ ID NO: 75878 - DNA, 201 bp, Homo sapiens
aattagtagcgcgcagagcgagtacaaagctaggggaggagcctgctgttgccccagcaacaaccacggaaaccaagacgagcgcggtcgcggaagtatcrcggcttacatatctcgcagccaggcgggtcctgggagaggcgcgagccaggcctggtcggcgcccgcggagaaaagaagcagtcaagcccatgaactaca

SEQ ID NO: 75879 - DNA, 201 bp, Homo sapiens
accaagacgagcgcggtcgcggaagtatcgcggcttacatatctcgcagccaggcgggtcctgggagaggcgcgagccaggcctggtcggcgcccgcggaraaaagaagcagtcaagcccatgaactacaaccccggttgccgctttctcctctcctaaccgttaagtgcgctaaggtaggaatgacgcatgcgctgcgct

SEQ ID NO: 75880 - DNA, 201 bp, Homo sapiens; identical to SEQ ID NO: 8998

SEQ ID NO: 75881 - DNA, 201 bp, Homo sapiens; identical to SEQ ID NO: 48516

SEQ ID NO: 75882 - DNA, 201 bp, Homo sapiens; identical to SEQ ID NO: 48517

SEQ ID NO: 75883 - DNA, 201 bp, Homo sapiens; identical to SEQ ID NO: 48518

SEQ ID NO: 75884 - DNA, 201 bp, Homo sapiens; identical to SEQ ID NO: 48519

SEQ ID NO: 75885 - DNA, 201 bp, Homo sapiens; identical to SEQ ID NO: 48520

SEQ ID NO: 75886 - DNA, 201 bp, Homo sapiens
gtggtgactcacccctgtaatgccagcactttgggagactggagcaggaggatcacttgagcccaggagtttgagaccagcctgggcaacatagtgagacmcccgtctctacaaataaataaaaaattagcaaagcatagtgctgtgtgcctgtcgtcccaactacttgggaggttgaggtgggaggattgcttgatcctg

SEQ ID NO: 75887 - DNA, 201 bp, Homo sapiens
agcctgaccaacatggtggaactccatctctactaaaagcacaaacattagctagatatagtggtgggtgcctgcaatcccagctactaaggaggctgagrcagaagaattgcttgaacctgggaggcggaggttgtggtgagcagagatcatgccactgcactccagcctgggcgacagagggagactctgtcaaaaaaa

SEQ ID NO: 75888 - DNA, 201 bp, Homo sapiens
gctcctgcctcagcttcccaaatagctgacaccacaggcatgtgccaccacacccatctagttttggtattttttagtagagacagggtttcgctatatgktggccaggctggtctcgaactcctgacctcagggtatccactctccttggcctcccaaagtgctgggattacgggcatgaaccaccgaatccggcctcaa

SEQ ID NO: 75889 - DNA, 201 bp, Homo sapiens
cactgcactccagcctgggtaacagagcaagatctgtttgttgttgttttgttttgtttttgagactttgtctcactcttgtcccccaggatggagtgcartggcacgatctcagatcactgcaacctccgcctcccaggttcaagtgattctcctgcctcagcctcccgagtacttgggattacaggcgcccgccgccat

SEQ ID NO: 75890 - DNA, 201 bp, Homo sapiens
gctgtgattgtgccactgcactccagcctgggtaacagagcaagatctgtttgttgttgttttgttttgtttttgagactttgtctcactcttgtcccccrggatggagtgcaatggcacgatctcagatcactgcaacctccgcctcccaggttcaagtgattctcctgcctcagcctcccgagtacttgggattacagg

SEQ ID NO: 75891 - DNA, 201 bp, Homo sapiens
acctcagcctcaggggtgtgacgaagctagcttggaatcctagtactaccctttacttgctgggcctcagtttccccccctgtcaaatggagataatacasttacctcacagggttgtgattatatttttcccctcccagggccatggctgaggtgcacgtgatcgggcagatcatgggggccagcggtttctcggaaagt

SEQ ID NO: 75892 - DNA, 201 bp, Homo sapiens; identical to SEQ ID NO: 48584

SEQ ID NO: 75893 - DNA, 201 bp, Homo sapiens; identical to SEQ ID NO: 48531

SEQ ID NO: 75894 - DNA, 201 bp, Homo sapiens
cgggccccctctgtgtcagccccaagtatggctgcaacttcaacaatgggggctgccaccaggactgctttgaagggggggatggctccttcctctgcggytgccgaccaggattccggctgctggatgacctggtgacctgtgcctctcgaaacccttgcagctccagcccatgtcgtgggggggccacgtgcgtcctgg

SEQ ID NO: 75895 - DNA, 201 bp, Homo sapiens
aaatgtcagtaatcacttcatgaacgctaaatgagaatgtaagtatttttaaatgtgtgtatttcaaatttgtttgactaattctggaattacaagatttytatgcaggatttaccttcatcctgtgcatgtttcccaaactgtgaggagggaaggctcagagatcgagcttctcctctgagttctaacaaaatggtgctt

SEQ ID NO: 75896 - DNA, 201 bp, Homo sapiens
tccggatcagggtgtgaggaggctggggctaaggggctcccctgaatatcttctctgctcacttccaccatctaagaggaaaaggtgagttgctcatgctsattaggattgaaatgatttgtttctcttcctaggatgaaaactaaatcaattaattattcaattaggtaagaagatctggttttttggtcaaagggaaca

SEQ ID NO: 75897 - DNA, 201 bp, Homo sapiens
ccccagtgggtcctcaggcgtctggagggagcccagcatccatcacgccacagctgcctctggcccccaggagcctgcaggtggggactcctccgtggccrcacaaaacaacgatggcactgacgggcaaaagctgcttttattctacatcctaggcaccgtggtggccatcctactcctgctggccctggctctggggct

SEQ ID NO: 75898 - DNA, 201 bp, Homo sapiens
atgctaatggtacaggacacttgcaataaatatccattatttagggttaaatgcagctgatcctgttagaagtctattcattaacaacatacacttggaarttattcctcgatatgaacaaccatggctgttcccccaacacacacacccacacacataaacacacacatgcatgacacagagatatgcatccacaaacac

SEQ ID NO: 75899 - DNA, 201 bp, Homo sapiens
ctggccttggtgaggcccagcaccctcctgtcaccttcctgcaaagcctgcttgcctctgccactggccttacgcctgtccacatagttcatattgtaagrtctgaagccaagcctgtgacctgtctctgtggggctcctactgtgttcaagtatcatgaaataatgaaatttgtgaggtggaagaaaataattgggacgt

SEQ ID NO: 75900 - DNA, 201 bp, Homo sapiens
ggagaaccagtacaggtaaagggggccctgagtgaccgggggaggggatgggcaggcatgggggcactgactacagtacaaagaggtggcagcaagagcargcccaggtttcctgtgggcagacacaccctggtccttgcagctgacccctcaacctccccccacgccaggcactcgggcccccttagagcatactgccca

SEQ ID NO: 75901 - DNA, 201 bp, Homo sapiens
gggcacccccaaggctacacccaccacaagtagaccttcgctgtcatctgacgcccccatcacatctgccccactcaagatgctggcccccagtgggtccycaggcgtctggagggagcccagcatccatcacgccacagctgcctctggcccccaggagcctgcaggtggggactcctccgtggccacacaaaacaacga

SEQ ID NO: 75902 - DNA, 201 bp, Homo sapiens
aggacagatggtcaatcgatgagcctcccccaagggcagacgggtgtcctcgagtggggttgcctgcagcaatcctggcatctttgtgcccagggtgaacyttgtagcacccctcacctctgtacaacacaatgactttcagaaatcatcatgtcataatcaatattagtgattttcctagttttttaagttttaaagcaa

SEQ ID NO: 75903 - DNA, 201 bp, Homo sapiens
acacggtgcttgtgttgcttcctgtgtcttcttgtgctgcctcctgcatctcccctgacccacaccccaacccaactctcctcccatcagggatctcttasgaagtggctgtcttgataggaataaactggacatgggtcagacgagagccacaagggtgtctgtccatagaaacaagttttatgtgagagagacccctgg

SEQ ID NO: 75904 - DNA, 201 bp, Homo sapiens
agaaggaaggagagatgagggagagaagagagagagagaacacaaaagggggtagaggaatgtcccaggtgtggtggtcacaatcaggtctcacaaagctrggcttggagcctgagaaggaagggctgagtttctcagggcgtgccggtgcgaatttcaggccacttcgttctgctggccttggtgaggcccagcaccctc

SEQ ID NO: 75905 - DNA, 201 bp, Homo sapiens
atggggtctcttgcaccatggggcctgtgtctctgggaccaccatctgggccccccgatgaggaggacaaaggagagaaagaagggagcaccgtgccccgygctgcaacagccagtcccacaaggggccccgagggcacccccaaggctacacccaccacaagtagaccttcgctgtcatctgacgcccccatcacatctg

SEQ ID NO: 75906 - DNA, 201 bp, Homo sapiens
ggaaatggtgcaaaacatgccagggtcatcacatctgaaagccaagggagtggtgtgtagatacccattggtaatgagtagagggctgccctgggtggagktggcgggtaattcccagcacttccagatgaccacacatgtgggcaaagtggccttccacacttaggatggggaaaccttcaggtacagatgcaggccctg

SEQ ID NO: 75907 - DNA, 201 bp, Homo sapiens
agttcatagtccacagttgatgcagcatcctgagattttaaatcctgaagtgtgggtggcgcacacaccaagtagggagctagtcaggcagtttgcttaargaacttttgttctctgtctcttttccttaaaattgggggtaaggagggaaggaagagggaaagagatgactaactaaaatcatttttacagcaaaaactg

SEQ ID NO: 75908 - DNA, 201 bp, Homo sapiens
agctccggaactcgtgcatctccaagcgctgtgtgtctctgctgctggacctgtcccagccgctccttcccagccgcctccccaagtggtctgagggcccstgtgggagcccaggctcccccggaagtaacattgagggcttcgtgtgcaagttcagcttcaaaggcatgtgccggcctctggccctggggggcccaggtc

SEQ ID NO: 75909 - DNA, 201 bp, Homo sapiens
ccatttttccccgagtgctttggcaattttcttattctctgttgagttctgaggtttcgcttcaggttgcaggtgtggttcctttctggtcccgcctgcamtaggtgagctcttcccagcacaggagggcatttccttctagctgtatttgaacctgagcatgtgtctgaatcctctggaacctcctgcagggctccttaa

SEQ ID NO: 75910 - DNA, 201 bp, Homo sapiens
gacaaagatctgggggtcagagtggctaacatgctgaaagtcactcatttagcccatatccttaagcaccaactaagtagaatgctgagcgaatgctgcakatcacaatctacctctgaggaatctacctccgagctgcacaaacaggggcctagaccacgagaacggctccctgctatgagtggatgctagggctgcaga

SEQ ID NO: 75911 - DNA, 201 bp, Homo sapiens
accatataccatgttatgccaggaaatacgcagtgtgctttgtttccctttttaatttaatttttagttacaaaaaaaaaaaaaaaggaaaaagacaggcyggatgcctgaatgatccacaaaccaattagtctgctcccaaataactgagattaaactcgccccatatttgagatcagaacattccattccagcatcgtg

SEQ ID NO: 75912 - DNA, 201 bp, Homo sapiens
gggcagacgggtgtcctcgagtggggttgcctgcagcaatcctggcatctttgtgcccagggtgaaccttgtagcacccctcacctctgtacaacacaatractttcagaaatcatcatgtcataatcaatattagtgattttcctagttttttaagttttaaagcaaacgattaataaaggacaaatttcaattttacaa

SEQ ID NO: 75913 - DNA, 201 bp, Homo sapiens
acacccacctcctggtgaccatttccctgtgggacaggcagatacagcccatttgatggtctcagtgactccacaccccacagggacttcccagacatgcygccatgcccacctctcagccacagggaccccacggagcccgtgtctgtttgctctaaacccaccagtgagaagtccccttgggaaacctgcttgggaaac

SEQ ID NO: 75914 - DNA, 201 bp, Homo sapiens
ggtgagtgtttgtgacccagacagctccccactttttgctggccccgtggggtgcactgccctctccctgggatctgtaagtgacacggtgcttgtgttgyttcctgtgtcttcttgtgctgcctcctgcatctcccctgacccacaccccaacccaactctcctcccatcagggatctcttaggaagtggctgtcttgat

SEQ ID NO: 75915 - DNA, 201 bp, Homo sapiens
gcgtgccacggtggggatttcgtgactctataatgattgttactccccctcccttttcaaattccaatgtgaccaattccggatcagggtgtgaggaggcyggggctaaggggctcccctgaatatcttctctgctcacttccaccatctaagaggaaaaggtgagttgctcatgctgattaggattgaaatgatttgttt

SEQ ID NO: 75916 - DNA, 201 bp, Homo sapiens
ctgggaggcctcatgtctcctgtgggctttttaccaccactgtgcaggagaacagacagaggaaatgtgtctccctccaaggccccaaagcctcagagaargggtgtttctggttttgccttagcaatgcatcggtctctgaggtgacactctggagcggttgaagggccacaaggtgcagggttaatactcttgccagtt

SEQ ID NO: 75917 - DNA, 201 bp, Homo sapiens
agaggaaatgtgtctccctccaaggccccaaagcctcagagaaagggtgtttctggttttgccttagcaatgcatcggtctctgaggtgacactctggagyggttgaagggccacaaggtgcagggttaatactcttgccagttttgaaatatagatgctatggttcagattgtttttaatagaaaactaaaggggcaggg

SEQ ID NO: 75918 - DNA, 201 bp, Homo sapiens
ctcaggcgtctggagggagcccagcatccatcacgccacagctgcctctggcccccaggagcctgcaggtggggactcctccgtggccacacaaaacaacratggcactgacgggcaaaagctgcttttattctacatcctaggcaccgtggtggccatcctactcctgctggccctggctctggggctactggtctatcg

SEQ ID NO: 75919 - DNA, 201 bp, Homo sapiens
cacagaggcgccatggcttccaacgctgtctgttttgtttcccatagtccgacacctgggacagactgctgaaagtgaggtggccctagagacactagagwcaccagccaccatcctcagagctttgaactccccattccaaaggggcacccacatttttttgaaagactggactggaatcttagcaaacaattgtaagtc

SEQ ID NO: 75920 - DNA, 201 bp, Homo sapiens
aaagttgtccactctaacaggactccaggatcacagaggcagggatcccctcctggaatccagtgcctcactcagtgcatagcagggtcttaatcaacaawtgttagatgggtggatggacaaacagatggatgaatgaaggggcacagggagggtctggtggcttctatggagagttcccaaaatgtctcaaatatcttt

SEQ ID NO: 75921 - DNA, 201 bp, Homo sapiens
gagcagtgtaccaggtagggtgggctagcacaccctcctggtgggcctgtgtgagcctcgatgctgtccagggcctcttcctccaccatctgccacctgtsccctgtctccagctcatggcacggcctgcactcaagtcttcactattgctgctctgaattgtggccgccatatccagctggtctggggctctttgcactc

SEQ ID NO: 75922 - DNA, 201 bp, Homo sapiens
cagggtcccctcctgggggatcccaaccaatgagcaaaggtctgtggctgcaggaaaagcacactgtgagtccctggcttttgccgagtcgcggtgtcgcrggagggcctgcccgggcttcgattcccgctccctgcccagatttccggcccttgctaggaatcctgagccgggggaagtgagcctgcaagccctgcgcca

SEQ ID NO: 75923 - DNA, 201 bp, Homo sapiens
ctctgcgccggagtggctgcagctcacccctcagctccccttggggcccagctgggagccgagatagaagctcctgtcgccgctgggcttctcgcctcccrcagagggccacacagagaccgggatggccacctccatgggcctgctgctgctgctgctgctgctcctgacccagcccggggcggggacgggagctgacac

SEQ ID NO: 75924 - DNA, 201 bp, Homo sapiens
tccagggcctcttcctccaccatctgccacctgtcccctgtctccagctcatggcacggcctgcactcaagtcttcactattgctgctctgaattgtggcygccatatccagctggtctggggctctttgcactccagctcccagaaacagagcctgagagaaggactcaccatcctgtggttcactgggaagcacaggga

SEQ ID NO: 75925 - DNA, 201 bp, Homo sapiens
aatcctgtctcagggtcccctcctgggggatcccaaccaatgagcaaaggtctgtggctgcaggaaaagcacactgtgagtccctggcttttgccgagtckcggtgtcgcaggagggcctgcccgggcttcgattcccgctccctgcccagatttccggcccttgctaggaatcctgagccgggggaagtgagcctgcaag

SEQ ID NO: 75926 - DNA, 201 bp, Homo sapiens
tgggcgggggggaggacacgccttactctaactggcacaaggagctccggaactcgtgcatctccaagcgctgtgtgtctctgctgctggacctgtcccakccgctccttcccagccgcctccccaagtggtctgagggcccctgtgggagcccaggctcccccggaagtaacattgagggcttcgtgtgcaagttcagct

SEQ ID NO: 75927 - DNA, 201 bp, Homo sapiens
tgataggaataaactggacatgggtcagacgagagccacaagggtgtctgtccatagaaacaagttttatgtgagagagacccctggtcactgggcagggmtagaatttatagtcagtctctcaaagtgagagatacagcctgctaccaatgacaggggacttggagagcagtggagcctctccctcagctgagatggtgc

SEQ ID NO: 75928 - DNA, 201 bp, Homo sapiens
taaaactccaccaaatccctcccaggaaaagcaagctcttcatcctcccctgaggtcgaagcaccatgccctcagcctctacgaatcccctgaacagcctytaaggagcgtcccctataggtgggagcggacacagaagggcggggctggagctagagaacctagctgtaagtgtcccaggtgaattaacccacctgagcc

SEQ ID NO: 75929 - DNA, 201 bp, Homo sapiens
tacatttgcaaatatttctccctatgataatgtagtcgatagtgtgcactctttctctctctctctctctctcacacacacacacacacacacacacacasagacacggcaccattctgcctggggcactggaacacattcctgggggtcaccgatggtcagagtcactagaagttacctgagtatctctgggaggcctca

SEQ ID NO: 75930 - DNA, 201 bp, Homo sapiens
catttaaattatatcctcattttaaaagttacatttgcaaatatttctccctatgataatgtagtcgatagtgtgcactctttctctctctctctctctcwcacacacacacacacacacacacacacacagacacggcaccattctgcctggggcactggaacacattcctgggggtcaccgatggtcagagtcactaga

SEQ ID NO: 75931 - DNA, 201 bp, Homo sapiens
ggcttcctccttgtctgtttcacttcccctcccacataaactagtctccccaaatcctgtctcagggtcccctcctgggggatcccaaccaatgagcaaargtctgtggctgcaggaaaagcacactgtgagtccctggcttttgccgagtcgcggtgtcgcaggagggcctgcccgggcttcgattcccgctccctgccc

SEQ ID NO: 75932 - DNA, 201 bp, Homo sapiens
tcctaaaggatgtgtgaacgggagatgatgcactgtgttttgaaagttgtcattttaaagcattttagcacagttcatagtccacagttgatgcagcatcytgagattttaaatcctgaagtgtgggtggcgcacacaccaagtagggagctagtcaggcagtttgcttaaggaacttttgttctctgtctcttttcctta

SEQ ID NO: 75933 - DNA, 201 bp, Homo sapiens
gacacgccttactctaactggcacaaggagctccggaactcgtgcatctccaagcgctgtgtgtctctgctgctggacctgtcccagccgctccttcccakccgcctccccaagtggtctgagggcccctgtgggagcccaggctcccccggaagtaacattgagggcttcgtgtgcaagttcagcttcaaaggcatgtgc

SEQ ID NO: 75934 - DNA, 201 bp, Homo sapiens
ccaaggtggggacgtgcaggcacagaggcgccatggcttccaacgctgtctgttttgtttcccatagtccgacacctgggacagactgctgaaagtgaggkggccctagagacactagagtcaccagccaccatcctcagagctttgaactccccattccaaaggggcacccacatttttttgaaagactggactggaatc

SEQ ID NO: 75935 - DNA, 201 bp, Homo sapiens
ttatttctcttcttagcttctccattgtctaaatcaggaaaacaggaaaacacagctttctagcagctgcaaaatggtttaatgccccctacatatttccrtcaccttgaacaatagctttagcttgggaatctgagatatgatcccagaaaacatctgtctctacttcggctgcaaaacccatggtttaaatctatatgg

SEQ ID NO: 75936 - DNA, 201 bp, Homo sapiens
atgagcggttgtccctctctgagttctggtagttgggttctatttgaggtttgtcgtgattaacttggatgatgatgttctcttgtggttaaaattggttyatagaattcaactgagtggaagaaaggatggaagggaggaaaagaggaagggaggaagggagggagagggaggaagggagggagagggaggagggaggga

SEQ ID NO: 75937 - DNA, 201 bp, Homo sapiens
taattgggacgtctaccttctttctccagggtctggctttcccaaaaacgttatatcacaaatgttttacttcattgttgaaatcgctgcctcctgtcccrcgtgtgtttgtcggggtgtcacgcccttgtctgctttccttctcatccgtcctgcaagtcctcatgccctggcctccatccaggccctcatcccccatgg

SEQ ID NO: 75938 - DNA, 201 bp, Homo sapiens
tgcctcctgtcccgcgtgtgtttgtcggggtgtcacgcccttgtctgctttccttctcatccgtcctgcaagtcctcatgccctggcctccatccaggccytcatcccccatggctgtggcttcgtcagcttctcctcggatttccaccagttttgtcttctatttacagccgcgtggtgaagggactaatatgtgtttgg

SEQ ID NO: 75939 - DNA, 201 bp, Homo sapiens
gcaggctgggtccctctcctgctgggtggtgctttctcttgcacaccactcccaccacggggggagagccagcaacccaaccagacagctcaggttgtgcmtctgatggaaaccactgggctcaaacacgtgctttattctcctgtttatttttgctgttactttgaagcatggaaattcttgtttgggggatcttggggc

SEQ ID NO: 75940 - DNA, 201 bp, Homo sapiens
ctagaatttatagtcagtctctcaaagtgagagatacagcctgctaccaatgacaggggacttggagagcagtggagcctctccctcagctgagatggtgytgaggtgtggtcccctcaggcccccagagtttcctggcactggctccagcagcccagggtcaccttctcagcaagtcatcatgggttggcttcctccttg

SEQ ID NO: 75941 - DNA, 201 bp, Homo sapiens
gtgttggcgtgccacggtggggatttcgtgactctataatgattgttactccccctcccttttcaaattccaatgtgaccaattccggatcagggtgtgasgaggctggggctaaggggctcccctgaatatcttctctgctcacttccaccatctaagaggaaaaggtgagttgctcatgctgattaggattgaaatgat

SEQ ID NO: 75942 - DNA, 201 bp, Homo sapiens
gtagcacccctcacctctgtacaacacaatgactttcagaaatcatcatgtcataatcaatattagtgattttcctagttttttaagttttaaagcaaacrattaataaaggacaaatttcaattttacaaaaatgttattcaaattctgttaagcgcctcatgtatgaactaaaatctgtactgacaaacaaaaatatca

SEQ ID NO: 75943 - DNA, 201 bp, Homo sapiens
ggcatgtgccggcctctggccctggggggcccaggtcaggtgacctacaccacccccttccagaccaccagttcctccttggaggctgtgccctttgcctmtgcggccaatgtagcctgtggggaaggtgacaaggacgagactcagagtcattatttcctgtgcaaggagaaggcccccgatgtgttcgactggggcagc

SEQ ID NO: 75944 - DNA, 201 bp, Homo sapiens
ctgtttcacttcccctcccacataaactagtctccccaaatcctgtctcagggtcccctcctgggggatcccaaccaatgagcaaaggtctgtggctgcargaaaagcacactgtgagtccctggcttttgccgagtcgcggtgtcgcaggagggcctgcccgggcttcgattcccgctccctgcccagatttccggccct

SEQ ID NO: 75945 - DNA, 201 bp, Homo sapiens
ttaagcaatatgggtatttttaataatatgttcaaacaaacttacttgggcttgtgtatgtaccccccaaacacacacacacacacacacacacacacgcrcacacacactggggtagaactactcaaaagccctctgatcagaaagattgtgcatcctgagacctgccttgcctgctctgagggcagatcccagggaacg

SEQ ID NO: 75946 - DNA, 201 bp, Homo sapiens
catggctgtggcttcgtcagcttctcctcggatttccaccagttttgtcttctatttacagccgcgtggtgaagggactaatatgtgtttggcagatttcrtccttcaccaataaaaaatatacctttttgaaccttttcacttcaaattatattatatatgactttacaactgatatacccgattcattctgctgcatct

SEQ ID NO: 75947 - DNA, 201 bp, Homo sapiens
ttttcacttcaaattatattatatatgactttacaactgatatacccgattcattctgctgcatctgatgaatatctggtattttttccctaaattcagcyttctggtgacacttcatgtttgtctcttgtaaacaacaaagctggatttcactttttttttcttttattcaatcaaaagtctttgtcttttaatgggaga

SEQ ID NO: 75948 - DNA, 201 bp, Homo sapiens
gtggtcaattctgagtcagcctgcttttaagattgtgcaaaaggctgtggcaaaggcacaggacttaagaagaacaaagggttctgctctgttatgctaayggtacaggacacttgcaataaatatccattatttagggttaaatgcagctgatcctgttagaagtctattcattaacaacatacacttggaagttattcc

SEQ ID NO: 75949 - DNA, 201 bp, Homo sapiens
atccaaatgtactgaggttaccacacacttgactacggatgtgatcaacactaacaaggaaacaaattcaaggacaacctgtctttgagccagggcaggcytcagacaccctgcctgtggccccgcctccacttcatcctgcccggaatgccagtgctccgagctcagacagaggaagccctgcagaaagttccatcaggc

SEQ ID NO: 75950 - DNA, 201 bp, Homo sapiens
gcttcgtcagcttctcctcggatttccaccagttttgtcttctatttacagccgcgtggtgaagggactaatatgtgtttggcagatttcgtccttcaccrataaaaaatatacctttttgaaccttttcacttcaaattatattatatatgactttacaactgatatacccgattcattctgctgcatctgatgaatatc

SEQ ID NO: 75951 - DNA, 201 bp, Homo sapiens
agaagtctattcattaacaacatacacttggaagttattcctcgatatgaacaaccatggctgttcccccaacacacacacccacacacataaacacacayatgcatgacacagagatatgcatccacaaacacacacaacacacacccacaagacacacacccacaagcacacacagttctaacatccttctgtgtcgta

SEQ ID NO: 75952 - DNA, 201 bp, Homo sapiens
tgaaggcagcaggagtcagagaactattcattgcaggaagccccaacatccggtgagaaataagaagtacaacagtacaggatgcgccttgggtcaggggracgtggaaagccctcagcctttgtgtccttctctgcgccggagtggctgcagctcacccctcagctccccttggggcccagctgggagccgagatagaag

SEQ ID NO: 75953 - DNA, 201 bp, Homo sapiens
accctgcctgtggccccgcctccacttcatcctgcccggaatgccagtgctccgagctcagacagaggaagccctgcagaaagttccatcaggctgtttcytaaaggatgtgtgaacgggagatgatgcactgtgttttgaaagttgtcattttaaagcattttagcacagttcatagtccacagttgatgcagcatcctg

SEQ ID NO: 75954 - DNA, 201 bp, Homo sapiens
aagcattttagcacagttcatagtccacagttgatgcagcatcctgagattttaaatcctgaagtgtgggtggcgcacacaccaagtagggagctagtcargcagtttgcttaaggaacttttgttctctgtctcttttccttaaaattgggggtaaggagggaaggaagagggaaagagatgactaactaaaatcatttt

SEQ ID NO: 75955 - DNA, 201 bp, Homo sapiens
gttctttgcatagatttggcttaagcttgaattagatccctgcaaaggcttgctctgtgatgtcagatgtaattgtaaatgtcagtaatcacttcatgaaygctaaatgagaatgtaagtatttttaaatgtgtgtatttcaaatttgtttgactaattctggaattacaagatttctatgcaggatttaccttcatcctg

SEQ ID NO: 75956 - DNA, 201 bp, Homo sapiens
cgtatcctatttaaaaaatgcctgtctatttaaggttcacgatgggaggataaaagaaaaaaggctcccaaagtcaacagagaacatgagctaggcaaaargaaagtccagtttgcttctaaaaaaggctgaaaattataaccatccatggccttgtgtcttaagtctcagaattttttttttctcttttggtggtttgca

SEQ ID NO: 75957 - DNA, 201 bp, Homo sapiens
ctaattctggaattacaagatttctatgcaggatttaccttcatcctgtgcatgtttcccaaactgtgaggagggaaggctcagagatcgagcttctcctytgagttctaacaaaatggtgctttgagggtcagcctttaggaaggtgcagctttgttgtcctttgagctttctgttatgtgcctatcctaataaactctt

SEQ ID NO: 75958 - DNA, 201 bp, Homo sapiens
gtgcatctccaagcgctgtgtgtctctgctgctggacctgtcccagccgctccttcccagccgcctccccaagtggtctgagggcccctgtgggagcccakgctcccccggaagtaacattgagggcttcgtgtgcaagttcagcttcaaaggcatgtgccggcctctggccctggggggcccaggtcaggtgacctacac

SEQ ID NO: 75959 - DNA, 201 bp, Homo sapiens
agccagtttcagataggaaaagcagagtgttaagcaatatgggtatttttaataatatgttcaaacaaacttacttgggcttgtgtatgtaccccccaaamacacacacacacacacacacacacacgcacacacacactggggtagaactactcaaaagccctctgatcagaaagattgtgcatcctgagacctgccttg

SEQ ID NO: 75960 - DNA, 201 bp, Homo sapiens
ctccagcggacacagccttccaggaccccagctcccggcaggagccatgcagtccttctgcgtgcccggtgcccttccccccacctccacccagccccgaraacatctgacctggactccacagcctggaaacctgcggccacctgctgagggcccccccacccactgcttgggtccactgaccagtccccttccacatgt

SEQ ID NO: 75961 - DNA, 201 bp, Homo sapiens
tgttaagcaatatgggtatttttaataatatgttcaaacaaacttacttgggcttgtgtatgtaccccccaaacacacacacacacacacacacacacacrcacacacacactggggtagaactactcaaaagccctctgatcagaaagattgtgcatcctgagacctgccttgcctgctctgagggcagatcccagggaa

SEQ ID NO: 75962 - DNA, 201 bp, Homo sapiens
ttctaacaaaatggtgctttgagggtcagcctttaggaaggtgcagctttgttgtcctttgagctttctgttatgtgcctatcctaataaactcttaaacmcattgattgtgaacttgttttaatatatttcacgacaactcgaaatacctggcagaacttgctttcaaggtcattacatttatccatctcccctttcaaa

SEQ ID NO: 75963 - DNA, 201 bp, Homo sapiens
aggttaccacacacttgactacggatgtgatcaacactaacaaggaaacaaattcaaggacaacctgtctttgagccagggcaggcctcagacaccctgcytgtggccccgcctccacttcatcctgcccggaatgccagtgctccgagctcagacagaggaagccctgcagaaagttccatcaggctgtttcctaaagga

SEQ ID NO: 75964 - DNA, 201 bp, Homo sapiens
ctcagagaaagggtgtttctggttttgccttagcaatgcatcggtctctgaggtgacactctggagcggttgaagggccacaaggtgcagggttaatactsttgccagttttgaaatatagatgctatggttcagattgtttttaatagaaaactaaaggggcaggggaagtgaaaggaaagatggaggttttgtgcggct

SEQ ID NO: 75965 - DNA, 201 bp, Homo sapiens
tctgcggctgccgaccaggattccggctgctggatgacctggtgacctgtgcctctcgaaacccttgcagctccagcccatgtcgtgggggggccacgtgygtcctgggaccccatgggaaaaactacacgtgccgctgcccccaagggtaccagctggactcgagtcagctggactgtgtggacgtggatgaatgccagg

SEQ ID NO: 75966 - DNA, 201 bp, Homo sapiens; identical to SEQ ID NO: 51130

SEQ ID NO: 75967 - DNA, 201 bp, Homo sapiens; identical to SEQ ID NO: 51189

SEQ ID NO: 75968 - DNA, 201 bp, Homo sapiens; identical to SEQ ID NO: 51131

SEQ ID NO: 75969 - DNA, 201 bp, Homo sapiens
gactagtatgtgtggcagtaaatagactagtggcagtaaatagactagtacctacatatattttttgtattcgtggcatacttaacttttgcttaattttwaaaatatatttctaggcttgtagttcctctgtaagttttttcaaattgttgcaaatctctgaaaatgtttccaatgtatttattgaaaaaaatccacaag

SEQ ID NO: 75970 - DNA, 201 bp, Homo sapiens; identical to SEQ ID NO: 51132

SEQ ID NO: 75971 - DNA, 201 bp, Homo sapiens; identical to SEQ ID NO: 51133

SEQ ID NO: 75972 - DNA, 201 bp, Homo sapiens
agtagagatggggtttcgccatgttggccaggcctgtctcgaacccctgacctcagttgacccacccgcttcggcctcccaaagtgctgggattacaggcktgaaccacggtaccctgccaattttaactttctataagagatttgcccagcctgggcaacatggagaaaccctgtctttaccaaaaatacaaaaaattta

SEQ ID NO: 75973 - DNA, 201 bp, Homo sapiens
tgtcattgcactccagcctgggtaatagagccagatcctgtctcaaaaaaaaaaaaaaaaaaagctttgtatccattttggcatacatagactagtatgtrtggcagtaaatagactagtggcagtaaatagactagtacctacatatattttttgtattcgtggcatacttaacttttgcttaatttttaaaatatattt

SEQ ID NO: 75974 - DNA, 201 bp, Homo sapiens
caagcaattctcctgcctcagcctcccaagtggctgggattacaggcacctaccaccacacctggctaattttttgtattgtaagtagagatggggtttcrccatgttggccaggcctgtctcgaacccctgacctcagttgacccacccgcttcggcctcccaaagtgctgggattacaggcttgaaccacggtaccctg

SEQ ID NO: 75975 - DNA, 201 bp, Homo sapiens; identical to SEQ ID NO: 9496

SEQ ID NO: 75976 - DNA, 201 bp, Homo sapiens
tagcctgtgctttgctcaacaagccacatgcctgccttgcttgcatcaagggaaggagtattgtgttctaatttgaagaaatacaccagccactccttaggcagcacttggtgcgggatgggctcctctggaaagggagcacctaatttgcacaaaggtgctgcaccaggtagctacgatcctggaatgggatgaagaaac

SEQ ID NO: 75977 - DNA, 201 bp, Homo sapiens
aggctgtagtgtgtatgggtagctcattccttttctttgccaaatagaattccagtatatggatgtgccacttttttattcactcaccagctgatgggctrccaggtaacatttccactgttggtgactatgaccaacactgctgtgaacatttaggactgagtctttaagtagacctgagtttccacttctcttaagtaa

SEQ ID NO: 75978 - DNA, 201 bp, Homo sapiens; identical to SEQ ID NO: 9498

SEQ ID NO: 75979 - DNA, 201 bp, Homo sapiens
catcccagctgagactgcatgaggagggaggcacgcagttgtggaatttgttccccttttagcatgctgaccagccctggcaacggagctcaaggcatctwtgtgccactgctcaacagtgagtgacgtcatgggcacggccaggtctttatcagttctgccggataaatagccaactgcactaggtctggagagacagca

SEQ ID NO: 75980 - DNA, 201 bp, Homo sapiens; identical to SEQ ID NO: 51195

SEQ ID NO: 75981 - DNA, 201 bp, Homo sapiens; identical to SEQ ID NO: 51196

SEQ ID NO: 75982 - DNA, 201 bp, Homo sapiens; identical to SEQ ID NO: 9502

SEQ ID NO: 75983 - DNA, 201 bp, Homo sapiens; identical to SEQ ID NO: 51198

SEQ ID NO: 75984 - DNA, 201 bp, Homo sapiens; identical to SEQ ID NO: 9503

SEQ ID NO: 75985 - DNA, 201 bp, Homo sapiens; identical to SEQ ID NO: 51199

SEQ ID NO: 75986 - DNA, 201 bp, Homo sapiens; identical to SEQ ID NO: 51149

SEQ ID NO: 75987 - DNA, 201 bp, Homo sapiens; identical to SEQ ID NO: 51152

SEQ ID NO: 75988 - DNA, 201 bp, Homo sapiens; identical to SEQ ID NO: 51201

SEQ ID NO: 75989 - DNA, 201 bp, Homo sapiens; identical to SEQ ID NO: 51155

SEQ ID NO: 75990 - DNA, 201 bp, Homo sapiens
gtgtgatccaccccaggcgcctctcactcctgtgagacccaaacctcctatcagctcccccagcaggccaagtctgtgcacccgtgactcccctgccccartgttccctccagtggctctttgcctcttcagtatccacgtcttcatgatccttcccctactccatcccccaagccctcaccaccaaatgtaatgtaaaca

SEQ ID NO: 75991 - DNA, 201 bp, Homo sapiens; identical to SEQ ID NO: 51158

SEQ ID NO: 75992 - DNA, 201 bp, Homo sapiens
tcagcctgggacgcagaggttgcagtgagccgagatcatgtcattgcactccagcctgggtaatagagccagatcctgtctcaaaaaaaaaaaaaaaaaaagctttgtatccattttggcatacatagactagtatgtgtggcagtaaatagactagtggcagtaaatagactagtacctacatatattttttgtattcgt

SEQ ID NO: 75993 - DNA, 201 bp, Homo sapiens
actttttacttctgtacacagtgtactggcgagaactgctcaccaggaggtgattagcttcacgtggtgttggaagcagatactcaacagttgagctcackgagaaagcacaggaggtggctacgaaattattataggagtacagtatgtctacagtaaatatgcacttatgactttaatactgcacatctttatgtttgc

SEQ ID NO: 75994 - DNA, 201 bp, Homo sapiens; identical to SEQ ID NO: 51207

SEQ ID NO: 75995 - DNA, 201 bp, Homo sapiens
gctgtcatcatcgccaccaccattattattgttattattattacattgtcaccccagagataatcctgcaccagtgacagggaaaatagcagctggcatcygctgcctgctcacgaccacacgccaggcttccgtcaaaccactcaacatgtattagtaatcttttaatcgacctacatattgttttaatttgcatgtgtt

SEQ ID NO: 75996 - DNA, 201 bp, Homo sapiens
tacggtgaaggacaaggattttatgacataaaagcgttgccctagaagcagtgtctgctatggattatgtgcccatgaaaaggcagctgctgtcatcatcrccaccaccattattattgttattattattacattgtcaccccagagataatcctgcaccagtgacagggaaaatagcagctggcatccgctgcctgctca

SEQ ID NO: 75997 - DNA, 201 bp, Homo sapiens; identical to SEQ ID NO: 51210

SEQ ID NO: 75998 - DNA, 201 bp, Homo sapiens
attatgtacatatcatcaaattcaccaatgttaagtgtacaattcaatgatttttagtaaatttactgaggtgtgagtccattaccatcagctagttttaraacattttcatgaccctagtaaaggattttacttcatgttcatttaaacttaatcttgggccaggcggggtggctcacgcctataatctcagcattttgg

SEQ ID NO: 75999 - DNA, 201 bp, Homo sapiens; identical to SEQ ID NO: 51211

SEQ ID NO: 76000 - DNA, 201 bp, Homo sapiens
tgctcaagcaatcctcccacctcagcctgccaaagtgctaaaattacggacctgagccaccgtacccagcctactgctgcacttttaacagcttaattgaratattatgtacatatcatcaaattcaccaatgttaagtgtacaattcaatgatttttagtaaatttactgaggtgtgagtccattaccatcagctagttt

SEQ ID NO: 76001 - DNA, 201 bp, Homo sapiens; identical to SEQ ID NO: 51212

SEQ ID NO: 76002 - DNA, 201 bp, Homo sapiens
tcccccaagccctcaccaccaaatgtaatgtaaacagcatgacagcaaaaactttttgttcacaactgcgtgttgttttttttttttttttttttttttaracacagtctcactctgttgctcaggatggagtgcagtgacacagtcatggctcactgcagccttgaattcctgggctcaagcgattcttccatttcagct

SEQ ID NO: 76003 - DNA, 201 bp, Homo sapiens
gtcttcatgatccttcccctactccatcccccaagccctcaccaccaaatgtaatgtaaacagcatgacagcaaaaactttttgttcacaactgcgtgttkttttttttttttttttttttttttagacacagtctcactctgttgctcaggatggagtgcagtgacacagtcatggctcactgcagccttgaattcctgg

SEQ ID NO: 76004 - DNA, 201 bp, Homo sapiens
acgtcttcatgatccttcccctactccatcccccaagccctcaccaccaaatgtaatgtaaacagcatgacagcaaaaactttttgttcacaactgcgtgktgttttttttttttttttttttttttagacacagtctcactctgttgctcaggatggagtgcagtgacacagtcatggctcactgcagccttgaattcct

SEQ ID NO: 76005 - DNA, 201 bp, Homo sapiens
ccagtggctctttgcctcttcagtatccacgtcttcatgatccttcccctactccatcccccaagccctcaccaccaaatgtaatgtaaacagcatgacarcaaaaactttttgttcacaactgcgtgttgttttttttttttttttttttttttagacacagtctcactctgttgctcaggatggagtgcagtgacacag

SEQ ID NO: 76006 - DNA, 201 bp, Homo sapiens
ttggaagccagaaacaagcccggcacttgtgcagtgacaacaccagggaatttcagtaaaaacccaaactccaccccagggagccccagtgcctcctcccrcatcacagggtgccagggcccactctctttgactcctgctccatagcccctgctgggtactgggctgcttctcccagttcctcctgcctccccccactta

SEQ ID NO: 76007 - DNA, 201 bp, Homo sapiens; identical to SEQ ID NO: 51178

SEQ ID NO: 76008 - DNA, 201 bp, Homo sapiens
tagggcaaatccagtgcctccctggggcccaggagactcagtgtgatccaccccaggcgcctctcactcctgtgagacccaaacctcctatcagctccccyagcaggccaagtctgtgcacccgtgactcccctgccccagtgttccctccagtggctctttgcctcttcagtatccacgtcttcatgatccttcccctac

SEQ ID NO: 76009 - DNA, 201 bp, Homo sapiens; identical to SEQ ID NO: 51224

SEQ ID NO: 76010 - DNA, 201 bp, Homo sapiens; identical to SEQ ID NO: 51181

SEQ ID NO: 76011 - DNA, 201 bp, Homo sapiens
ctgctcacgaccacacgccaggcttccgtcaaaccactcaacatgtattagtaatcttttaatcgacctacatattgttttaatttgcatgtgttaatgcrttgatctatgagatgggtattatgatgagctctgttctgcaggggagaaagcagaaacatggagaatttaagtcatttcccccaaatcacaaagtcagga

SEQ ID NO: 76012 - DNA, 201 bp, Homo sapiens; identical to SEQ ID NO: 51229

SEQ ID NO: 76013 - DNA, 201 bp, Homo sapiens
ccaaacctcctatcagctcccccagcaggccaagtctgtgcacccgtgactcccctgccccagtgttccctccagtggctctttgcctcttcagtatccaygtcttcatgatccttcccctactccatcccccaagccctcaccaccaaatgtaatgtaaacagcatgacagcaaaaactttttgttcacaactgcgtgtt

SEQ ID NO: 76014 - DNA, 201 bp, Homo sapiens; identical to SEQ ID NO: 51184

SEQ ID NO: 76015 - DNA, 201 bp, Homo sapiens; identical to SEQ ID NO: 51232

SEQ ID NO: 76016 - DNA, 201 bp, Homo sapiens
caggaggccaaagtgggcggatcacgaggtcaggagatcgagaccatcctggctaacaccgtgaaaccccgtctctactaaaaaagtacaaaaaattagcygggcatggtggcgggcgccggtagtcccagctactcgggaggctgaggcaggagagtggcgtgaacccgggaggcagagcttgcagtgagccgagatcgc

SEQ ID NO: 76017 - DNA, 201 bp, Homo sapiens
cagggtttcaccatgttggccaggctggtcttgaactcctgacctcaggtgatccacccatctcagcctcccaaagtgccatgattacaggcgtgagccaycgcactcggctgccaacaagtattcttaaacctcagccacaagttatttgttatttatttacttcttacctaattgggctgaattttttttttggagacg

SEQ ID NO: 76018 - DNA, 201 bp, Homo sapiens
tactgtctgtgtttgtgtgtgaggttttttggtgttttttttttacatggggtctcactgtcacccagcctggagtgcagtagtgtgatcacagctcactrcagcctcagcttcctaggctcaagcaatcctcccgcctcagcctccagaacagctaggactacaggtgcaccccactgtgctcagctaattttttatttt

SEQ ID NO: 76019 - DNA, 201 bp, Homo sapiens
ccaagtagctgggattacaggcatgcaccaccatgcctggctaattttgtatctttagtagagacagggtttccccatgttggtcaggctggtctcgagcycctcacctcaagtgattcacccgcctcggtctccaaagcgctgggatttacaggtgtgagccagcgtgcccggtctgccatatgcagtttactggagaga

SEQ ID NO: 76020 - DNA, 201 bp, Homo sapiens
tttctcccccgatgagtccaatccatgactgcctttaactctgtggcttccttcccctagaggaaagccagaaattgtgggaagcaatttagacacactgrtgagcatagggctggatgagaagtttccacaggactacaggctggcccagcaggtgtgccatgccattgccaacatctcggacaggagaaaggtatgtgg

SEQ ID NO: 76021 - DNA, 201 bp, Homo sapiens
gctgcagacctccgtccatggtaccatatgaagcaatttggcttttcttgtaatgtcatgactcttttctgcttcttgggaacacttccagcatcactagkggcacttcattatgggtcccatggtgtcatgtaaggtttatgatactgctttagacacatgaaaaatacctgaggaaccacaggagatcacttcttgctg

SEQ ID NO: 76022 - DNA, 201 bp, Homo sapiens; identical to SEQ ID NO: 31903

SEQ ID NO: 76023 - DNA, 201 bp, Homo sapiens
caacactgtcatgttggggattatatttccaacacatgaattatgaggggcacattcaaaccatacagcgtgctaagtgttgttctgactggtttgcatgsactatctcattcagttttgacatatatatatacatatatatatatatatatatatatacacacatatatataccattggtccttgaacaacgtgggggtt

SEQ ID NO: 76024 - DNA, 201 bp, Homo sapiens
ccaacactgtcatgttggggattatatttccaacacatgaattatgaggggcacattcaaaccatacagcgtgctaagtgttgttctgactggtttgcatrgactatctcattcagttttgacatatatatatacatatatatatatatatatatatatacacacatatatataccattggtccttgaacaacgtgggggt

SEQ ID NO: 76025 - DNA, 201 bp, Homo sapiens
tatcccgccactcccaggagcttccagctatcctggatgatacaactttgagtggatcagatagaaacgcccatctaaatgccctcaaaatgaactgttaygctctgatacgtctcctggaatcctttgagaccatggccagccagacaaaccttgtggacctggaccttggtgggaaggtaatttggagttttgggctca

SEQ ID NO: 76026 - DNA, 201 bp, Homo sapiens; identical to SEQ ID NO: 31913

SEQ ID NO: 76027 - DNA, 201 bp, Homo sapiens
taaatatccaggaatgttgacagctgttggattcccctgtatccccttgaacgaaaccatcctgtacttctctaactccttaggcccagcagcttccacayaagaaaagaatccccgggagtctacaggaaacatggtcacaggacagactgtctgtaaaaataaacccaatatgtcggatcctgaggaatccaggggaaa

SEQ ID NO: 76028 - DNA, 201 bp, Homo sapiens; identical to SEQ ID NO: 31914

SEQ ID NO: 76029 - DNA, 201 bp, Homo sapiens; identical to SEQ ID NO: 31915

SEQ ID NO: 76030 - DNA, 201 bp, Homo sapiens
aataattgaagaagaatttgtcaggtgggtagggaggatggctacagataatactgagctgtgagagtgaggctctgttgatagatatgccgtttttttgkttttgttttttttttgtggggggacagagcttcactcttgtcgcccaggctggagcgcagtggttcaatctcggctcactgcagcctctacctcctgggt

SEQ ID NO: 76031 - DNA, 201 bp, Homo sapiens; identical to SEQ ID NO: 31916

SEQ ID NO: 76032 - DNA, 201 bp, Homo sapiens
tgaagcaatttggcttttcttgtaatgtcatgactcttttctgcttcttgggaacacttccagcatcactagtggcacttcattatgggtcccatggtgtyatgtaaggtttatgatactgctttagacacatgaaaaatacctgaggaaccacaggagatcacttcttgctgccatatgcaatttttgttttgagacaga

SEQ ID NO: 76033 - DNA, 201 bp, Homo sapiens
gtgagcatagggctggatgagaagtttccacaggactacaggctggcccagcaggtgtgccatgccattgccaacatctcggacaggagaaaggtatgtgrgggtggttccaaactaaggagagtggagattctcgtgtccaccctgtacacacacccacgttgtcttgctctccacagccttctctgggcaaacgtcacc

SEQ ID NO: 76034 - DNA, 201 bp, Homo sapiens
tcacttgaacctgggagccggaggttgtagtgagccgagatcgtgccactgcacttcagcctgggtgacagagcgagactccatctattttttttttttttaaaaaaagatggtgaaaccccgtctctactaaaaaatagaaaaattagctaggtgtggtggcaggcacctgtaatcccagctactcgggaggctgaggca

SEQ ID NO: 76035 - DNA, 201 bp, Homo sapiens
agtagagcttttacaggaatgctgatggattggattggattatagggttagtaaaggaatctgagatgagaatgattacaaggctttttttttttttttttgacagtcttgctctgttggctctgtcacccaggttggcgtgcagtggcgtgatcttggctcgctgcaacctctgcctcccaggttcaagcaattctcatg

SEQ ID NO: 76036 - DNA, 201 bp, Homo sapiens
tttcatttcagtgtggaaggctctttagaaacactattaacataacagcattatgtcaaaaagcgccaataacattctcaccaacttttctttttaaaggmattaggtatagctagactgtaaaaggcaagtggtgtgaagcccaaacctaagatcctaagatctaggatgagtcaagacttcatagtctacatgagtaga

SEQ ID NO: 76037 - DNA, 201 bp, Homo sapiens
atcctgatgtccagcatgtgcattttgctagatcacctggatggagaagtaggtggtccactaggggtcactgagctttttctggggattttaagtccagygttgaaaggctgtttcttaacagaacaagaaagtagctttgacaagttgtctagatttatcattgtgacatttcctttctgtagagaagcaggtcaagtt

SEQ ID NO: 76038 - DNA, 201 bp, Homo sapiens
tgttgttgttgctttttttttgagacggagtctcactctgtcacccaggctggaatacagtggcactatctcggctcactgcaacctcctcagttcaagcrattctcctgcctcagcctcctgagcagctgggattacaggcgcatgccaccacacctggcttttttttttttttttttttgtatttttattagagacggg

SEQ ID NO: 76039 - DNA, 201 bp, Homo sapiens
cctagaagaaaacgaatagacttgggagtacgaatgcccacttcaggttagtagtcatgagtttaacgtaagactagtcagcttgtttctgtgtttttctyaggccatttttatttgtgtggtcacatgaatggagtaaccagaaagttgatttaacctagatttgccaggggagtatgtgttgttgttgttgttaattag

SEQ ID NO: 76040 - DNA, 201 bp, Homo sapiens
agagacgggttttgccatgttggccaggctggtcttgaactcctaacctcaggtgatctccctgctttggccccccaaagtgctgggattacaggtgtgarccaccacgcccagccagaagtctatttttaaaataagtaaaataagtttgatggaagaaggttgtgattttaaatcagctactctaggcccggtgcggtg

SEQ ID NO: 76041 - DNA, 201 bp, Homo sapiens
agatgcaactagtgcaggtaaatatagagcttggggcagttgaaagttctcttctgtctgcttctgtttcctcaataggaagggaaagcctttaactgagrgtgagtttgggaagaaggtcatggtgttatgagcagaggataggtgtgaaataattgcctagaagaaaacgaatagacttgggagtacgaatgcccactt

SEQ ID NO: 76042 - DNA, 201 bp, Homo sapiens
cacaagctgatttttgtatttttaatagagacgggttttgccatgttggccaggctggtcttgaactcctaacctcaggtgatctccctgctttggccccscaaagtgctgggattacaggtgtgagccaccacgcccagccagaagtctatttttaaaataagtaaaataagtttgatggaagaaggttgtgattttaaa

SEQ ID NO: 76043 - DNA, 201 bp, Homo sapiens
ttacaggcgtgggccaccacacccggccttacaaggctttttgacttgagcaactagaagaatgaagttgccatttactgagatggggtagcatatgggarggagaggtttagattgttggttatgtgagtgcagagttcaagggagaggttgtcagctaaagatacacatttaggatttaatactcagcgtgtagacagc

SEQ ID NO: 76044 - DNA, 201 bp, Homo sapiens
ccccacactttctttccctcatagtcactttcgaagtatagatcctggcctcaaagaagatactctggaattcctgataaaaggtgtttatgggtcagggrgtaggggatggaaggtgtttgttatcgtttgtttgtttgtctgtttgtttgtttttcctacattttgtcagccacatgatgatatcaaggctgttgtgat

SEQ ID NO: 76045 - DNA, 201 bp, Homo sapiens
ggttttgccgtgttgtccagtctggtcttgaacttctggcctcaagtgatctgcctgcctcggcctcccaaaatgttgggattacaggcgtgggccaccayacccggccttacaaggctttttgacttgagcaactagaagaatgaagttgccatttactgagatggggtagcatatgggagggagaggtttagattgttg

SEQ ID NO: 76046 - DNA, 201 bp, Homo sapiens
cagcacctatagacaaggcacattacagtacagaacaatagcacagactctggagccagactgcttggggttaaaattctgatgctgccatttattaactytggaaaaattgtttatttttacttatgaagtaaaaattatacgaggggactcagaacagtgccaaacacaatgtaaacagctacataagtgtttgctctt

SEQ ID NO: 76047 - DNA, 201 bp, Homo sapiens
tgcctcagccacctgagtatctaggattacaggtgtgcaccaccacgcctggctaattttttttttttttttttttttttttgaggcagagtctcgctctytcgcccaggctggagtgcagtggcaccatctcggttcactgcaagctccgcctcccagggtcacgacacctggctaatttttgtatttttagtagagatg

SEQ ID NO: 76048 - DNA, 201 bp, Homo sapiens
aaagcaaagcaacttgttatagaaagtaatggctagaataaagaaaaccctgactttgggagcagtagggatagaatgaatgaggcagggctctgatacarttggatccagacagctgctttcatcatctcaaactcttcctttctcagtttggttactggctgttgctaccgccttctggagaatcccaccattaatcac

SEQ ID NO: 76049 - DNA, 201 bp, Homo sapiens
tagacaaggcacattacagtacagaacaatagcacagactctggagccagactgcttggggttaaaattctgatgctgccatttattaactctggaaaaaytgtttatttttacttatgaagtaaaaattatacgaggggactcagaacagtgccaaacacaatgtaaacagctacataagtgtttgctcttactattgag

SEQ ID NO: 76050 - DNA, 201 bp, Homo sapiens
aagcaattctcatgcctcagccacctgagtatctaggattacaggtgtgcaccaccacgcctggctaattttttttttttttttttttttttttgaggcakagtctcgctctctcgcccaggctggagtgcagtggcaccatctcggttcactgcaagctccgcctcccagggtcacgacacctggctaatttttgtattt

SEQ ID NO: 76051 - DNA, 201 bp, Homo sapiens
aggttcaagcaattctcatgcctcagccacctgagtatctaggattacaggtgtgcaccaccacgcctggctaattttttttttttttttttttttttttkaggcagagtctcgctctctcgcccaggctggagtgcagtggcaccatctcggttcactgcaagctccgcctcccagggtcacgacacctggctaattttt

SEQ ID NO: 76052 - DNA, 201 bp, Homo sapiens
ttttttgacagtcttgctctgttggctctgtcacccaggttggcgtgcagtggcgtgatcttggctcgctgcaacctctgcctcccaggttcaagcaattytcatgcctcagccacctgagtatctaggattacaggtgtgcaccaccacgcctggctaattttttttttttttttttttttttttgaggcagagtctcgc

SEQ ID NO: 76053 - DNA, 201 bp, Homo sapiens
gcacctgtaatcctagctactcgggaggctgaagtgggagggttgcttgaacctgggaaatggaggttacagtgagccaagatcgcaccactgcactccarcctgggtgacaaaacgagactctgtctcaaaaaaaaaaccaaaaaaaaccacacagacgggcgcggtggctcacgcctataatctcagcactttgggagg

SEQ ID NO: 76054 - DNA, 201 bp, Homo sapiens
tgattacaaggctttttttttttttttttgacagtcttgctctgttggctctgtcacccaggttggcgtgcagtggcgtgatcttggctcgctgcaacctytgcctcccaggttcaagcaattctcatgcctcagccacctgagtatctaggattacaggtgtgcaccaccacgcctggctaatttttttttttttttttt

SEQ ID NO: 76055 - DNA, 201 bp, Homo sapiens; identical to SEQ ID NO: 31930

SEQ ID NO: 76056 - DNA, 201 bp, Homo sapiens; identical to SEQ ID NO: 31931

SEQ ID NO: 76057 - DNA, 201 bp, Homo sapiens; identical to SEQ ID NO: 31932

SEQ ID NO: 76058 - DNA, 201 bp, Homo sapiens; identical to SEQ ID NO: 31933

SEQ ID NO: 76059 - DNA, 201 bp, Homo sapiens; identical to SEQ ID NO: 31935

SEQ ID NO: 76060 - DNA, 201 bp, Homo sapiens; identical to SEQ ID NO: 31937

SEQ ID NO: 76061 - DNA, 201 bp, Homo sapiens
ctaccaggctcaagcagtcctcccacctcagcctcccaagtagctgggaccacagacatgtaccaaagtgctgggattgtaggcatgaggcaccatgctcrgccagacttttttgttaaaaactaaaacacctacacacattagcctaggcctacacagggtcaaggtcaccaagaagtcactagacgatgggaatttttc

SEQ ID NO: 76062 - DNA, 201 bp, Homo sapiens
tgtatatactatggttttttccctctacctgcctacctatggtaatgtttaatttacaaattagatacagtaagagattaacaacaattctttttttttttgagacggagtcttgctctgtcaccgggctggagtgcagtgctgtgatctcagctcactgcaacctccgcctcccaggttcaagagattcccctgcctcag

SEQ ID NO: 76063 - DNA, 201 bp, Homo sapiens; identical to SEQ ID NO: 31941

SEQ ID NO: 76064 - DNA, 201 bp, Homo sapiens; identical to SEQ ID NO: 31943

SEQ ID NO: 76065 - DNA, 201 bp, Homo sapiens
tctgtcatgcttcttggcatgatggcacggtgaggctcaaatctagcaggcaatggggtgggagagcaaaggaaggttctgagagggctccttttccttcrgtgacattgtcacagtgaggcccaactgagctctgctgtgagttataacgccacctaaatggaaaagcaaatagtgagaggaccagccctcctgcctagt

SEQ ID NO: 76066 - DNA, 201 bp, Homo sapiens
ccatgggaaggaaggcccgtggaggctgctgcagtgggcagtaacgaggggctggacttgaggattggagaaatcactgcagaatgggcttaatggaagayaaatttttaaaggaaaaatagtgactgatttgtaaaaaaattagatgaccgaaattttaagcacatattactgatagagtgttgataccactggcaaaat

SEQ ID NO: 76067 - DNA, 201 bp, Homo sapiens
ggctggagtgcagtggcacgatctcggctcactgcaagctccacctcccaggttcaagtgattctcctgcctcagacacctgagtagctgggactacaggygtccgccaccactcctggctaatttttttgtttgtttgtttttgtattttcagtagagacagggctgtgttagccaggatagtctcgatctcctgagctc

SEQ ID NO: 76068 - DNA, 201 bp, Homo sapiens
taggcctagtccacaattaagcatgtgtttctactttataaatgtttaaaaaaactactgaaacaattaaatgttaacaatattataatcaaacatgagtmctccttcaattgaagaagagcacctataaataagttctagttgtatgatcttgaataagttgcttaactttctgtgcctcggtttcattatctataaaat

SEQ ID NO: 76069 - DNA, 201 bp, Homo sapiens
aatcagctactctaggcccggtgcggtggctcacgcctataatcccagcactctgggaggccgaggcgagtggatcacctgaggtcaggagttcaagaccrgcctggccaacatggtgaaaccttgtctctactaaaaaaatatgaaaattagctgtgcatggtggtgtgtgcctgtaatgccagctacttgggaggctga

SEQ ID NO: 76070 - DNA, 201 bp, Homo sapiens
tgagatgagaatgattacaaggctttttttttttttttttgacagtcttgctctgttggctctgtcacccaggttggcgtgcagtggcgtgatcttggctsgctgcaacctctgcctcccaggttcaagcaattctcatgcctcagccacctgagtatctaggattacaggtgtgcaccaccacgcctggctaattttttt

SEQ ID NO: 76071 - DNA, 201 bp, Homo sapiens
aggggaagtggtgataaaacgactcaggatatattttcaaagtagagcttttacaggaatgctgatggattggattggattatagggttagtaaaggaatytgagatgagaatgattacaaggctttttttttttttttttgacagtcttgctctgttggctctgtcacccaggttggcgtgcagtggcgtgatcttggct

SEQ ID NO: 76072 - DNA, 201 bp, Homo sapiens
ataagaggcaaggagagaagcagggatactagttaagtggctaatacagtaataccaagtagattggactggagggatagcaggggaagtggtgataaaaygactcaggatatattttcaaagtagagcttttacaggaatgctgatggattggattggattatagggttagtaaaggaatctgagatgagaatgattaca

SEQ ID NO: 76073 - DNA, 201 bp, Homo sapiens
ttaggtaggaagtggtacagattattctagaatcttgctcctcaaaatgtggtcctcagatcagcagtgttaatatcaggatctcatgatctgggagcttrttagaaatgcaggatgtcaaggcccaggatgtcaaagctgctgaatcaggaaatctgtattttaagaagattcccccaggcaatttggatgcaattataa

SEQ ID NO: 76074 - DNA, 201 bp, Homo sapiens
cagctactcagaaggctggggcaggaggatcgcttgaacccagaagtttgaggctgcagtaagctatgatcctgcactgcacttcggcctgcgcaacacarcaaaccctgtctcaaaaaaaattgtttacaaaggtgtttttgttgttgttgttgttgttgttgctttttttttgagacggagtctcactctgtcacccag

SEQ ID NO: 76075 - DNA, 201 bp, Homo sapiens
caagtggctggaattacaggtgcccaccaccacatccagctaattttttttgtattttttagtagagctggggtttcaccatgttggccaggctggtctcraactcctgacctcaggtgatctgcccaacttggcctcccaaagttctgggattataggcgtgagctactgtgcccagcctatttctggaatatttcattt

SEQ ID NO: 76076 - DNA, 201 bp, Homo sapiens; identical to SEQ ID NO: 6114

SEQ ID NO: 76077 - DNA, 201 bp, Homo sapiens
tttagtagagacgggtttcaccatgttggccaggatggtctcgatctcctgaccttggatctgcccacctcggcctcccaaagtgctgggattacaggtgygagccactgcgcctggcctgtttaacaataatattaataaaatagagcaattgtaactatgccagcatcactacccttgcactttggggccattattaag

SEQ ID NO: 76078 - DNA, 201 bp, Homo sapiens
caccgcgcccagccacttttttttttttttaaagagtcttttgttttttggagacaaggtctcattttgttgcccaggctggagtgcagtggctccatccsagctcactgcaacctctcgggctcagccgcccgagtagctgggactacaggcatgtgccaacatgcactgctaattttgtgttatttgtagcaacgaggt

SEQ ID NO: 76079 - DNA, 201 bp, Homo sapiens
tgggattacaggcaatgccaccacgcccggctaatttttgtatttttagttgagacagggtttcaccatgttggtcaggctggtctccaactcctgacctsatgatccacccgcctcgacctcccaaagtgctgggattacaggcgtgagccaccgcgcccagccacttttttttttttttaaagagtcttttgttttttg

SEQ ID NO: 76080 - DNA, 201 bp, Homo sapiens
tttttttttgtggggggacagagcttcactcttgtcgcccaggctggagcgcagtggttcaatctcggctcactgcagcctctacctcctgggttcaagcrattttcctgcctcagcctcccgagtagctgggattacaggtgcccgccaccacaagctgatttttgtatttttaatagagacgggttttgccatgttggc

SEQ ID NO: 76081 - DNA, 201 bp, Homo sapiens
gaacatgctgcatactatgacaaactactcttcacttattataatgatgcatcatttttttaaatggtcaccttttttttttttaagttctggagtacacrtacaggatgtgcaagtttgttacataggtaaacgtgctgtgttggtttgctgcacctatcaacccatcacctgggtattaagcccagcatgtattagcta

SEQ ID NO: 76082 - DNA, 201 bp, Homo sapiens
ctcccaagcagctgggatcacagacatgcaccaccatacctggctaatttttaaattttctgtagaaacagtgtctccctatgttgcccaggctggtctcraacttctgggctcaagcagtcttcccgcctcagcctcccaaagtgctgggattgcaggctggaatgcagtggcctgatcacagctcactgcagcctcaat

SEQ ID NO: 76083 - DNA, 201 bp, Homo sapiens
ataccgatcaatctaggcacacctggggatggggaagggagggaattaatctgagccgcctattatactacgaagcagttatcggggtgcctacatcagcyacttaccaagagagaagcttctgcacgccagaggcacccagtcccacaggcgcctacctgccccggataagaggttccctgccatttctctagtctcccc

SEQ ID NO: 76084 - DNA, 201 bp, Homo sapiens; identical to SEQ ID NO: 31958

SEQ ID NO: 76085 - DNA, 201 bp, Homo sapiens
agaccaggcgcgatggctcacgtctgtaatcccagcactttgggaggccaaggcagcagattacctgaggtctgaggtcaggagttcgagaccagcctggwcaacatggcgaaaccccacctttactaaaaatacaaaaaaattagccaggtgtggtggtgggcacctgtagtcccagctacttgggaggctgaggcagga

SEQ ID NO: 76086 - DNA, 201 bp, Homo sapiens
tgcctctggatattgatatctctgatgagcatgtacccagcttgccaccgtatttattcagttgaacaatttcacgtgtatttttaaacattcgattccaygggttagatctgatctgttagaaggggctctgcaggctccttcctgtctcacccccacactttctttccctcatagtcactttcgaagtatagatcctgg

SEQ ID NO: 76087 - DNA, 201 bp, Homo sapiens
aaaagaccaggcgcgatggctcacgtctgtaatcccagcactttgggaggccaaggcagcagattacctgaggtctgaggtcaggagttcgagaccagccyggtcaacatggcgaaaccccacctttactaaaaatacaaaaaaattagccaggtgtggtggtgggcacctgtagtcccagctacttgggaggctgaggca

SEQ ID NO: 76088 - DNA, 201 bp, Homo sapiens
ttgcagtaagtgaaacacccaactggtactttaaaaagaactggtgactgtttgtcctaactgtgcatgttagtcctgaaattccaagttataggttcacygataaatgcctctggatattgatatctctgatgagcatgtacccagcttgccaccgtatttattcagttgaacaatttcacgtgtatttttaaacattcg

SEQ ID NO: 76089 - DNA, 201 bp, Homo sapiens
gatgagtaggatttagagaatcagagcaaggagggagggcatttcaaacagaacccaagaaagagcacagttcacattgtagaacaaagaagactgtgttytggttcaaattatctggaaaagaccaggcgcgatggctcacgtctgtaatcccagcactttgggaggccaaggcagcagattacctgaggtctgaggtca

SEQ ID NO: 76090 - DNA, 201 bp, Homo sapiens
gtaagtagacttggtccaccaaaagagaaggaattaaatggaaacagggatgaaattatgtcatttactgaccctgctattcattttacctgatagcttastgatgctgaccttgccggaccactgcagaaggagacccagaaattacaagagatgagggcccagaggcgaactgcagcagcttgtaagtagttactgcct

SEQ ID NO: 76091 - DNA, 201 bp, Homo sapiens; identical to SEQ ID NO: 31959

SEQ ID NO: 76092 - DNA, 201 bp, Homo sapiens
attattgagttattactatgtatttagcaatttacttagctccagaaagaagtataagactatttgctttcatgttcccaactttaaaggaaccaacagtmtagttggtagtgaaaaaccacagaacatttttagaacaatgcagcaggtagataataaagtgccagaatgagttgtacgggtaatggttgtcatagcaat

SEQ ID NO: 76093 - DNA, 201 bp, Homo sapiens
gtctagtaagagcaactcagctttgattttttttttttcttggaggtaggatctggctctgtcacccatgctggagcatgatcatagctcattgcagcctygatctcctgggctcaagcaatcctcccacctcagcctcccaagtagctgggacttcaggcacatactaccatgcctggctaatttttttagtttttgtag

SEQ ID NO: 76094 - DNA, 201 bp, Homo sapiens
gaaaagtggaggggtgaatcagtatgttgtgcaagaggtactgtccatcaaacatcttccaccacagcttagaggtaagagtccatagctgtcactgtacytagctctttcaaaggaccatctcacatggaattgctacattgtcatttctgttccactacaccaggaagcatcataagagcaagaaacatgtttttccta

SEQ ID NO: 76095 - DNA, 201 bp, Homo sapiens
agtgctgggattacaggcgtgagccaaagcgcccggcaacaagtattattgagttattactatgtatttagcaatttacttagctccagaaagaagtatargactatttgctttcatgttcccaactttaaaggaaccaacagtctagttggtagtgaaaaaccacagaacatttttagaacaatgcagcaggtagataat

SEQ ID NO: 76096 - DNA, 201 bp, Homo sapiens
aaatatctgccccaaagaggtctagaattcacatttttattatcagtagtaaaagtcttcctctaccaaggacgaggatatctggctccctttaaggactstaatgtgtcttaccactacaaggagtactcctaatctatattctgtagaaagggtttttagagtgagtgggtagctcagtttagagtatacttaaagatc

SEQ ID NO: 76097 - DNA, 201 bp, Homo sapiens
gttgaaaagtggaggggtgaatcagtatgttgtgcaagaggtactgtccatcaaacatcttccaccacagcttagaggtaagagtccatagctgtcactgkacttagctctttcaaaggaccatctcacatggaattgctacattgtcatttctgttccactacaccaggaagcatcataagagcaagaaacatgtttttc

SEQ ID NO: 76098 - DNA, 201 bp, Homo sapiens
accatgcccgactagttttttgtatctttagtagagacggggtttcaccatgttggccgagctggtctcgaacccttgacctcgtgatccacccgcctcarcctcccagagtgctgggattacaggcgtgagccaaagcgcccggcaacaagtattattgagttattactatgtatttagcaatttacttagctccagaaa

SEQ ID NO: 76099 - DNA, 201 bp, Homo sapiens
ctcccgagtaactggaattacatgcatgtgccaccatgcccgactagttttttgtatctttagtagagacggggtttcaccatgttggccgagctggtctsgaacccttgacctcgtgatccacccgcctcaacctcccagagtgctgggattacaggcgtgagccaaagcgcccggcaacaagtattattgagttattac

SEQ ID NO: 76100 - DNA, 201 bp, Homo sapiens
agcctgcagagtagctgggattataagtgtgctccaaccaccatgccccgcaacaagtatttattaatctaacttcacttttatggagtttttgttttttwaaatatagagatggggtcttgctatgttgcccaggctggtcttgaactcctggcttcaagcaatcctcatgccttggcctcccaaagtgttgggcttaca

SEQ ID NO: 76101 - DNA, 201 bp, Homo sapiens
ctgctgctagtggatgcctcggttgggaccattcagtgtcttgaggaaattgtaaggcttcctgctttctctttctttattcattcaacaagtattttggwtgttttttttttttttttttgagacggagtcatgccccattgcccaggctggagtgcaatggcacaatcttggctcactgcaacctccgcctcccaggtt

SEQ ID NO: 76102 - DNA, 201 bp, Homo sapiens
ttacaagcatgagccactgctcctggcctcaagagctcattctaatgccatcttttcaacaaataccttttctgatcatccccctcagcaaaaaaaaaaargaaaaaaaaacctctcatgggactcgctttcattatcatatttaaatttacattttgtttacatacacatctcttctttttttcttttttccagtcttac

SEQ ID NO: 76103 - DNA, 201 bp, Homo sapiens
acctgtagttccagctactcggaaggctgggcaggaggattgcttgagcccgggagtttgaggctacagtgagctgtggtcatgccactgcactctagccrgagcaacagaataagaacctgtgtcttaagaaaagaaaaaaaaaaggcaggggttctttttttctgtttgcttcctctagccacttacagcttatacatt

SEQ ID NO: 76104 - DNA, 201 bp, Homo sapiens
caggaagacaggttgaggccaggagttcgagagcagcctgggcaacatagcaagaccccatctctacaaagaaacaaaaactaactgggcgtgatggcacrcacctgtagttccagctactcggaaggctgggcaggaggattgcttgagcccgggagtttgaggctacagtgagctgtggtcatgccactgcactctagc

SEQ ID NO: 76105 - DNA, 201 bp, Homo sapiens
aagcgccaataacattctcaccaacttttctttttaaaggcattaggtatagctagactgtaaaaggcaagtggtgtgaagcccaaacctaagatcctaaratctaggatgagtcaagacttcatagtctacatgagtagaggcagcatctagaggaaaacaaaagtatgtggctatcaaattccaaagaagccccatttt

SEQ ID NO: 76106 - DNA, 201 bp, Homo sapiens; identical to SEQ ID NO: 31965

SEQ ID NO: 76107 - DNA, 201 bp, Homo sapiens
gaggttttgccatgttgcccaggctggtctcaaactcccgagctcaagcgatctgcccacctcagcctcccaaagtgctgagattacaggtgtgagccacygcacccagccaagagtcctttttaaaacaattgcattgctttgatgattttggtgtttagaatcctgaatacaacttctcctataaataagatcaaatca

SEQ ID NO: 76108 - DNA, 201 bp, Homo sapiens
taaaaatggaaataatagtactttgcacattaatatgccactttatagttctttaaacaccttcgtactgcttgatttgtttgatcatcagagcaactttrtgaagtaatcagagtttagtaaccctgtttttacagataaagcccagaggtttaagtgtcaagaccaagtgccaaagtcactactagaattagtttctag

SEQ ID NO: 76109 - DNA, 201 bp, Homo sapiens
ttacccaggtagctgtgggcacaccgcccacctacgccccatccgcaacagccacaagccccgccccccgggttccggcaggaggggcctctaccaccctycccgcctcagtgcttccggtccgcctgccggaagttttggagcgccggacaagctgaggtccgcgactcgtcgctaagattccccaaaactgagatttca

SEQ ID NO: 76110 - DNA, 201 bp, Homo sapiens
aatccaggggaaatgatgaactagtgaagcaggagatgctggtacagtatctgcaggatgcctacagcttctcccggaagattacagaggccattggcatmatcagcaagatgatgtatgaaaacacaactacaggtatgccagagtccctttctataaggacagccttggggttcttttggattttttaattttttaaat

SEQ ID NO: 76111 - DNA, 201 bp, Homo sapiens
cgaagacagccatcttgggccttacccaggtagctgtgggcacaccgcccacctacgccccatccgcaacagccacaagccccgccccccgggttccggcmggaggggcctctaccacccttcccgcctcagtgcttccggtccgcctgccggaagttttggagcgccggacaagctgaggtccgcgactcgtcgctaaga

SEQ ID NO: 76112 - DNA, 201 bp, Homo sapiens
gccaacttcacacgagtactaaggcgaagacagccatcttgggccttacccaggtagctgtgggcacaccgcccacctacgccccatccgcaacagccacragccccgccccccgggttccggcaggaggggcctctaccacccttcccgcctcagtgcttccggtccgcctgccggaagttttggagcgccggacaagct

SEQ ID NO: 76113 - DNA, 201 bp, Homo sapiens
atgtcaaaaagcgccaataacattctcaccaacttttctttttaaaggcattaggtatagctagactgtaaaaggcaagtggtgtgaagcccaaacctaaratcctaagatctaggatgagtcaagacttcatagtctacatgagtagaggcagcatctagaggaaaacaaaagtatgtggctatcaaattccaaagaagc

SEQ ID NO: 76114 - DNA, 201 bp, Homo sapiens
agtggaaaaaggaattttctttttgtactttttattctttattttattttgaaagacaaggtaaagactctcttgcccaggctggagtccagtggcatgawcacggctcactgcagcctcaacttcccagactcaagcaatcctctcacctcagcctcccaagcagctgggatcacagacatgcaccaccatacctggcta

SEQ ID NO: 76115 - DNA, 201 bp, Homo sapiens
caaataagcccaagaagatgacaggaaccgtccccgccaacttcacacgagtactaaggcgaagacagccatcttgggccttacccaggtagctgtgggcrcaccgcccacctacgccccatccgcaacagccacaagccccgccccccgggttccggcaggaggggcctctaccacccttcccgcctcagtgcttccggt

SEQ ID NO: 76116 - DNA, 201 bp, Homo sapiens
acgtcacccccccttccggctgcctcaggaacacaggttgtttgagcgactgcgggagacagtcacaaaaggtgagctctcagggaaggccttgggcagawttgggccctttgttgcagtaaacaacttctccctcctcctctgcaggctttgtccacccagacccactctggatcccattcaaagaggtggcagtgaccc

SEQ ID NO: 76117 - DNA, 201 bp, Homo sapiens
gtcttgaactcctgacctcacatgatccacccaccttggcctcccaaagtgttaggattataggcgtgagccactgcaccagtctagatggcagcttcttsctctaatgtccagaagtggaaaaaggaattttctttttgtactttttattctttattttattttgaaagacaaggtaaagactctcttgcccaggctgga

SEQ ID NO: 76118 - DNA, 201 bp, Homo sapiens
atgcgatatcggctcaccacaacctctgcctccccaggctcaagcgattctcctgcttcagcctcccaagtagctaggattacaggtgcacgccactaccrcctggctaatttttgtatttttagtagagacgggatttcaccatgttggccaggctggtcttgaactcctgacctcacatgatccacccaccttggcctc

SEQ ID NO: 76119 - DNA, 201 bp, Homo sapiens
caagaagaagggttggttaatgcagcagctcgacaatatggtcctagcttgtctcctcttggcttttctttcatggttgctagatcgcaacttctttttgwttttcttttttttttttttttgagacagggtctcactctgttgcccagactggagtgcagtgatgcgatatcggctcaccacaacctctgcctccccagg

SEQ ID NO: 76120 - DNA, 201 bp, Homo sapiens
atttgttatcacctacaagaagaagggttggttaatgcagcagctcgacaatatggtcctagcttgtctcctcttggcttttctttcatggttgctagatygcaacttctttttgtttttcttttttttttttttttgagacagggtctcactctgttgcccagactggagtgcagtgatgcgatatcggctcaccacaac

SEQ ID NO: 76121 - DNA, 201 bp, Homo sapiens; identical to SEQ ID NO: 31971

SEQ ID NO: 76122 - DNA, 201 bp, Homo sapiens; identical to SEQ ID NO: 31972

SEQ ID NO: 76123 - DNA, 201 bp, Homo sapiens
ctcagtgccttggtttcgtcatctgtaaatatagagataataaccaattcatttgttatcacctacaagaagaagggttggttaatgcagcagctcgacartatggtcctagcttgtctcctcttggcttttctttcatggttgctagatcgcaacttctttttgtttttcttttttttttttttttgagacagggtctca

SEQ ID NO: 76124 - DNA, 201 bp, Homo sapiens; identical to SEQ ID NO: 31974

SEQ ID NO: 76125 - DNA, 201 bp, Homo sapiens
atttgaatcctggttctaccactctgaccttagacaagttacttaattgtctcagtgccttggtttcgtcatctgtaaatatagagataataaccaattcmtttgttatcacctacaagaagaagggttggttaatgcagcagctcgacaatatggtcctagcttgtctcctcttggcttttctttcatggttgctagatc

SEQ ID NO: 76126 - DNA, 201 bp, Homo sapiens
gctttctttggcgcccttcaaccgtgaaggaaatgaaggttgagaacctggaacccgcttccaatgaccaagccctttctctgtgcctcacaacagtcttscgctgtagctgtttttattacccctattttactactggggaggagatttgaggtcctgaaagtgaagtgacttgctggacgtcacttagcagaggagatg

SEQ ID NO: 76127 - DNA, 201 bp, Homo sapiens
cccaaaactgagatttcaagaaaattcaccctttccgctttctttggcgcccttcaaccgtgaaggaaatgaaggttgagaacctggaacccgcttccaawgaccaagccctttctctgtgcctcacaacagtcttgcgctgtagctgtttttattacccctattttactactggggaggagatttgaggtcctgaaagtg

SEQ ID NO: 76128 - DNA, 201 bp, Homo sapiens
tacaagcatgagccactgctcctggcctcaagagctcattctaatgccatcttttcaacaaataccttttctgatcatccccctcagcaaaaaaaaaaaaraaaaaaaaacctctcatgggactcgctttcattatcatatttaaatttacattttgtttacatacacatctcttctttttttcttttttccagtcttacc

SEQ ID NO: 76129 - DNA, 201 bp, Homo sapiens
aggccagagagctgacagctgagagcaggtacgagggttaggccgtgaggccatgggagcagtggggagccagaccgcaggttcttgtgggccatcatggkgactttggcatttcctcagaatgaagtggagccactggggagccacaagcagggaggtgaggtgacctgacttgtacttcaacagggccatcctagctgt

SEQ ID NO: 76130 - DNA, 201 bp, Homo sapiens
tacgagcaatagcaaggaggccagagagctgacagctgagagcaggtacgagggttaggccgtgaggccatgggagcagtggggagccagaccgcaggttyttgtgggccatcatggtgactttggcatttcctcagaatgaagtggagccactggggagccacaagcagggaggtgaggtgacctgacttgtacttcaac

SEQ ID NO: 76131 - DNA, 201 bp, Homo sapiens
tacagcgtgctaagtgttgttctgactggtttgcatggactatctcattcagttttgacatatatatatacatatatatatatatatatatatatacacayatatatataccattggtccttgaacaacgtgggggttagggatgacaacccctgtgcagtcaaaaatctgcatatgtaagttttgactgccccaaaactt

SEQ ID NO: 76132 - DNA, 201 bp, Homo sapiens
catacagcgtgctaagtgttgttctgactggtttgcatggactatctcattcagttttgacatatatatatacatatatatatatatatatatatatacayacatatatataccattggtccttgaacaacgtgggggttagggatgacaacccctgtgcagtcaaaaatctgcatatgtaagttttgactgccccaaaac

SEQ ID NO: 76133 - DNA, 201 bp, Homo sapiens
accatacagcgtgctaagtgttgttctgactggtttgcatggactatctcattcagttttgacatatatatatacatatatatatatatatatatatatayacacatatatataccattggtccttgaacaacgtgggggttagggatgacaacccctgtgcagtcaaaaatctgcatatgtaagttttgactgccccaaa

SEQ ID NO: 76134 - DNA, 201 bp, Homo sapiens
gcacattcaaaccatacagcgtgctaagtgttgttctgactggtttgcatggactatctcattcagttttgacatatatatatacatatatatatatatakatatatatacacacatatatataccattggtccttgaacaacgtgggggttagggatgacaacccctgtgcagtcaaaaatctgcatatgtaagttttga

SEQ ID NO: 76135 - DNA, 201 bp, Homo sapiens
ggattttttaattttttaaatttttattaacaatagagatggggccttcctttgttgctcaggctggtctccaactcctgggctcaggcaattcttctgcrtcagcctcccaaagtgctggtattacaggtgtgagccactgcacccggccatggatcttggagttcttttccatattttattgatatatctatctgctcc

SEQ ID NO: 76136 - DNA, 201 bp, Homo sapiens
acctaaacacctcccattagactccaccttccaacactgtcatgttggggattatatttccaacacatgaattatgaggggcacattcaaaccatacagcrtgctaagtgttgttctgactggtttgcatggactatctcattcagttttgacatatatatatacatatatatatatatatatatatatacacacatatat

SEQ ID NO: 76137 - DNA, 201 bp, Homo sapiens
tacactccgaacatggcccttttctcgttccaacgatcaaccactttggggggcgggagagtgagccttataccgatcaatctaggcacacctggggatgsggaagggagggaattaatctgagccgcctattatactacgaagcagttatcggggtgcctacatcagccacttaccaagagagaagcttctgcacgccag

SEQ ID NO: 76138 - DNA, 201 bp, Homo sapiens
ttaatttcatatcttcacattgtgaaaagagatatccagggccagatgtcgtggcttatgcctgtaatcctaacactttgggaggccaaggcaggaggatygcttgagcccaggagttgaaaatcagcctgagcaacatgacgaaacccccatctctacaagggataccaaaaaaaaattagccaggtgcggtggcacgca

SEQ ID NO: 76139 - DNA, 201 bp, Homo sapiens
aaaaattagccgggtgtggtgacgcgtgcctgtaatcccagctactcaggaggctgaggcgggagaatcacttgaacctgggagccggaggttgtagtgasccgagatcgtgccactgcacttcagcctgggtgacagagcgagactccatctattttttttttttttaaaaaaagatggtgaaaccccgtctctactaaa

SEQ ID NO: 76140 - DNA, 201 bp, Homo sapiens
agtggtatgatcacaactcactgcagctttgatctcccaggctcaagtgatcctcccacctcagctccctcgagtagctgagaccacaggcacacaccatyacacccacaggcacacaccatcacacccacaggcacacaccatcacacccacaggcatacaccatcacacccacaggcacacaccatcacacccggctaa

SEQ ID NO: 76141 - DNA, 201 bp, Homo sapiens
gtagtcatgagtttaacgtaagactagtcagcttgtttctgtgtttttctcaggccatttttatttgtgtggtcacatgaatggagtaaccagaaagttgrtttaacctagatttgccaggggagtatgtgttgttgttgttgttaattagtggaataagttacaagtatcacagtatctaacaataggggaatagtaaat

SEQ ID NO: 76142 - DNA, 201 bp, Homo sapiens
actcagaacagtgccaaacacaatgtaaacagctacataagtgtttgctcttactattgagcacagtaccactctctacacaggaggaaaagatagtcgtyacagcctaattgccattctgaaattgtgtaccacgtcgaaggtcaagtcttacccaggatcccgatgttgtcatacactccgaacatggcccttttctcg

SEQ ID NO: 76143 - DNA, 201 bp, Homo sapiens
ggcgaaacccatctctgctaaaattacaaaaattggccaggtatggtggcacgtacctgtaatcctagctatttggggagctgaggcatgagaatcactcraacctaggaagcagaggttatagtgagccaagatcatgccactacacttcagcctgggtgacagaacaagactctgtctctaaaaaaaaaaaaaatatat

SEQ ID NO: 76144 - DNA, 201 bp, Homo sapiens
tatgttgggggtggggaactaacaaaaccagatgatgttactagcttgctataaaactaaaagccattatatatgttggggatgggaaagtaatagaaccrgatacgaagacaggtcttgaatatagaccctgactttttcactgtttggtttctagccctgtgagcctgtaggagtagaatggctccccaaatgtatgag

SEQ ID NO: 76145 - DNA, 201 bp, Homo sapiens
gacagaggaagagtccatctcaaaaaaaaaaaaaaatttatagatggccaggtgcagtggctcacacctgtaatcccagcaccttgggagcccaaagctgstggatctcttgaggccaggagtttgaggccagcctggccaacgtggcgaaatggcgaaacccatctctgctaaaattacaaaaattggccaggtatggtg

SEQ ID NO: 76146 - DNA, 201 bp, Homo sapiens
agtgtgacccagtcttgggcaaaatacaataggcctagtaggtatatccctggggcgcgatgtgtgagaaactgtaagtctgacagatccgcaacggaagwtgttaagcaaatcgcttaacagatccgcaacggaagatgttaagcaaatcgcttaactttcttacttcaatttccgctctgtaaactcatttgtattatt

SEQ ID NO: 76147 - DNA, 201 bp, Homo sapiens
tcaagaccaagtgccaaagtcactactagaattagtttctagtccagggtcaatctcagatcccgtaagataatgttactagcttgctataaaactaaaarccattatatatgttgggggtggggaactaacaaaaccagatgatgttactagcttgctataaaactaaaagccattatatatgttggggatgggaaagta

SEQ ID NO: 76148 - DNA, 201 bp, Homo sapiens
agcctctcactgtagcctcaaccctgctgggctcaagcgatctcccacattagcctcctgagtagcctggttaatttatttataatttgtagctgggattrcaggtacacaccaccaggcctggcctttgccagcctgggcaacgtggcaagaagataacatgtagacaagcagtcaaacatgtattctttttttccccct

SEQ ID NO: 76149 - DNA, 201 bp, Homo sapiens; identical to SEQ ID NO: 31979

SEQ ID NO: 76150 - DNA, 201 bp, Homo sapiens
tcactgttgcccaggctggagtacagtagcgcaatcacagctcactgcagcctctcactgtagcctcaaccctgctgggctcaagcgatctcccacattakcctcctgagtagcctggttaatttatttataatttgtagctgggattacaggtacacaccaccaggcctggcctttgccagcctgggcaacgtggcaaga

SEQ ID NO: 76151 - DNA, 201 bp, Homo sapiens
gtattttctcctgtcaattagaaaaggattgtttgtttttgagacagaatctcactgttgcccaggctggagtacagtagcgcaatcacagctcactgcarcctctcactgtagcctcaaccctgctgggctcaagcgatctcccacattagcctcctgagtagcctggttaatttatttataatttgtagctgggattac

SEQ ID NO: 76152 - DNA, 201 bp, Homo sapiens
cctactcagagaatatgcctaataaatattttatgagagtagtacagaagtatgactccatttttctcttatatttcatttcagtgtggaaggctctttaraaacactattaacataacagcattatgtcaaaaagcgccaataacattctcaccaacttttctttttaaaggcattaggtatagctagactgtaaaaggc

SEQ ID NO: 76153 - DNA, 201 bp, Homo sapiens; identical to SEQ ID NO: 31905

SEQ ID NO: 76154 - DNA, 201 bp, Homo sapiens
gaaggagctaaatggacgctaaataaagagagtgtttcaaaaacaaaagagaggtcaactgcagattaactactggatttattgatgtcatagtcactggyaaccttgacaaagctgtttcaggagatggtgggggcaaaagcctgctaggaataggtttttaagaaaatggaatgacagagattagagatgatgaattta

SEQ ID NO: 76155 - DNA, 201 bp, Homo sapiens; identical to SEQ ID NO: 31906

SEQ ID NO: 76156 - DNA, 201 bp, Homo sapiens
ctagactgtaaaaggcaagtggtgtgaagcccaaacctaagatcctaagatctaggatgagtcaagacttcatagtctacatgagtagaggcagcatctaraggaaaacaaaagtatgtggctatcaaattccaaagaagccccattttattacagagaaaatacaaagccgtttcctcacagggaaaagtacagtttccc

SEQ ID NO: 76157 - DNA, 201 bp, Homo sapiens
tctgatgctgccatttattaactctggaaaaattgtttatttttacttatgaagtaaaaattatacgaggggactcagaacagtgccaaacacaatgtaarcagctacataagtgtttgctcttactattgagcacagtaccactctctacacaggaggaaaagatagtcgttacagcctaattgccattctgaaattgtg

SEQ ID NO: 76158 - DNA, 201 bp, Homo sapiens
gtgagagaacacattagatccaagacaagagaactcatcctacaccagctaagctttcaacccacggttgcatcttgctgagcagcacctatagacaaggmacattacagtacagaacaatagcacagactctggagccagactgcttggggttaaaattctgatgctgccatttattaactctggaaaaattgtttattt

SEQ ID NO: 76159 - DNA, 201 bp, Homo sapiens
agtacagtttcccttctccagggtgacagatgagccttttccgaagttctcagctttctcttctatcgaaacttcccatgtcggttaaagtgtttgtagaratagcggatgcgtttattaaggttgtgcaggtcatcagcgaacattctacttccaaccattttcctctttcggatacaacgttgcaattcattccctttc

SEQ ID NO: 76160 - DNA, 201 bp, Homo sapiens
aagttttggagcgccggacaagctgaggtccgcgactcgtcgctaagattccccaaaactgagatttcaagaaaattcaccctttccgctttctttggcgyccttcaaccgtgaaggaaatgaaggttgagaacctggaacccgcttccaatgaccaagccctttctctgtgcctcacaacagtcttgcgctgtagctgtt

SEQ ID NO: 76161 - DNA, 201 bp, Homo sapiens
agaaggggctctgcaggctccttcctgtctcacccccacactttctttccctcatagtcactttcgaagtatagatcctggcctcaaagaagatactctgsaattcctgataaaaggtgtttatgggtcagggggtaggggatggaaggtgtttgttatcgtttgtttgtttgtctgtttgtttgtttttcctacattttg

SEQ ID NO: 76162 - DNA, 201 bp, Homo sapiens
cttgtgtagctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcctca

SEQ ID NO: 76163 - DNA, 201 bp, Homo sapiens
  misc_feature (1)...(201): n = A,T,C or G, or insertion/deletion polymorphism (see Tables 1-2)
gtttatgggtcagggggtaggggatggaaggtgtttgttatcgtttgtttgtttgtctgtttgtttgtttttcctacattttgtcagccacatgatgatancaaggctgttgtgattcagttggtttggctaagcccagggacctttggcctgttaaaggtctgtaatcttggtgggcgatacagagttatgtgtgttcac

SEQ ID NO: 76164 - DNA, 201 bp, Homo sapiens
tcttgtgtagctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcctc

SEQ ID NO: 76165 - DNA, 201 bp, Homo sapiens
accccagttgctcaggctggaatgcagtggcatgatctcagctcactgcagcctcaaactcctgggctcaggtgatcttcccacctcagcctcttgtgtarctgggactgcaggcacgcagaaccatgagtagctggaactacaggcatgcagaaccatgcccagctaagttgttttttttttttttttttttgagacaga

SEQ ID NO: 76166 - DNA, 201 bp, Homo sapiens
ctcttgtgtagctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcct

SEQ ID NO: 76167 - DNA, 201 bp, Homo sapiens
tcacgatgtaatctaaaaaatgtggaccatttgcacattctgcagagtatcacattggtccaccatcttgtaactttacatccttcagacgtctttttttktttttttttcttttttttaaagacagagtctccctctgttgcccaggctgaagtgcatggtgcaatctcagctcactgcaacctctctgtctcccggatt

SEQ ID NO: 76168 - DNA, 201 bp, Homo sapiens
attgggctgaattttttttttggagacggagtcttgctctgttgcccaggctggagtgcagtggtgcgatcttggctcactgcaacctccacctcctgggytcacgccattctcctgcctcagcctcccgagtagctgggactacaggcgcccgccaccacgcccggctaatttttttttttatatttttagtagagacgg

SEQ ID NO: 76169 - DNA, 201 bp, Homo sapiens
tccccttccggcaatctctgctcctctgctattacatgaagcgaagagtttctgcctctctgtggctactaccgtaggaaaggttcgtgtgaacaatgacraaactgtcagtgatcacccaggaaggaaagatttaggtaaatgcagagtgtggagttagagacctcagcataaaacagaggctttgtgtctgaggcaggg

SEQ ID NO: 76170 - DNA, 201 bp, Homo sapiens
cctcttgtgtagctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcc

SEQ ID NO: 76171 - DNA, 201 bp, Homo sapiens
aaactggatgaagctgctgccaatttaaccaagtgggaatcccagtgctaattgtctgctggatgggatatctttattggagcagattaacatagcctcamatttgtggtttgtgaccactgatttagcaaatacattgtttttcttttttctttttctttttcttttgagacagggtcttgctttgttgcctaggctgaa

SEQ ID NO: 76172 - DNA, 201 bp, Homo sapiens
actctgttgcccaggctgcagtacagtgacacgatcttggctcactgcaacctctgcctcccaggttcaagcaattctcgtgcctcagcctcccaagtagstgggaccacaggcgcgcaccaccacaccgcactaatttttttatttttagtagagacagggtttcaccatgttggccaggctggtcttgaactcctgacc

SEQ ID NO: 76173 - DNA, 201 bp, Homo sapiens; identical to SEQ ID NO: 31921

SEQ ID NO: 76174 - DNA, 201 bp, Homo sapiens
ttcactttttttttttttttttttttgagacagtctcaccccagttgctcaggctggaatgcagtggcatgatctcagctcactgcagcctcaaactcctrggctcaggtgatcttcccacctcagcctcttgtgtagctgggactgcaggcacgcagaaccatgagtagctggaactacaggcatgcagaaccatgccca

SEQ ID NO: 76175 - DNA, 201 bp, Homo sapiens
tcattatcatatttaaatttacattttgtttacatacacatctcttctttttttcttttttccagtcttacccctgtataaactggatgaagctgctgccratttaaccaagtgggaatcccagtgctaattgtctgctggatgggatatctttattggagcagattaacatagcctcaaatttgtggtttgtgaccactg

SEQ ID NO: 76176 - DNA, 201 bp, Homo sapiens
agcccttacagccgtcaacaagttttttttttttttttttttttttttttttgagatggagtctcactcactctgttgcccaggctgcagtacagtgacaygatcttggctcactgcaacctctgcctcccaggttcaagcaattctcgtgcctcagcctcccaagtagctgggaccacaggcgcgcaccaccacaccgca

SEQ ID NO: 76177 - DNA, 201 bp, Homo sapiens; identical to SEQ ID NO: 31922
  misc_feature (1)...(201): n = A,T,C or G, or insertion/deletion polymorphism (see Tables 1-2)

SEQ ID NO: 76178 - DNA, 201 bp, Homo sapiens
ccacctcagcctgcagagtagctgggattataagtgtgctccaaccaccatgccccgcaacaagtatttattaatctaacttcacttttatggagtttttkttttttaaaatatagagatggggtcttgctatgttgcccaggctggtcttgaactcctggcttcaagcaatcctcatgccttggcctcccaaagtgttgg

SEQ ID NO: 76179 - DNA, 201 bp, Homo sapiens
tcagcaaaaaaaaaaaagaaaaaaaaacctctcatgggactcgctttcattatcatatttaaatttacattttgtttacatacacatctcttctttttttyttttttccagtcttacccctgtataaactggatgaagctgctgccaatttaaccaagtgggaatcccagtgctaattgtctgctggatgggatatcttta

SEQ ID NO: 76180 - DNA, 201 bp, Homo sapiens
cctagtatgaatcctgatcttagagaaaagatttctcctagtgtttttgtgactctagaacttaacaacaaaagcccttacagccgtcaacaagttttttktttttttttttttttttttttttgagatggagtctcactcactctgttgcccaggctgcagtacagtgacacgatcttggctcactgcaacctctgcctc

SEQ ID NO: 76181 - DNA, 201 bp, Homo sapiens; identical to SEQ ID NO: 31924

SEQ ID NO: 76182 - DNA, 201 bp, Homo sapiens
agggcaccttgcacttagcagagtcccaaatattttattttctccactctagcaccaccaaatcatgtaaagtatacagccactcacatttcacatcaacytctccattcttatgcatagctccttccagccacccctctgaaaactgactctcctaaacatttccgtaagacccaggatcatgttttcatatatacccat

SEQ ID NO: 76183 - DNA, 201 bp, Homo sapiens; identical to SEQ ID NO: 31923

SEQ ID NO: 76184 - DNA, 201 bp, Homo sapiens
ctcagcaaaaaaaaaaaagaaaaaaaaacctctcatgggactcgctttcattatcatatttaaatttacattttgtttacatacacatctcttcttttttycttttttccagtcttacccctgtataaactggatgaagctgctgccaatttaaccaagtgggaatcccagtgctaattgtctgctggatgggatatcttt

SEQ ID NO: 76185 - DNA, 201 bp, Homo sapiens
acctagtatgaatcctgatcttagagaaaagatttctcctagtgtttttgtgactctagaacttaacaacaaaagcccttacagccgtcaacaagtttttkttttttttttttttttttttttttgagatggagtctcactcactctgttgcccaggctgcagtacagtgacacgatcttggctcactgcaacctctgcct

SEQ ID NO: 76186 - DNA, 201 bp, Homo sapiens; identical to SEQ ID NO: 31926

SEQ ID NO: 76187 - DNA, 201 bp, Homo sapiens
caacagcacaccaaataagcccaagaagatgacaggaaccgtccccgccaacttcacacgagtactaaggcgaagacagccatcttgggccttacccaggyagctgtgggcacaccgcccacctacgccccatccgcaacagccacaagccccgccccccgggttccggcaggaggggcctctaccacccttcccgcctca

SEQ ID NO: 76188 - DNA, 201 bp, Homo sapiens
cactgctcctggcctcaagagctcattctaatgccatcttttcaacaaataccttttctgatcatccccctcagcaaaaaaaaaaaagaaaaaaaaacctstcatgggactcgctttcattatcatatttaaatttacattttgtttacatacacatctcttctttttttcttttttccagtcttacccctgtataaactg

SEQ ID NO: 76189 - DNA, 201 bp, Homo sapiens
tataaaataagaaattgattagatcttatgatctctaaggactttctaattctaaatttcatgaactaataatatcaaacatgcttaatactaccttaatyttcaaacctagtatgaatcctgatcttagagaaaagatttctcctagtgtttttgtgactctagaacttaacaacaaaagcccttacagccgtcaacaag

SEQ ID NO: 76190 - DNA, 201 bp, Homo sapiens; identical to SEQ ID NO: 31927

SEQ ID NO: 76191 - DNA, 201 bp, Homo sapiens
catgcccagctaatttgttttttgtatttttttagtagagatggggtttcaccactttggccaagctggtcttgaactcctgacctcaagtgatctgctcrcctcggcctcccaaagtgctgggattacaagcatgagccactgctcctggcctcaagagctcattctaatgccatcttttcaacaaataccttttctgat

SEQ ID NO: 76192 - DNA, 201 bp, Homo sapiens
agagcacctataaataagttctagttgtatgatcttgaataagttgcttaactttctgtgcctcggtttcattatctataaaataagaaattgattagatyttatgatctctaaggactttctaattctaaatttcatgaactaataatatcaaacatgcttaatactaccttaatcttcaaacctagtatgaatcctgat

SEQ ID NO: 76193 - DNA, 201 bp, Homo sapiens; identical to SEQ ID NO: 31928

SEQ ID NO: 76194 - DNA, 201 bp, Homo sapiens
catgtagtaatggtctgaccataggcctagtccacaattaagcatgtgtttctactttataaatgtttaaaaaaactactgaaacaattaaatgttaacartattataatcaaacatgagtcctccttcaattgaagaagagcacctataaataagttctagttgtatgatcttgaataagttgcttaactttctgtgcct

SEQ ID NO: 76195 - DNA, 201 bp, Homo sapiens
agcttcactcttgtcgcccaggctggagcgcagtggttcaatctcggctcactgcagcctctacctcctgggttcaagcaattttcctgcctcagcctccygagtagctgggattacaggtgcccgccaccacaagctgatttttgtatttttaatagagacgggttttgccatgttggccaggctggtcttgaactccta

SEQ ID NO: 76196 - DNA, 201 bp, Homo sapiens
cgtctctactaaaaaagtacaaaaaattagccgggcatggtggcgggcgccggtagtcccagctactcgggaggctgaggcaggagagtggcgtgaacccrggaggcagagcttgcagtgagccgagatcgcaccactgcactccagcctgggcgacagagagagattccgtctcaagaaaaaaaaaaaagacatatatat

SEQ ID NO: 76197 - DNA, 201 bp, Homo sapiens
tggatactttacaagcccatggccatgatgtcaactcctttgtgcggagccgtgttttgcagctcttcacccgaattgtccagcagaaggtaaccaacttmtatgtggcaaaaacatatggtacctctccatataccagtgtaaagaggaatccagtgttgaagataaatatctgccccaaagaggtctagaattcacatt

SEQ ID NO: 76198 - DNA, 201 bp, Homo sapiens; identical to SEQ ID NO: 31929

SEQ ID NO: 76199 - DNA, 201 bp, Homo sapiens
ttcttggatactttacaagcccatggccatgatgtcaactcctttgtgcggagccgtgttttgcagctcttcacccgaattgtccagcagaaggtaaccarcttctatgtggcaaaaacatatggtacctctccatataccagtgtaaagaggaatccagtgttgaagataaatatctgccccaaagaggtctagaattca

SEQ ID NO: 76200 - DNA, 201 bp, Homo sapiens
gcgcctacctgccccggataagaggttccctgccatttctctagtctccccccttcaacagcacaccaaataagcccaagaagatgacaggaaccgtcccygccaacttcacacgagtactaaggcgaagacagccatcttgggccttacccaggtagctgtgggcacaccgcccacctacgccccatccgcaacagccac

SEQ ID NO: 76201 - DNA, 201 bp, Homo sapiens; identical to SEQ ID NO: 31940

SEQ ID NO: 76202 - DNA, 201 bp, Homo sapiens
agcagtagctccaccagtaaataccactcatagctttctcatgcacaccatgctgtttcttgactctaggcctttatttctgcttcaactgcctggaaaamctgctagcctccactcccttaagacaactcagtggtcacctcttctctaaagcccttctcgtccccattcctgcttcctcaggaaaagataggtgtctct

SEQ ID NO: 76203 - DNA, 201 bp, Homo sapiens; identical to SEQ ID NO: 31942

SEQ ID NO: 76204 - DNA, 201 bp, Homo sapiens
ggggtttcaccgtgttagccaggatggtctcgatctcctgacctcgtgatctgcctgtctcagcctcccaaagtgctgggattacaggcgtgagccaccgygcccggccccctaaaggctaaattttaataatcattacaatcttcaggatctgactcttgcttcccatctctttccctgtcttttaccacaagcagtagc

SEQ ID NO: 76205 - DNA, 201 bp, Homo sapiens
ttgtgtggacatatgttttcagttttcttgggtataaacctaggagtggaattactgggtcatgcggtaactctacacttaactttttgtggaactgccamttttccaaagtggctgcaccattttactaaaggctaaatttttttttttttgagatggagtctcactctgtcgcccaggctggagtgcggtggtgcgatc

SEQ ID NO: 76206 - DNA, 201 bp, Homo sapiens
gaataatgttgctaaggagatttgtgtacaagtgtttgtgtggacatatgttttcagttttcttgggtataaacctaggagtggaattactgggtcatgcrgtaactctacacttaactttttgtggaactgccaattttccaaagtggctgcaccattttactaaaggctaaatttttttttttttgagatggagtctca

SEQ ID NO: 76207 - DNA, 201 bp, Homo sapiens
tgttggtgagtggatgtgatttttttattcagctactaccatgctttcctgtgtgagccctatgaggaaaaattggttttggcccttgttctagcattctytgagcaacaagtcctctttgggattcagctttctcctgtgaccttgggagtgaatacctaggcagttaatggaaaaagttatggccaagcacaagcaagc

SEQ ID NO: 76208 - DNA, 201 bp, Homo sapiens
acaagcatgagccactgctcctggcctcaagagctcattctaatgccatcttttcaacaaataccttttctgatcatccccctcagcaaaaaaaaaaaagraaaaaaaacctctcatgggactcgctttcattatcatatttaaatttacattttgtttacatacacatctcttctttttttcttttttccagtcttaccc

SEQ ID NO: 76209 - DNA, 201 bp, Homo sapiens
gtatggatagaccacattttgtgtatccattcaccagctgacggatatttggattgtttcttctttttagctattatgaataatgttgctaaggagatttrtgtacaagtgtttgtgtggacatatgttttcagttttcttgggtataaacctaggagtggaattactgggtcatgcggtaactctacacttaactttttg

SEQ ID NO: 76210 - DNA, 201 bp, Homo sapiens
agtgagccaagatcgcaccactgcactccagcctgggtgacaaaacgagactctgtctcaaaaaaaaaaccaaaaaaaaccacacagacgggcgcggtggytcacgcctataatctcagcactttgggaggccgaggagggtggatcacgaggtcaggagtttgagaccagcctggccaatatggtgaaatcctgtctcta

SEQ ID NO: 76211 - DNA, 201 bp, Homo sapiens
aattagctgggtgtggtggcgcgcacctgtaatcctagctactcgggaggctgaagtgggagggttgcttgaacctgggaaatggaggttacagtgagccragatcgcaccactgcactccagcctgggtgacaaaacgagactctgtctcaaaaaaaaaaccaaaaaaaaccacacagacgggcgcggtggctcacgcct

SEQ ID NO: 76212 - DNA, 201 bp, Homo sapiens
ggagggaaaggaggggatatttattagtaaggattaaagactttgaggccaggtgtggtggctcacgcctgtaatcccagcactttgggaggctgaggtgrgtggatcacttgaggtcaagagtttaagactagcctggccaacatggtgaaatcccatctctactaaaaatacaaaaaaaaattagctgggtgtggtggc

SEQ ID NO: 76213 - DNA, 201 bp, Homo sapiens
gcttgccttgcttcctcaaacaatgaactttctcaaatcaacccatgtcatctctctcaattctcttttatgcctgaatgctaacctggctgattcccatrctgatgttgggcactcctaggtgaatgtcaaggacaaagacagtccacttgttcatctcatttactttaactttttgtgcaagaccctattctctggttc

SEQ ID NO: 76214 - DNA, 201 bp, Homo sapiens; identical to SEQ ID NO: 31946

SEQ ID NO: 76215 - DNA, 201 bp, Homo sapiens
tgcttagccttcagctttgattctgagtcccatctgttcctcaggataaagcgtcttcccaccagctggcttgccttgcttcctcaaacaatgaactttcycaaatcaacccatgtcatctctctcaattctcttttatgcctgaatgctaacctggctgattcccatactgatgttgggcactcctaggtgaatgtcaag

SEQ ID NO: 76216 - DNA, 201 bp, Homo sapiens
taccatgcttagccttcagctttgattctgagtcccatctgttcctcaggataaagcgtcttcccaccagctggcttgccttgcttcctcaaacaatgaaytttctcaaatcaacccatgtcatctctctcaattctcttttatgcctgaatgctaacctggctgattcccatactgatgttgggcactcctaggtgaatg

SEQ ID NO: 76217 - DNA, 201 bp, Homo sapiens
agaaagtagctttgacaagttgtctagatttatcattgtgacatttcctttctgtagagaagcaggtcaagtttgttgaataaggagctctttattaatckgttaatctttcaattcacattgcttttatccagttctggtaagggagatgacatttctgcagcttaagtctagtaagagcaactcagctttgattttttt

SEQ ID NO: 76218 - DNA, 201 bp, Homo sapiens
aagttctcagctttctcttctatcgaaacttcccatgtcggttaaagtgtttgtagagatagcggatgcgtttattaaggttgtgcaggtcatcagcgaayattctacttccaaccattttcctctttcggatacaacgttgcaattcattccctttccaacctcgaagccatatgggccccctgatcagttctttggggt

SEQ ID NO: 76219 - DNA, 201 bp, Homo sapiens
cccagaccagtctcaaattcctgtctccaagcaatcctcccacctcagcctcccaaaatgctgggattacatgtgggcaccattctgcccagctgtaattyttaaaaattattattaaaaaagaacaaaacacatagatgccctagactcaactcagctctactgatcaatctttaggggttaggactaggcttttgaaat

SEQ ID NO: 76220 - DNA, 201 bp, Homo sapiens
gacagaactagcagaacgtgtcccagctatcctgatgtccagcatgtgcattttgctagatcacctggatggagaagtaggtggtccactaggggtcactragctttttctggggattttaagtccagcgttgaaaggctgtttcttaacagaacaagaaagtagctttgacaagttgtctagatttatcattgtgacatt

SEQ ID NO: 76221 - DNA, 201 bp, Homo sapiens
gactcaactcagctctactgatcaatctttaggggttaggactaggcttttgaaatgttaaaacacccagaaaactgatgaccagtcaggcttagtatccsccatctctaccattcatatggtacttaatgtttcatatttaaatggaaaggacacctcacacttttttgtttttcctatagttcctactcagagaatatg

SEQ ID NO: 76222 - DNA, 201 bp, Homo sapiens
tcagcctcccaagtagctgggattacaggcgcccaccaccacacccagctaattttttgtatttttagtagagacagggtttcactatgttggccaagctrgtcttgaatgcctgacctcgtgatccacctgcctcggcctcccaaagtgctgggattacaggcatgagccaccacacccggccaactctatcatattttt

SEQ ID NO: 76223 - DNA, 201 bp, Homo sapiens
aacagtgccaaacacaatgtaaacagctacataagtgtttgctcttactattgagcacagtaccactctctacacaggaggaaaagatagtcgttacagcstaattgccattctgaaattgtgtaccacgtcgaaggtcaagtcttacccaggatcccgatgttgtcatacactccgaacatggcccttttctcgttccaa

SEQ ID NO: 76224 - DNA, 201 bp, Homo sapiens
atatactgtttcataccacaaacaagattgttctgtccttgaaaacaaaaccttttgtatctttgaatcaggaaatattctataaatgcctattgacctaytaatttcctcttccctaacaatcagatactctaccaggatatgtagatatcttcttcagggcaccttgcacttagcagagtcccaaatattttattttct

SEQ ID NO: 76225 - DNA, 201 bp, Homo sapiens
ctaaagcatgttggtcagaagcagtccaccacggaggggatgaacaacagtatacagtcatggtctttcatcagggctatgttaattctgttctctgtcaygatgtaatctaaaaaatgtggaccatttgcacattctgcagagtatcacattggtccaccatcttgtaactttacatccttcagacgtcttttttttttt

SEQ ID NO: 76226 - DNA, 201 bp, Homo sapiens
actaaaaaagtacaaaaaattagccgggcatggtggcgggcgccggtagtcccagctactcgggaggctgaggcaggagagtggcgtgaacccgggaggcrgagcttgcagtgagccgagatcgcaccactgcactccagcctgggcgacagagagagattccgtctcaagaaaaaaaaaaaagacatatatattttatgg

SEQ ID NO: 76227 - DNA, 201 bp, Homo sapiens; identical to SEQ ID NO: 31956

SEQ ID NO: 76228 - DNA, 201 bp, Homo sapiens
acgttgaatatatagatctggagttcaggagagaggtctgagctagagataacacatttgggaatataatagtattcagagccgtgagactgaatgaaatyaccaaatcagtaagtgtagctaaaagagcaggaatccaaggactggtaccctagggcactccagcattaagagtgaggatgccgggtgcatggctcacgc

SEQ ID NO: 76229 - DNA, 201 bp, Homo sapiens; identical to SEQ ID NO: 31957

SEQ ID NO: 76230 - DNA, 201 bp, Homo sapiens
catagtctctaaaattaattatacaaagcttaaaaataaataatataaagaagaagatagtaggacctgtcatttcatgttggatcatcagagaaggcttkctgttacgtcacgtttgagcagagaccttaagaaagtaaggaaataaactatgcagattgttagggaagagcattccaagcaaacagaaaagcctatgca

SEQ ID NO: 76231 - DNA, 201 bp, Homo sapiens; identical to SEQ ID NO: 31964

SEQ ID NO: 76232 - DNA, 201 bp, Homo sapiens; identical to SEQ ID NO: 31963

SEQ ID NO: 76233 - DNA, 201 bp, Homo sapiens
gtctcgcaatgtcgcctggcctggagtgcagtggcatgatatcagctcactgcaacctccacctcccaggttcaagggattctcctgcctcagcctcccawgtagctgggattacaggcgcccaccaccacacccagctaattttttgtatttttagtagagacagggtttcactatgttggccaagctggtcttgaatgc

SEQ ID NO: 76234 - DNA, 201 bp, Homo sapiens
atgcagctgtgaaagaccacttgagatgcagattgaatcagtcgttatatttaggaatgagaagtcattggtgactttgtcttttttttttttttttttgygatggagtctcgcaatgtcgcctggcctggagtgcagtggcatgatatcagctcactgcaacctccacctcccaggttcaagggattctcctgcctcagc

SEQ ID NO: 76235 - DNA, 201 bp, Homo sapiens
aaaaaaaatagatagggccaggcgcggtggctcacgcctgtaatcccagcactttgggaggctgaggcaggtggatcacgaggtcaggagatcgagaccayggtgaaaccccgtctctactaaaaatacaaaaaaaaattagccgggcatggtggcgggcgcctctagtcccagctactcaggaggctgaggcaggagaat

SEQ ID NO: 76236 - DNA, 201 bp, Homo sapiens
ggctcactgcagcctctacctcctgggttcaagcaattttcctgcctcagcctcccgagtagctgggattacaggtgcccgccaccacaagctgatttttrtatttttaatagagacgggttttgccatgttggccaggctggtcttgaactcctaacctcaggtgatctccctgctttggccccccaaagtgctgggatt

SEQ ID NO: 76237 - DNA, 201 bp, Homo sapiens
aacctcctcagttcaagcaattctcctgcctcagcctcctgagcagctgggattacaggcgcatgccaccacacctggcttttttttttttttttttttgkatttttattagagacggggtttcaccatgttggtcaggctggtctcgaactcctgacctgatgatccacctgcctcagcctacaaagtgttgggattaca

SEQ ID NO: 76238 - DNA, 201 bp, Homo sapiens
gtaatctgatggctgcaagtgctgggtgttttgaagttggggtatatgaaagaagtgagtgaaactgactccaagattctgcccctcacagtggtatcccrccactcccaggagcttccagctatcctggatgatacaactttgagtggatcagatagaaacgcccatctaaatgccctcaaaatgaactgttatgctctg

SEQ ID NO: 76239 - DNA, 201 bp, Homo sapiens
cacttgaacctgggagccggaggttgtagtgagccgagatcgtgccactgcacttcagcctgggtgacagagcgagactccatctattttttttttttttwaaaaaagatggtgaaaccccgtctctactaaaaaatagaaaaattagctaggtgtggtggcaggcacctgtaatcccagctactcgggaggctgaggcac

SEQ ID NO: 76240 - DNA, 201 bp, Homo sapiens
ttttttgtgattctaccaataaaagcaataaacctagttttctgccatggatagaatttactgaaaaggtttctcttccctccaaattgatttgttttttycatcttcatagcttttcaggctgcctttcgagctcaggggcccctggctatgctgcagcactttgatactatctacagcattttgcagtaagtgaaacac

SEQ ID NO: 76241 - DNA, 201 bp, Homo sapiens
tctactaaaaaatagaaaaattagctaggtgtggtggcaggcacctgtaatcccagctactcgggaggctgaggcactgaattgcttgaacccaggaggcrgaggttgcagtgagctaacatcatgccactgcactccagcctgggcgacagagcgagactccgtctcaaaaatatgtatatatatttgtgagggtggagc

SEQ ID NO: 76242 - DNA, 201 bp, Homo sapiens
taaggtgtaaagtaggcgtggtactgtctgcttttgctcaggtgtggtgaagctcaaacaaggctttaattgtaacacaaatataagatatcatcatcatyattttattttatttttttttgagatgagacggagttttgctcttgttgcccaggctggagtgcaatggcacgatcttggctcactgcaacctccacctct

SEQ ID NO: 76243 - DNA, 201 bp, Homo sapiens
accactgcattctggcctgggcaacaaagcaagaccctatcttgaaaaaaacaaaaaaatggaagcatgttcaaaggacacaggccaagttgaaggagatygcagagaccaagtatgggacaatttgagcaggaaaataaatagtaatagtaatggattaaagcacagaataagacaaatatccctaagtccattctgcta

SEQ ID NO: 76244 - DNA, 201 bp, Homo sapiens
aaagaaaaaattccagtatatttactgaaaaaaattagcatattagtggacctacacaattcaaatcgtattgttcgaagattaattgtagacatacatakgtgccttacttttctccagtgagagggcctaaaggcagtaatactctaatagaaatgagtgcaagtaatgcctagaatttggcttctacataccattatt

SEQ ID NO: 76245 - DNA, 201 bp, Homo sapiens
ggatcatgagatcaagaccatcctggctaacatggtgcaaccccgtctctactaaaaataaaaaaaattagccaggcgtcgtggcacgcacctgtagtccyagctacgtgggaggctgaggcagtagggagtaggcagtaggatcgcctgagcccaggaggtcaaggctacagtgagctatgtttgcaccactgcattctg

SEQ ID NO: 76246 - DNA, 201 bp, Homo sapiens
gccttacttttctccagtgagagggcctaaaggcagtaatactctaatagaaatgagtgcaagtaatgcctagaatttggcttctacataccattattccrtaatagccaggattccaccaagaatggttgattacaggactgggccagggaaaatacaagatgagcccagaacatcttttattttatttatttatttatt

SEQ ID NO: 76247 - DNA, 201 bp, Homo sapiens; identical to SEQ ID NO: 31969

SEQ ID NO: 76248 - DNA, 201 bp, Homo sapiens; identical to SEQ ID NO: 31970

SEQ ID NO: 76249 - DNA, 201 bp, Homo sapiens
tttgagaccatggccagccagacaaaccttgtggacctggaccttggtgggaaggtaatttggagttttgggctcacgttatatggggtctggggagatasgggaatagatggaaaagaagggaatccaatgatccacaaatcctttctgtcctcattgagaatttaggagaaagaactcaaaagtgtcacacgttttctt

SEQ ID NO: 76250 - DNA, 201 bp, Homo sapiens
ggagtcttgctctgtcaccgggctggagtgcagtgctgtgatctcagctcactgcaacctccgcctcccaggttcaagagattcccctgcctcagcctccygagtagccggaactacaggcgtgagccaccgcacccagctaattttttgtattttagtagagacgggtttcaccatgttggccaggatggtctcgatctc

SEQ ID NO: 76251 - DNA, 201 bp, Homo sapiens; identical to SEQ ID NO: 31975

SEQ ID NO: 76252 - DNA, 201 bp, Homo sapiens
ttttccttaaggtagagcttacaggatttgctaacagactgggtgtgaggtgggagggagagttcagtcaaggatgactctcccgggttttggtctgagcrtttggaagactggagttaatggtaactgagatagggagaaggctgtgaataggtgttttgggaggaagatcagatgttctgttttggacatacaaagttt

SEQ ID NO: 76253 - DNA, 201 bp, Homo sapiens
tctgtttgcttcctctagccacttacagcttatacattttaatgcatatagtatttcatgataaggcatcataggaggagtcgacattctcagggaaaatrcggaaggcctccatttgcatcttgctacattcagaaaggttctgtcgttaggtattgggggagttttgtgaagtagataggtgacatttgtacatgttct

SEQ ID NO: 76254 - DNA, 201 bp, Homo sapiens
agcaacttgttatagaaagtaatggctagaataaagaaaaccctgactttgggagcagtagggatagaatgaatgaggcagggctctgatacagttggatycagacagctgctttcatcatctcaaactcttcctttctcagtttggttactggctgttgctaccgccttctggagaatcccaccattaatcaccagaaga

SEQ ID NO: 76255 - DNA, 201 bp, Homo sapiens
ctttgggaggccgaggcaggtggatcatgagatcaagaccatcctggctaacatggtgcaaccccgtctctactaaaaataaaaaaaattagccaggcgtygtggcacgcacctgtagtcccagctacgtgggaggctgaggcagtagggagtaggcagtaggatcgcctgagcccaggaggtcaaggctacagtgagcta

SEQ ID NO: 76256 - DNA, 201 bp, Homo sapiens
aaaaattagcatattagtggacctacacaattcaaatcgtattgttcgaagattaattgtagacatacataggtgccttacttttctccagtgagagggcytaaaggcagtaatactctaatagaaatgagtgcaagtaatgcctagaatttggcttctacataccattattccataatagccaggattccaccaagaatg

SEQ ID NO: 76257 - DNA, 201 bp, Homo sapiens; identical to SEQ ID NO: 31980

SEQ ID NO: 76258 - DNA, 201 bp, Homo sapiens
ggagacagagtgagactttgtctcaaaagaaagaaagaaaaaattccagtatatttactgaaaaaaattagcatattagtggacctacacaattcaaatcrtattgttcgaagattaattgtagacatacataggtgccttacttttctccagtgagagggcctaaaggcagtaatactctaatagaaatgagtgcaagta

SEQ ID NO: 76259 - DNA, 201 bp, Homo sapiens
tatatattttatggtagtaaatgataaaatagactaggatctacataaattttatgcgttcatgacatatgtagctttaaaaaaaaattagccagatatgrtagagcatacctgttgttctagctactcaggaggctgaggcagcccgattgcttgagcccaggaatttaaggctgcagtaagctgtgattgtgccattgc

SEQ ID NO: 76260 - DNA, 201 bp, Homo sapiens
caattctcgtgcctcagcctcccaagtagctgggaccacaggcgcgcaccaccacaccgcactaatttttttatttttagtagagacagggtttcaccatrttggccaggctggtcttgaactcctgacctcaggtgatccacccatctcagcctcccaaagtgccatgattacaggcgtgagccaccgcactcggctgcc

SEQ ID NO: 76261 - DNA, 201 bp, Homo sapiens
ccgtgcaacctccatccctttgttttcgtcacaagaggaatgaatatctatgttgacccacccttaggcatagaacaaacagaaataaggaaagtatatgrtgttcttaatatgtgtttcattttcttttctttcttttccagaaagtattttggagaaaaaattggactgtattttgcctggctgggattatatacatca

SEQ ID NO: 76262 - DNA, 201 bp, Homo sapiens
aaaacaagatggggtaagataagctagaatgcaataaatattagtattcattataagaaggatgggtaagtgttgcttcattagattttgtttcatttttrtaagtgtgtttgtgagagtgagggtatgtatttgcatactgaaatctgatgtaacagattgttttaactgtaggtcacagtcaaaaacgtttaaaattac

SEQ ID NO: 76263 - DNA, 201 bp, Homo sapiens
actctaagggtttgtgtctttcagccactcataactgtgattaaaaacttacagtattcctgggattattttagaggttgctaattttgtcatcaagcctkaaattcactctgtctcactttttaaaacctttttattttgaaaaattttagattcacagcgcaggaacttgcaaagatagtacagaggggcccagcgtgc

SEQ ID NO: 76264 - DNA, 201 bp, Homo sapiens
ggagagcagctgcgtcccgggagcacacgggcagtgttcagcccatcgagagctggagcagggagcaggaggaaatggaattgtgaccatagactcctggractgttcacaggcagggttggtagaacacactgaagttggggcttgttgcctgggaagtcactggcagctctgtgtctccttatcaaacaggagcattgt

SEQ ID NO: 76265 - DNA, 201 bp, Homo sapiens
cattccttcagtctgacttcctcccttcatggagacaccagtcggtcagcactctgggcactgttgtgtgcacagccctcctcgggaaccaaggaaggagyggtaggaagaggagggacttactaccattcttagtatccccagaccaaagccagtgttaggagggaatacacccactcgagaaaggcctcaaatccaagg

SEQ ID NO: 76266 - DNA, 201 bp, Homo sapiens
accaaagccagtgttaggagggaatacacccactcgagaaaggcctcaaatccaagggagaaaaacatgcaaatcagtgtatgcaaaatgtcatgtcagawgaaaacatgcacatcagtgcaccataatgtagctgcaagtaaaacaaatgcagctttaagtaactgtgtattcaaccagtgcataggtgtttgatattct

SEQ ID NO: 76267 - DNA, 201 bp, Homo sapiens
tgagatcataaagccagagagtcagggatatgtcagaatgccctgggggcctcctgagggccaaaggagaggcagggtgtcaggtgctggttgtctttgawgtctgtgaatgaagaaagaaacactaaacctctgtggtataagccagtgcactatgtgtgaaactgaggagttggggaggcgtgagctaagggaaaggat

SEQ ID NO: 76268 - DNA, 201 bp, Homo sapiens
aaactggtccttccaatagaaagaactctagaagtttgaatgtgggtgatctagtggggaaatgtttgtattatttgtcccatttgatttagctgaaataygtctcatatatatgagagagacagagagagaggaggctgggggaggtgggtagggtagagtgcctactccgctaatgccgtagaatgtttccaaaaaaga

SEQ ID NO: 76269 - DNA, 201 bp, Homo sapiens
tgagtaaataaataataaaaaataggtaaaaataaacttctatctccagtagtagtaggttaggatatttgtaacatcccattttgctaaaatttattttwaaaaattggataaatgtatttttcaatcttctcaaagcctcgaagggctgacaggataggaagtaataccaggctaaaatctaaaggaaaatgggaacca

SEQ ID NO: 76270 - DNA, 201 bp, Homo sapiens
agagtgagcgtctctccttcccatgttcccagggtgtcaggtgagactcgggtgcagatgcagctctgcttctatctagcagtgtggcctagggcatggcrtcgtataatttccctggcttcccttttttcctggaaattgtagggaattagaccagagaatgagtttttccctgcagtgatgcaacccaccggtctgtgg

SEQ ID NO: 76271 - DNA, 201 bp, Homo sapiens
gagctaggtgcctgagctttcctcctgtgccccagatactcattttcttacacttggatattgggagtccaccatcagaaatcctcctccacagcctggaytctcatcatagccccttcactgatctccctatttgcacactgcccctgacagatcatcagcatgctaacttttaaaacctaaaccaactcacatcactcc

SEQ ID NO: 76272 - DNA, 201 bp, Homo sapiens
cctggcgtacagtaagtgctctatgaatgttttcttaagaaggaagaatgaaagaagtgatcctgtagtgaggaccttttgggccggctgggtgtggggasgggctgtcagttggactctgcagacgttacctttcatgaaaactctccagacatccttgtggtattgatttagttgggacaacctacaccaccccttgca

SEQ ID NO: 76273 - DNA, 201 bp, Homo sapiens
ctccgtgtttcccccactgccctgggctgggggaaagcacctctggaagggcagggatccagatgagcaggaaacactgtggacttcctttctctagaggmctctcagaatggtcagagtcctgttggcttggggtgtaatgaacctgccatgcacagcaggtaccctaaagacaccttcctccccaggcttctctgcaga

SEQ ID NO: 76274 - DNA, 201 bp, Homo sapiens
ggaatgctgtcatccatagagctggtctcctatagcagcataaattgatgaacttatgcaattatctggatagttcaggaaaactaccccatatattagayaactactgctatgataatgctttgtagcaaatactccagagtcccggtgacttaaaacggagacagagaatcaaaaacaatgaaaatgacgggctctggt

SEQ ID NO: 76275 - DNA, 201 bp, Homo sapiens
gggacccacagtttccatttggacttcctgcaggcttctcgacccctacttcctgttcacctcctgcgcccattctctcatttgccacctgtcttccatcygctccaagccctcatcacctctgcctttttccagcttccccttcccctccagggtctatgtttctgattattccccacagttggagttccttgcattctt

SEQ ID NO: 76276 - DNA, 201 bp, Homo sapiens
ggtaaagaagcaaaccagcagggaagccctagaagacagcattcatgtctgcctctggagttcaaatgaagagagaagaggaagtggagagtcccattttycctataaccctggaaggaagttagatttcagagtaccatgtgcacgaatgtggtgagggcatgctgtgtacatttgcaatccctcagaagtaaactgccc

SEQ ID NO: 76277 - DNA, 201 bp, Homo sapiens
tgaatactatgtcttattttttctatttttattttgtactcattaaccattcccacttcctgcccactcccctactgtccttcccaggctctggtaaccayccttttactcttaatggattattttcatagtgctcttgacagctgggttgatctggatatttttggaagctcacgaagtaatcaaatccactggtttttt

SEQ ID NO: 76278 - DNA, 201 bp, Homo sapiens
cactagtacattctttattctctcttggcatacataaaaccttgttgcacatgtttgcctacacttaactctccactttcaaacccagcttcttgcaggcmagaacagacctttgccttcttaaatacttggtacagggcctgacatttataaatgctctccataaatgcgtgatggatgaataaactttctaaacaaagg

SEQ ID NO: 76279 - DNA, 201 bp, Homo sapiens
aaactttctaaacaaaggcagtgactgtagacatggaaagaagagtccaaatctgggaggtggtttttaaagctatttcaagggaaggcaaactgtggccygtgggccaaacctagtcactttatatattgcttttgtaaataaagttttattggaactcagccaagcccacttgttgatgtgctgtctatagctgttttt

SEQ ID NO: 76280 - DNA, 201 bp, Homo sapiens
atctggtgaggcttgatccctcagctcccatgatgtccctaaagacaaccaatttctctatctttctgctcaaccatctgcagggtccacttcatcttttrttttctcactgatcccccttgctgacccaggacttccctttatggagtgaatcgatggccactgttatcccccagagtctgacggaaggagaaagctgct

SEQ ID NO: 76281 - DNA, 201 bp, Homo sapiens
actggcagtaaagggtaaaggaagcaattaagacttttttttcttgtatctccccaccatgcctaatccagagctttgctcccaagtgatggcattgaccracaggcctgcaggtacttagaaagaaataccgtgtatgtgacacaggaggaaaagggagactaaaaattaccccatatgggaaagatacccaaggcagaa

SEQ ID NO: 76282 - DNA, 201 bp, Homo sapiens
tacatttttgcatatcttttccctctagcctttttgaggtataactgatgtataataaactgcacatatttaaagtatccaatctgttgagttttgacatrtgttcaaaaccatcactgtgaaaccatcactgtcttgtaatcaagaaaatgaacatatctaccacccccaaacatttccacaggtccttttgtaaagtct

SEQ ID NO: 76283 - DNA, 201 bp, Homo sapiens
aaacttctgtgctttggttgttcctttgtgtccaggaaaccagatatgtctatgaagcttaatgctaggtctcaggctttgtatgacaagtatgtgttttyaggtaccaatgctggggcctaagccttccctggtcatgtttcttggccctgcccctgtggatgtgggacagtgttgctaggcctggttgtgtcaggctgc

SEQ ID NO: 76284 - DNA, 201 bp, Homo sapiens
tcaggctccagaacccatggccttcccggggcctatcttacatggtgaggattattccctatttcttccacctgtaggatttctgaagtagaataacaccyagagaagcctgagtcacactctgttgctgactccccataggttaggtctttcaaggtgccgtgctgcctttggggtcctctgcagctcaggggttgagtg

SEQ ID NO: 76285 - DNA, 201 bp, Homo sapiens
gaattaagaggagaggagaagatgagctatttcacatgaaatattgcagagttggtgacagtagacataggagagtggctgagctaggattatctccaaarcttggactgaagtcagaggactgggatgtggttacattgatagggagagggaatatgctgagagagtctaattttatgctacatatgatgaatttgattt

SEQ ID NO: 76286 - DNA, 201 bp, Homo sapiens
aattttgtctcaaaaaaagaaagaaagaaagaaagaggttttcccttataaaaccatcagatcttgtgagcttattcactaccacgagaacagtatggggkaaaccgcccccatgattcagttacctcccaccaggtccctcccgcaacatgtgggaattatgggagctacaattcaagatgagatttgggcagggacaga

SEQ ID NO: 76287 - DNA, 201 bp, Homo sapiens
aaccagacacaagaattgatgaataaatttactcataagtgtcaatttatattagcctagatgtttcaggatttttcgcatctgggcctataaagagtctkactctcatactaaaatcacattgcaggcagatttgctgccaggctatgcactgcctgggggcccctctgcatggctgacatgctagactgtctgtccatg

SEQ ID NO: 76288 - DNA, 201 bp, Homo sapiens
attattttcctatttatacttctatatccaaatacagtaattggcttaagtaacagcttctgcctcagtaagaggtgtctgcaaagaaggatattagcatsttttaaagcttgtccatatttcataattcttacatttgactttgaggaaaaagattcataaaaccgctttgaattatgccagtcaaaacaaattatcttg

SEQ ID NO: 76289 - DNA, 201 bp, Homo sapiens
aaagaaggatattagcatgttttaaagcttgtccatatttcataattcttacatttgactttgaggaaaaagattcataaaaccgctttgaattatgccastcaaaacaaattatcttgagatcaaaagtcttataagtataagttgataaataaattaattgagttttaaatatagttaatactgcatcccatgtgctag

SEQ ID NO: 76290 - DNA, 201 bp, Homo sapiens
ccagtcatcaggaacttcctattcagtgttgccaggaatacctgctctctctttcctgccactggggcctcatgaatcttgggcccctccctctctgatcmctgtacttctgcttttgaagttattagtaataagagatgcttctactgtgctaggaacataaagtaactcatttaatctttaaaaccactccatgaagcg

SEQ ID NO: 76291 - DNA, 201 bp, Homo sapiens
cactgtaccttttctctacttggagaaaagttccagggaaggagggatcttgtgtctaggactggcagtatagcctcagtgcctggaaagagctcagagtwtagcaggtgcttgatgactcctggttgaagacatttgttggatgtatctctggacttacctctttacatcagacaaatgtggtcctgagcaggcttgggt

SEQ ID NO: 76292 - DNA, 201 bp, Homo sapiens
gtctgagtgcttaggaagctaggcttgctttaaaaagttaagggttatggccgggtgcagtggttcacgcctgtaatcccagcactttgggaggccgaggsgggtggatcacctgaggttaggagttcaagaccagcttggtcaacatggtgaaaccccatctctactaaaagtacaaaaaaatcagctgggcctggtggc

SEQ ID NO: 76293 - DNA, 201 bp, Homo sapiens
aaaaaaagaaagaaaaaaaagatgagggagctttgaactggggcccagcatggggggaggtgagccacagccacacctagagggattcaagcaaactcctytgtgtgctgccacatcatgtcctggaaagccagagataatcagaaacatcctgtcggtcagctgagggtgcctcccttagcccctgtgcagggtctggaa

SEQ ID NO: 76294 - DNA, 201 bp, Homo sapiens
gagcttcagaatttgtgctgtggttcgtaaaaaaactcagagtatgtatgttggggggacatggggatgctctttgggatacctgtctctgtgtgccaccygtctttgaaagcgaggaggggtggggagagagagagagagaggagagtttatgtctttcttaatctggttcttgaaaaaaaattccactagattgaaaat

SEQ ID NO: 76295 - DNA, 201 bp, Homo sapiens
ccaccccatagcaatatacaatggataattttatggaaatcacatgtaacttttattgaccactgactcattgaattttaattccatagacgggaatgccraggaaccggaattgtgtacactgaggctgtggttctaatataaacattgcttgggtatatatgcatgattggtcaaataactttcaggaaccatgaataa

SEQ ID NO: 76296 - DNA, 201 bp, Homo sapiens
agactgaggtctataggggaacataagttgatcaatgataatacatggcagagccagagtcgaagccaggcagtctgactcaaaagcaatgcttttaaccycttgctcctgtgtctgctgaaagttttccttcaatagatcctcaaacactcctaaaaagtcatgtttgattcttctttcctaaactaaaggcagaaagga

SEQ ID NO: 76297 - DNA, 201 bp, Homo sapiens
gccattctcctgcctcagcctcctgagtagctgggactacaggcgcccgccactgcgcccggctaatttttttgtatttttaatagagacggggtttcacygtgttagccaggatggtctcaatctcctgacctcgtgatccacccgtctcagcctcccaaagtgctgggattacaggcgtgagcccccgtgcccggccag

SEQ ID NO: 76298 - DNA, 201 bp, Homo sapiens
tcaagctttttattggtgttacatctctgcctacagtgtgaagactattgggttacactgagggttatgtttaacataaagagatgccctactgtgaaatrtaggtagatgttcagaaaataaggtcagcatgtgatctagacataatatgtcaaataggtgtgctctgggggctgcgtttcctagattgataagggttgt

SEQ ID NO: 76299 - DNA, 201 bp, Homo sapiens
gtttgattattttcttcttgttttaaactgatttccatgcttgtttgggggtagaatcttggtttctgaagtctgggtgaacggggaggccaaagcaaatmcctgttgttgggtaaagttgtggatggatgcttacttttcaacatgcctctcctgccccattcctcctcctctaatgtactttctcctcccttcccttat

SEQ ID NO: 76300 - DNA, 201 bp, Homo sapiens
tttgattattttcttcttgttttaaactgatttccatgcttgtttgggggtagaatcttggtttctgaagtctgggtgaacggggaggccaaagcaaatcyctgttgttgggtaaagttgtggatggatgcttacttttcaacatgcctctcctgccccattcctcctcctctaatgtactttctcctcccttcccttatc

SEQ ID NO: 76301 - DNA, 201 bp, Homo sapiens
tgagacatttcaactaagctagagacatttcctgctctgttatatatttcacattgcttgtccctggaaaaattacctaccttagactgacaggcctgggmcttcctacagaaatatctgtgccctggttctcccttctgtgatgacaaggaccaaattatgtgttacagctcattttacacgaactgaagttttagttgc

SEQ ID NO: 76302 - DNA, 201 bp, Homo sapiens
aatgagctagtattcacatgaatcattctgggatgggggtgaaaaggcaagggtgagggaaaacccaaggcttctctatgggtctgagaaagaggcatgarctcacgtcaggcattaacattttgtagtttaaaccatgcagacagatcaggaagatgattagcaaaacagaatactgatcaactgtgatgcttaatgacc

SEQ ID NO: 76303 - DNA, 201 bp, Homo sapiens
ttctgtgatgacaaggaccaaattatgtgttacagctcattttacacgaactgaagttttagttgcctgttgagatttgggagcccctccagtcatattgrttacttatttataacatcttctttagggatggattgtatcctctgacggctaatctcttcatgttgtgttaaatttcctgtcgatttcagcaacttatat

SEQ ID NO: 76304 - DNA, 201 bp, Homo sapiens
atgagctagtattcacatgaatcattctgggatgggggtgaaaaggcaagggtgagggaaaacccaaggcttctctatgggtctgagaaagaggcatgagmtcacgtcaggcattaacattttgtagtttaaaccatgcagacagatcaggaagatgattagcaaaacagaatactgatcaactgtgatgcttaatgaccc

SEQ ID NO: 76305 - DNA, 201 bp, Homo sapiens
gttttcagtattttgctattagaaataatgctgtcacaaacatattttttccttttacttttagttgatgtaactgtacatacttatgggatacagagtgrtattttgatacatatatgcaatgtgtaatgattaaatcagggtagttagcgtatctgtcacccctaatatatcatttctttgtgttgtaaatattcacaa

SEQ ID NO: 76306 - DNA, 201 bp, Homo sapiens
ggcttctctatgggtctgagaaagaggcatgagctcacgtcaggcattaacattttgtagtttaaaccatgcagacagatcaggaagatgattagcaaaasagaatactgatcaactgtgatgcttaatgaccctcccatcccaaattcactcagcctccagcttggtctggatcagccttctttttggttcaagaatgca

SEQ ID NO: 76307 - DNA, 201 bp, Homo sapiens
catcacagtttgaaaataaagacaaagggtaatgtgttaacattcataatcattgtgatctcctcttagcgagagggatgatgctgtttgccatctttcascaaaaacataatttctggggccgtgatggagagctgggcttgcaggtcagcttcacagatggtttcttttcttaccctttattttcacttagttggaaaa

SEQ ID NO: 76308 - DNA, 201 bp, Homo sapiens
gccactcctgtacaggaaatcttacaaccagttttaatttcctcagatttttttttttaagacggagtttcactcttcttgcccaggctggagcacaacgstgcaatctcggctcaccacaacctccgcctcccaggttcaagcgattctcctgcctcagcctcctgagtagctgggattacaggcatgcgccaccatgcc

SEQ ID NO: 76309 - DNA, 201 bp, Homo sapiens
atgggcgggaaccagggctgcgcgtggcgcttgggggccagcgcgagttctgggtgggcgtgggcttggcaggccccgcacttggagcaaccagccggccygccggccgtgggcagtgagaggcttagcacctgggccagcagctgctgtgctcgacttctcgtggggccttagctgcctccccacggggcggggtttggg

SEQ ID NO: 76310 - DNA, 201 bp, Homo sapiens
cctcccaggttcaagcgattctcctgcctcagcctcctgagtagctgggattacaggcatgcgccaccatgcctggttaattttgtatttttagtagagayggggtttctccatgttagtcaggctggtctcgaactcctgacctcaggtgatctgaccgccttggcctcccaaagtgctgggattacaggtgtgagccac

SEQ ID NO: 76311 - DNA, 201 bp, Homo sapiens
ttttcacttgcattaataagtgccataaaatatctttttattttgttcatcatttcaaaagcacatgtgagcacctcctccatagacagtgttcttcagtkgggggacgtagtcttctatttgccatctatctctctgccaggcacactgaaaatgcagacagtcagagcctgtgagttgaagattttctatatagtcttc

SEQ ID NO: 76312 - DNA, 201 bp, Homo sapiens
tcccagcactttgggaggctgaggcgggcagactgcttgagctcaggagtttgagaccagcgtgggcaacgtagtaagaccgtgtctctacaaaataattwaaaaatatagctatgcatggtggcatgggcctgtagttccagctactcgggagcctgaggcaggaggatggcttgagcccaggagttagaggcagcagtt

SEQ ID NO: 76313 - DNA, 201 bp, Homo sapiens
taagaccgtgtctctacaaaataattaaaaaatatagctatgcatggtggcatgggcctgtagttccagctactcgggagcctgaggcaggaggatggctygagcccaggagttagaggcagcagttagctgtgattgtgccactgcactgaaacctgggtgacaaagcgagtctctgcctcttaaaaaaaaacaaaaaaa

SEQ ID NO: 76314 - DNA, 201 bp, Homo sapiens
catgggcctgtagttccagctactcgggagcctgaggcaggaggatggcttgagcccaggagttagaggcagcagttagctgtgattgtgccactgcactraaacctgggtgacaaagcgagtctctgcctcttaaaaaaaaacaaaaaaaaaaaacccaaaaccaaaaaccaaaaaaacttttatgttcaacagagattt

SEQ ID NO: 76315 - DNA, 201 bp, Homo sapiens; identical to SEQ ID NO: 30022

SEQ ID NO: 76316 - DNA, 201 bp, Homo sapiens
gcattactttaactttcataaagaataaagaactagcttgaaaaaaaaaatgtccttactttggattctcccagatgcagaccctgagccagtgattcaastgcaaaattctgggggaggtagactctccagtagtggagtgagcaagtgagagagacaagggaaggcagcccagaaggggtgcttggtcaatcaggttac

SEQ ID NO: 76317 - DNA, 201 bp, Homo sapiens
aaacagcaaaaggacactagagtgcttccttcttttttcagatcatgaatccattcatgagggcagagctcctcaggacttaagcacttcttaaagacccwgtctcttaacaccatcaccttggggtttaagttccaacatatgaattcttcagggactcatatattcaaaccagaacagtgagagagctgagtttatgtg

SEQ ID NO: 76318 - DNA, 201 bp, Homo sapiens
gcataaacatgtgctttcctccccccacctcctttgttctttctactactcgactgttggctttgtcatctccaaagcagactccaggaatttctatggaygttgggtgaactacgtttttgggaagtgacagatgatagaatggggaacatgctccaaacccttgttcacccctgttctgaagtatcccaggggctgttc

SEQ ID NO: 76319 - DNA, 201 bp, Homo sapiens
tgctccaaacccttgttcacccctgttctgaagtatcccaggggctgttcctgtgccttgggcacttctgttcagcagcagaaggaccataaacttcctgycttgatcatgtggggtctttgaggaggcaccacatctaaaagatgccctttggcagtttcccccttacttaggcttgctaacgtttgatgtttttgctct

SEQ ID NO: 76320 - DNA, 201 bp, Homo sapiens
aatgccaagatgacaagaaatagcaatctgaatctgtgctaacattcagctcccccatcccggacttccatgtgtttagtggtttccttactgattctccmaaccttactggaaagaaagaagcctgcccatgtggtccgctcttctttcagatggggcagcccaagtgagattgtcatgaataattgggaacaaagtcca

SEQ ID NO: 76321 - DNA, 201 bp, Homo sapiens
ttctccctgtcagaagctggctgcagcacagcctgagctgaatgctggcctttgcggtgggatggtttgctttaccagtcattctttatccacagattgtycaaagtcaattccacatctgggagctgatgctggtgcttttcctaaaaaatacttctcaggtttttccagcattctgatgccacattcatgcttttctgc

SEQ ID NO: 76322 - DNA, 201 bp, Homo sapiens
ctggtgcttttcctaaaaaatacttctcaggtttttccagcattctgatgccacattcatgcttttctgcatcatggtttcatttatgcttggtctagggycgtgggcctgtattgatttccacagcacctttgggccatttatgcaactgtggtgggagatattttacataagcttggaagagttactgcccaaccaggg

SEQ ID NO: 76323 - DNA, 201 bp, Homo sapiens
gcgcctaagaggccttgtcagccatgtaattttaaaagtttggttttaatcccaacttttataagtcagcaaacattcattcatgtgtagaggacctactracaacagaatcaaaaaccataaacaaatacagaactagacactagagaatgtgcattgtgtaagtgtatcactgtctgtctacactcagtgttgttgctg

SEQ ID NO: 76324 - DNA, 201 bp, Homo sapiens
tgtaattttaaaagtttggttttaatcccaacttttataagtcagcaaacattcattcatgtgtagaggacctactgacaacagaatcaaaaaccataaamaaatacagaactagacactagagaatgtgcattgtgtaagtgtatcactgtctgtctacactcagtgttgttgctgaggggaaacttacctgtggacaca

SEQ ID NO: 76325 - DNA, 201 bp, Homo sapiens
cataagtaataactatggaacttcgatgatccagcgactggaggaggagcagaggaaagcatcaataaataaaaagaggcggacgatgggtgttaatttckgtcaacacgtgtgctcccagctgcagcacacgttctgttcttaggtctggtctgcattcctcctgggtgacctttcctgcctgttgctgggagagacact

SEQ ID NO: 76326 - DNA, 201 bp, Homo sapiens
acctggagaggctgtgaatgcacctttcactgcaggtcagccactcgcatgataagagcttgtgtctgtttttccacaatttcagctctttgtcttcaggrgataagactgtcactcagggccatcttagcagatttgatgctcagaatctgcttttgaagttgggagttagaatccctgagttcatcattttctttcatc

SEQ ID NO: 76327 - DNA, 201 bp, Homo sapiens
aggcgtatcatgtacccagggagggcataatggggaacagctggctaacatgtgtctcgccatttctgaggttgttcataattctctgatatccaagaatracagtaataatgatgccactgctgattgtattaataataataaagaggattggggtgtctttcctgaatcctgccgaagtaaagaggagagcctgggctg

SEQ ID NO: 76328 - DNA, 201 bp, Homo sapiens
gcttaagtgacaaggtgggctcatagtgtttccattgtctgtgtgaggaaggaactaagggcattgatggaactggtgttgcgagtcctcaggacagcacrgctcccaccactgctgtgatccagcctgtgaacgtcagcgcagctggtgtccttgggtgggcgcttgctgcctgctttggtgccacatgcccgcttccca

SEQ ID NO: 76329 - DNA, 201 bp, Homo sapiens
attcccagcccctctgagtctcagtgttctcatctataaggtagagatgctaatcctacctggcaggcacacctgacagagtttgtatggaccgtggatgraatgatgctcagggaagtgctgggtacactgcaaaacattccatacatggaagggtttgttatcatccttgtgtttctccagggcttaccacaatcaacc

SEQ ID NO: 76330 - DNA, 201 bp, Homo sapiens
cccagctactcaggaagctgaggcaagagagttgctcgaaccctggaggcagaggttgcagtgagccgagatcgcaccactgcactccagcctgggtgacrgttagactccgtctccaaaaacaaaaacaaaaacaaaagacaaacatataattcagttcaacttaatccagtctattcatcgagcaccttctctgtgcca

SEQ ID NO: 76331 - DNA, 201 bp, Homo sapiens
atcaagctgatgttagagcagaggaactgctggttggtaaggatgcctcagagatgaaaaggagaggagggtggtctcagagaaccagaagaggagtgggwaagttggtcctggaagaggacttctcactccttccccaagccttgccctgtctcttgacctcccttgactccctgctcttccagctcagctttgtccatg

SEQ ID NO: 76332 - DNA, 201 bp, Homo sapiens
ggggtttgatggcttaagggtgggaagctgggtgccctcattctcactcttccctgggtacatttcttccctacctctctgatcttccctcctgcttatcwtgtccaaactgcaggtttgttttcacaaccttccattcattgaaatgccactctgctgctcgtccctttctaagatgctaagaggatgtggcctatggga

SEQ ID NO: 76333 - DNA, 201 bp, Homo sapiens
tgagaatgcacagatcattgagatctttattttacagatgaaaaaactgaatcccagaaggagaacattcctatagcaagtaatgacagagctgggtcttrgaagcacatctcctgtctgtcaggacagagttatcctatatcccaaccttagggcagatctgagaactgacgacagcaaggcaagggaatgggttacgag

SEQ ID NO: 76334 - DNA, 201 bp, Homo sapiens
taaaggctttttgtccctgtttctaaaaccatggcgtattcctgaagaaaataggcattttagattatttaaattgagaatggagaagggagattgatttrtgtttaaatggcagtattagtatgtgttgtggaggttgggagagaagtgatttaaaagtgtagaaatgggagaaagaagcttgagtttgaccaaagaaaa

SEQ ID NO: 76335 - DNA, 201 bp, Homo sapiens
gagagcaccagttgagaaacattggctgtccaaattccttaactgatatatgcagaaatggaggcacagaaacttgagcaccttggcctagatcacacagmcacaggaaacagagatggggctcggaacacctctagccctcaaatccagggctcttgcttaaaacatgtgatgatccatgccattatagcttttggaggg

SEQ ID NO: 76336 - DNA, 201 bp, Homo sapiens
tggcgggaagtggagtctgccctctttgttgggatcctgctccacagtttggaagcaggtgaaactttcagatggcctctaatcaacctggggtgcttccyggcggaggtgctatgttagggggcacgtgaataatagagagggttgcctatctcctcaccctctctccattagattcccctccatcgtatccccatagcc

SEQ ID NO: 76337 - DNA, 201 bp, Homo sapiens
accctgtgacccctctttgctgtcccccagtatccccctgaagatttatcctcaggctttgtagctgcgtgtttctccctctaagcctctcgctggtcctyttgaactttttccttctccctcctccaataatcctaagtcttcaccccttttccctctcatcccctgtctttaccaatccatcccagctactctctttcc

SEQ ID NO: 76338 - DNA, 201 bp, Homo sapiens
ccatcagaggaggcctcctggaaggttcagtggctaagctgagttttgaataatgaattgctatgagttgggtatagagagggggatggacattccagataggggggaatagcatgaattaaggcatgaaaggtcgaaaaagcacaattgttgaggggttacaagtagctgactgtagctggaatgaagagtgtgcatgag

SEQ ID NO: 76339 - DNA, 201 bp, Homo sapiens
gttttccatgggtaaagtgagaccatggagacccaccttacataattgttgagaggattgtttaaaatacatattttggccaggtgtggtggctcacaccrgtaatcccagcgctctgggaggctgaagcaggaggatcacttgagaccaggagttcgagatcaacgtgggcaacatgaagagacctcatctctataacat

SEQ ID NO: 76340 - DNA, 201 bp, Homo sapiens
gaaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgt

SEQ ID NO: 76341 - DNA, 201 bp, Homo sapiens
aaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgtg

SEQ ID NO: 76342 - DNA, 201 bp, Homo sapiens
ccattataaggctactagtggacttctcagcagaaaccttgcaggtgaggagagagtaggatgatatattcaaagtattgaaatttaaaaaacctgccaaycaagagtactatatctaggtcaaagaataaatcaaaaaaggaaattagaaaatatctcaagacaaatgaaaatgaaagcacaacatattaaaacttatga

SEQ ID NO: 76343 - DNA, 201 bp, Homo sapiens
ttccagatgacatgatctcatatgcagaaaaccctaaagactctaccaaaaaacttttagaaataataaattcagtatagttgcaggatactaaatcaacmtgcaaaaatcattttcatttctgtgcactaacaacctatctaaaaagaaaactaagaagaaaagtaccattcacaatagcaccaaaaagaataaaatacc

SEQ ID NO: 76344 - DNA, 201 bp, Homo sapiens
caaaagcaaaaatagacaaatgggaatatatcaaactaaaatgcttctacacagcaaaggaaacaatcaacagagtgaaagtcaatatgcagaatgggagaaaatatttgcaaaccatatatctggtaagggattaatatccaacatgtataaggaacttctacaattcagtggcaaaacaaagaaacacacaaaaaacca

SEQ ID NO: 76345 - DNA, 201 bp, Homo sapiens
aatatgcagaatgggagaaaatatttgcaaaccatatatctggtaagggattaatatccaacatgtataaggaacttctacaattcagtggcaaaacaaagaaacacacaaaaaaccaaatagcctgataaaaaaattaagtaaaggacctaaatagacatttcaccaaagaagacatacaaatgaccaacaggtatagga

SEQ ID NO: 76346 - DNA, 201 bp, Homo sapiens
aaaataattccttcatttttctcctcctcccttcctcccagagtatggggtaataaacttgttctgagccataggtagctgactgtaaacacacacagatmcacacacacacacacacacacacacacgcctattctcacaaactggaataacgcgggataaccaccccatggtaactgagcatttctaagaagacacacc

SEQ ID NO: 76347 - DNA, 201 bp, Homo sapiens
tacagctcctcacagatcagatggcctggaacactcccacggtccctgggcaaagccaagtcttggtcaggagggagaggaggaaggagcctcaggagaaygggacgctgggcagcatgtgtgtggggagccaaggcagatggtgatggtggttgtcatcccagtggcataaggaactctctgacctcaagaaactgctgg

SEQ ID NO: 76348 - DNA, 201 bp, Homo sapiens
acaggccccacaccatgacagttttgctccatgactacttactaccatgcatggcaccctccgtgtgcctcgcggagaagttgccctcatatggtctgtgytggaagagtgacggagcaggggaatctggcacaggcggaacgtgataattcatgcacaggcctggccaaggtctttcccacccgtttctttgggttttca

SEQ ID NO: 76349 - DNA, 201 bp, Homo sapiens
aactgctgatttcccttattttggtcttagttctgcttcctggagctgcacagaacaagtataccctgttgtataggtcaaccctttaaatatttgaaaayaacaattgtgtcaacaacagtgctcatatacctaagctttctttcccacaccccaaatactcctaggactttctgcgtttccatatcaacgtgtgttccc

SEQ ID NO: 76350 - DNA, 201 bp, Homo sapiens
ttgtataggtcaaccctttaaatatttgaaaacaacaattgtgtcaacaacagtgctcatatacctaagctttctttcccacaccccaaatactcctaggmctttctgcgtttccatatcaacgtgtgttccccacacagccttatcatcgtgattgtccttcttgggactcactggtggggtaacttggaagaggaggag

SEQ ID NO: 76351 - DNA, 201 bp, Homo sapiens
gggactgatcttgccttagaaggagcaaggggactggcgtcctgtgagttaccagggacacggctcaactgtttgatcccgggagccactgtttgaccacrtgtccctggaacccctgagcacctcagtcctcctaataatattccctggagtgatgttctccacccacaccacatggctatgtaaccaacataaacagaa

SEQ ID NO: 76352 - DNA, 201 bp, Homo sapiens
aatgtcaagtagactggtgggttcatgagattggaaaccaatgagctggaagaatatgattcactttgcttttctgtggttcccatcccatgaactggggcaaatcatataactggcaaatggggtttcttggctattttagggtcattgggaatctatttccagtgctatgaactcctgtaaggcatttctctctgcttc

SEQ ID NO: 76353 - DNA, 201 bp, Homo sapiens; identical to SEQ ID NO: 30052

SEQ ID NO: 76354 - DNA, 201 bp, Homo sapiens
catgtcttagtctgtttcctaaaatggacttgagatggatgacaaccaaaagaattttggttgtaaaaggacagataaaaagaatcatgtaactggggagkgggggaagtaggggaagtgcaagggaaatgatgatagtggaaactaaaaataagggtgatggatgcaggagagacagagttgcattctgggctttctggt

SEQ ID NO: 76355 - DNA, 201 bp, Homo sapiens
ctgcacccggccccagatcttctttttatcatagaaggcaatggcttgtagtggagctcacggagggtgttatacacagatgaggggggatataacttggyatgctgggtaggatgctatgtttgtaaaaattaatctgaggctctgatcccaggggtgggggtctgggttaaacccagttcctgagttgagagaggagca

SEQ ID NO: 76356 - DNA, 201 bp, Homo sapiens
tgggatactgtgtcaagtagtaactcattagcccagcaccaattctgtttgtcaatgtggtgggttagggagtagggagaggcaaagcatgtgattgcccsccaaggctgcagataaaacagaaagaactttttcccaaagtttcttggtcccagactcgactcagggggactgttttggcttccttttaccacatggccc

SEQ ID NO: 76357 - DNA, 201 bp, Homo sapiens
ctctgctgctgatccttggaaaggaggtgagcaaaactctaatgcccatgttatgatttccatcccccagggtaacccttttaggggaaacctagagacayaggaaaagtgtgtcctttttcaacctccgcttgcttattttccctctttgctttccttcccgtctttctactctcattcttttccttctcttctctcttc

SEQ ID NO: 76358 - DNA, 201 bp, Homo sapiens
catctttgttttggatctctgcttctctttagctcatgttctctggagttcctggcaacatgatactagtttcagctttgggtggaggcttctgcttcctyctggtggggtcctgttttggccaaccctatctcctctttcttctgtcttccttctaactccaatatattattctcctttctctctggtttatctgaatgt

SEQ ID NO: 76359 - DNA, 201 bp, Homo sapiens
ttgccaacaaaaggtgatttttggtgtcggggaggggggtcacatgcctgaagtgtcttagtttcacaaggaatacgctgtgtctttccccttcaattgcrctgctgcgttttttgtctcctagtttcagtcctctcactcctaataccgcagccctcaaatgcgggtgccatctttgttttggatctctgcttctcttta

SEQ ID NO: 76360 - DNA, 201 bp, Homo sapiens
ctgtggagagagtcactcctgcattttaagacttgccttcctcacaagaaaggcacttttcttcttggttccaactgaggattcattttgccgtgctgcaygactttcatgttactgtgtggagacgctgagacctagagaggtggggttactggctaaaatgttcgaataggtcagtgtggcatctgggagcagaagcta

SEQ ID NO: 76361 - DNA, 201 bp, Homo sapiens
gggttgacagccacacagtttagatgatgtttgaggtattttttttttttttaatccaggatagtctatacataatttaaaaatctacccagaggccaggmacggtggctcacacctgtaatcccagcactttgttggggagaagtggaaggatctcttgaagtcagaagtttgagaccagcctgggcaacatagcaaaac

SEQ ID NO: 76362 - DNA, 201 bp, Homo sapiens
gcaaaaaatccccaggatgatgcacatctgggttgacagccacacagtttagatgatgtttgaggtattttttttttttttaatccaggatagtctatacrtaatttaaaaatctacccagaggccaggcacggtggctcacacctgtaatcccagcactttgttggggagaagtggaaggatctcttgaagtcagaagtt

SEQ ID NO: 76363 - DNA, 201 bp, Homo sapiens
aacaacaccaatttgctgtggagaaacctattctggttatgattctgccactaaatattgtgtttggtgggtttcacttatctcttctgtaaatcagaagrttcttaatcaggtgaattgattaagatcacctggtaagtgttttcaaactgttcatgccagtgtcccatctctgggaatttgacctacttggttggtatg

SEQ ID NO: 76364 - DNA, 201 bp, Homo sapiens
cgctgactgtgtcagcagtgggcaggggaaacaacaccaatttgctgtggagaaacctattctggttatgattctgccactaaatattgtgtttggtgggkttcacttatctcttctgtaaatcagaaggttcttaatcaggtgaattgattaagatcacctggtaagtgttttcaaactgttcatgccagtgtcccatct

SEQ ID NO: 76365 - DNA, 201 bp, Homo sapiens
ttagttggtcctggctctgggctgtggattgtgtttagtttgccccaggtgtgcacattttgcttagattcaacagcttctgggacacattctgctcacaragactcagcagagcacaggaaagaaggaaaacatgaagtacttcttgcggtacctgctgacatcacatttgctagcattccattggccaaagcaagtcat

SEQ ID NO: 76366 - DNA, 201 bp, Homo sapiens
tcaagtgacatcttccagccttggggacaagttaccactgtctgggcctgctggaggtgatcttagaaagtgatagatggtatttataggtccagggtagkggtggagctggggaatgccatgcagagttcagtctggaaggttgtttatgctcttgcaactccaacaaagagcagccctgtctatccatggctcaaatta

SEQ ID NO: 76367 - DNA, 201 bp, Homo sapiens
ctgtctatccatggctcaaattaaattgcagatgcccctgaactcggggttaggaacataaacaactggtgagttgcagacttcaagcaatgagcaaactyggcaggggagaggcctggtgaagggctggttggcaatggatttttccagttgatgtttttccaggaggcttctctgacttcttggattccagggaccaga

SEQ ID NO: 76368 - DNA, 201 bp, Homo sapiens
tcaaaaccaattgtgcaatgtgtcacaagtaatgcactactgccaatgttttagaaatacaaggtaaaacagagtcagtgccaccctcactttcttagatktctagatgttttttgaggaagggacgtttcagcatacacaaatggaagtgcaggtcatcatttttcattgagtgtcttgacaggaataataagtttcaga

SEQ ID NO: 76369 - DNA, 201 bp, Homo sapiens
ctatccatctctgctgtgtttgatattatcctacacacatgaatatgctgtttcatttgcatatatttaccctctcattgagtcctcatgtccccttgcgwggtggcgggccagatctaactatcttctattatagataccaaagtctaggtccatccagggtcataccgccctaagtggctgagctgggccttgcatggt

SEQ ID NO: 76370 - DNA, 201 bp, Homo sapiens
taggaggtgtggtgtatgggaggtgatgaggccatgagggcagagcacacatacatgggaaagagtcctatgtaagaggcctgagagagatgcctttcccyttgaccatgagaggacagtgagaaggtgctgtctataagccaaaagacaggccctcaccagacaccaaatctaccttgatctcagacttgcaaacctcca

SEQ ID NO: 76371 - DNA, 201 bp, Homo sapiens
aaggggttaattcattaagaagacataaaaatcctaaatatgtgtgtacctaataacagagcttcaaaatagatggagcagtagttgacaaaacgaaaagragaaatagacaaatcagttacatattggtgataccatctttttcagtacttgatagaccaagtagatgatcagtaagaatatagtagacttgaacaatat

SEQ ID NO: 76372 - DNA, 201 bp, Homo sapiens
cattgctggttggttatgccagtctgtctctatttttagaaagagctacaagagggaggaaaagaatctagagaaataagtacagatggattcctccctgrggcagaagctggggtctgtgggatgaagcacagacacaaagccattgtcctgccacccagcagtggagtcggagatggatggcatgaatctagaatacca

SEQ ID NO: 76373 - DNA, 201 bp, Homo sapiens
cattccttttgatgtctaaattgcattcccttctgtctaatagaagccgttctgttccatttccagaggagatggggaacagctggacaccatccctttgmtaaagtctgaggacagaggtggagtcaccctcacatgagtcaccttacccatcccagtgtttgacatttgggggctatttcttttttgtccccttgggca

SEQ ID NO: 76374 - DNA, 201 bp, Homo sapiens
gatgtttttgagcaagactttgaaggctcgctcaaagacaagtagagttgctgagaagaagttgtactctgtggaggactgacatttctagatggacagcygctcactttcagccaagaccacttgtcctcccactgcccccagagaagggcagctccccacagagtgtccgaggtccatgcactgacttcttgtactcat

SEQ ID NO: 76375 - DNA, 201 bp, Homo sapiens
gagttaaacatttaactggtttttaatctaataattatcttttattcccaaaagataagctgaaagagaagatttaggcgactacggcaaggacttctgtrtagattacacttggtaggtggagacaatctttaccaataatgaaaagccagtcggatgtaattgatgtaataactcccttcccttttaacattgggtttt

SEQ ID NO: 76376 - DNA, 201 bp, Homo sapiens
gtggcctctagagtaaaggcccctccagccttctcttaacatgtccccacactttcactgggattaatcgctcccctgtgtgcttctgtggtccttaaatrtacctctattttatgatgagtgacagccaactatggtttgtggcactccttaacagtaggagtctgtttcccctcattgagggagggaattgagtcagct

SEQ ID NO: 76377 - DNA, 201 bp, Homo sapiens
atgggcatagatctctttttttttccaatggaaaaaggcattaacgtcccattttcttggttgatgctattacaaaccaattaaatctcactgtggcttgrgtcccacgactgtgggggagttataaggtgttgtggagattactcgataattgcaaagtactcgtaaaataatacaatgccatataagtgctgttcctaa

SEQ ID NO: 76378 - DNA, 201 bp, Homo sapiens
gagagggagacaaggagagggaccatgtctgagtgatggtgtcattggagtgacacagatgggctcagataacagaaagcttcaaagaggagcaaagatayatttttgtgtcaagatgcaaagaacatgaacaagtagagatggggggctaatggcaaatgtaggtttcatacttctatgaaacatatcactgaaaggact

SEQ ID NO: 76379 - DNA, 201 bp, Homo sapiens
ttctgctaccacactggctctccctgtcagccgggctccaggctgggggagggggcccgcccctccccgggacccgccagacagaaccccgccttccctgmgattccccgacgtgggcggcagacactgttccctactccacagacccagggcttcctcccagccctcccgaggctatgtggtctggggtgggctcctctg

SEQ ID NO: 76380 - DNA, 201 bp, Homo sapiens
gtcccctcggagaatgggtgaggatagaatggcaccgcctgcagttgttttagttatgcttgttagtcacttacatggtctgtcctctcctgcatcatggygtgtcttgggaaagccagagacaggtcaaaagcctggcccgttgacctttggaatctctgacatatggacagggataaggacatgtgtgttccctgaatg

SEQ ID NO: 76381 - DNA, 201 bp, Homo sapiens
ctgctaccacactggctctccctgtcagccgggctccaggctgggggagggggcccgcccctccccgggacccgccagacagaaccccgccttccctgcgrttccccgacgtgggcggcagacactgttccctactccacagacccagggcttcctcccagccctcccgaggctatgtggtctggggtgggctcctctgtt

SEQ ID NO: 76382 - DNA, 201 bp, Homo sapiens
acaaacaagggaaccattataaggctactagtggacttctcagcagaaaccttgcaggtgaggagagagtaggatgatatattcaaagtattgaaatttawaaaacctgccaaccaagagtactatatctaggtcaaagaataaatcaaaaaaggaaattagaaaatatctcaagacaaatgaaaatgaaagcacaacata

SEQ ID NO: 76383 - DNA, 201 bp, Homo sapiens
catttctgtgcactaacaacctatctaaaaagaaaactaagaagaaaagtaccattcacaatagcaccaaaaagaataaaatacctaggaataagtttaaytaagagggtgaaagatttgcacattgaaaactataaaacgttgataaaagaaattaaagaggatataaataaaaggaaggtgtgaaaggaaaataaaaac

SEQ ID NO: 76384 - DNA, 201 bp, Homo sapiens
ctagctatggccttctcattctcctctcctttatagctaggcttttaaaaaagcctcttttggaagtatagcatatatcagaatagtacacaaatttttaktgtacaacttggtgaattatcactgagtggacaaactagaggaactgccatccagatgaagaaatagaacatttccagctttctggaagtcccccttggg

SEQ ID NO: 76385 - DNA, 201 bp, Homo sapiens
agaagaaaagtaccattcacaatagcaccaaaaagaataaaatacctaggaataagtttaactaagagggtgaaagatttgcacattgaaaactataaaaygttgataaaagaaattaaagaggatataaataaaaggaaggtgtgaaaggaaaataaaaacttgggaccccaattcactctgccaaaatgaaaaaattaa

SEQ ID NO: 76386 - DNA, 201 bp, Homo sapiens
gcctgcctgcatttttcctcactctttaccttgagccagagctagaagatgaagctgggcatagtggtgcctctccatcctctcagggctcttggttgtcsgtgattacattgaaatccagggctgtgatgtgggttgagttggatactgcttatgagagaccatcagaacttgggtgacaggggaactgctgaaaaacgg

SEQ ID NO: 76387 - DNA, 201 bp, Homo sapiens
tttccaggttgaatctgctcattgttacttcctgcctgggtttgctaacatctccaggtccctcttgcagccaccgctgcagccttgctcggtatggaaaygtgtatttccaggcttcagaaagcaaagcgtgtcgggaatgggacgaggagaatcagtgaccctgctgagagtggccccacctcatctgaagtcaaggcc

SEQ ID NO: 76388 - DNA, 201 bp, Homo sapiens
acagtctatcaggattgtaaatggacataccccaaaggtggagagagtggaatgtgatgaggtctgaatgcaagtaaaaaggcaaactcaatgaagtgagyttgggagattcaagttctatatgagctgtgacttgtaaaatatgggaaaggcaaacaatgttttctgtgtcactgcaagggaaagaagacagcaggtgac

SEQ ID NO: 76389 - DNA, 201 bp, Homo sapiens
ctgggtgacctttcctgcctgttgctgggagagacactcttaggcctctgcagatattagtgactcatgggtcattaagattatgttgtttttatcttatrctgttagaccttttccttgatcttcggggtcattggatctcccaatgtttgtgcaccttgggcatgttagtaaaactttctgtgcctcagtgttttttaa

SEQ ID NO: 76390 - DNA, 201 bp, Homo sapiens
tgcactccagcctgggtgacagagtgagatcttgtctcaaaaaaataaaaaataaaaagtaaaataaattaggaggcaccaacagaagaaaaagactgggktatgacaagagagccaaccagaggagaatcatttagatgaaagtgggggagaggaagagaagacgccatttaagctgaaatgtgagcactgggtaggagt

SEQ ID NO: 76391 - DNA, 201 bp, Homo sapiens
aggatggtctcggtctcctgaccttgtgatccaactgcctcggcctcccaaagttctgggattacaggcgtgagccacagtgccaggccattttttttttyttttttgagacaaagtttcaaaaaagtcttgcccaggctggagtgcagtggtacagtcacggtttattgcaaccttgacttcctgggctcaggtgtttct

SEQ ID NO: 76392 - DNA, 201 bp, Homo sapiens
gtatggtggcatgcacctgtggtcccagcaactcaggaggccgaggtgggaaaatcacttgagcccaggaggttgaggctgcagcgagctataatcatacyactgcactccagcctgggtgacagagtgagatcttgtctcaaaaaaataaaaaataaaaagtaaaataaattaggaggcaccaacagaagaaaaagactg

SEQ ID NO: 76393 - DNA, 201 bp, Homo sapiens
atagagggacagctgggagggtagggtttatatttaatacctttatgggcttttcagtgcatgctctttgattgctttgattgctgtttaaatagactggraagagtgcagaatgctttttattcattttgttttctgtaatgcttctcactgtcaaaaataagaaaaaataattggtggtacctaagtgctgcagttcct

SEQ ID NO: 76394 - DNA, 201 bp, Homo sapiens
tttcatggttgaacaaattcagaaaacactaatgattacaatttaccaggacagtcaaagttttgagaagccttgtagtaaaaacaaacaaacaaacaaayaaacaaacaaacaaacaaacacacaaaaactggttcaatttttttcaggcctttttctgctgaacacttgaacacctatgaatatcctgaggaaccaatg

SEQ ID NO: 76395 - DNA, 201 bp, Homo sapiens
taaattaattgagttttaaatatagttaatactgcatcccatgtgctagaccatttcgtaagagccttatgtacgtgatttgttttcaccttcacaacaaygacatgaggtagatatgaccgttagcttcattttatagatgagaaaattgaaactcagagaggttaataaacttatccaagggcacacaccttgaaggag

SEQ ID NO: 76396 - DNA, 201 bp, Homo sapiens
agattctaagataacttggagtagtcttgtttatttgttgtcattgggtttgggagttttatggaagagacttggtgcatggatcttcctacgtgaccttkgcatgtctatgatgactttttcatgttccattcctgtttgatgaaatagaagtagaggctcaccttgttatgaatggtggaaggagacccagtgtggctc

SEQ ID NO: 76397 - DNA, 201 bp, Homo sapiens
agatacacccagaatgtttgaccaaatatctgggcacccaatggtccagtcaagttgacacataaaatgaaccatcacaaggcttgtactttccaagtcartaatcctctttgttagggaatgaatagtggcattcaaaaagatatgtccaagtcctagccctggaacctgtaaatataatcttatttggaaaaaagatct

SEQ ID NO: 76398 - DNA, 201 bp, Homo sapiens
gccaccaagatcttggaatttgacccttgccctcccaaccctacctcaaacttagaacatctgcacccacttaatggacatctgttacacacttgagccamcgaccctaaagaaagttaaaacagcattcatcacagtttgaaaataaagacaaagggtaatgtgttaacattcataatcattgtgatctcctcttagcga

SEQ ID NO: 76399 - DNA, 201 bp, Homo sapiens
ttttttttttttttttttttgctctgaagctaccaaacttccaggggccacactttgggaacactatcctactgttttcgatgagaacatttttggaataractgatgaactgggtacaggtgggaagggactggtccctggtgaattttaaagagaacgaaaacgagaaactgaagaacaacgggttgggctccttgtgt

SEQ ID NO: 76400 - DNA, 201 bp, Homo sapiens
taatacataattatctctcctttgtaaaatcttccctttcccagccccacccaactccaaatcttgatataaatgcaagattctgtatcagaaccaataastaattgagaatctcactatgcctggggtcccacaactgccaccagcaagttccgggaactgaaccatgtgggcaggagctgggagcagagtggtgggaat

SEQ ID NO: 76401 - DNA, 201 bp, Homo sapiens
gaattgcttgagcctggaaggcagaggtttcggtgagccgagatcatgccacagcactccagcctgggcgacagagtgagactctgtctcaaaaaaaaaaraaagaaagaaaaaaaagatgagggagctttgaactggggcccagcatggggggaggtgagccacagccacacctagagggattcaagcaaactcctctgt

SEQ ID NO: 76402 - DNA, 201 bp, Homo sapiens
gtgagagtgagggtatgtatttgcatactgaaatctgatgtaacagattgttttaactgtaggtcacagtcaaaaacgtttaaaattactacaaaattgargttttggatgttgttttttcagactcaggatggggcctggcaagtcaggaaggtgtaaatactagaaaaaagtaaacattttaatagatttctttaaaaa

SEQ ID NO: 76403 - DNA, 201 bp, Homo sapiens
ccagctgtttgggaggctgaggcaggagaatggcgtgaacccgggaggcagagcttgcagtgagccgagattgcacgactgcactccagcctgggggacasagcaagactctgtctcgaaaaaaaaaaaagaaaaaagtagccgggcgtggtggcaagcacctgtagtcccagctactggggaggctgaggcaggagaatg

SEQ ID NO: 76404 - DNA, 201 bp, Homo sapiens
tgccctgtggtttgtttcttaaatattagggtaattgtcttggaagcatttgggaccaagtataaggcaggcagtataaggcaggcagtccagatcctgayggattgtgtggaagacatctgtgatggcccaggtacaatgtgagctgtgtccataaccccatgagactgctttttcgaaaaatgtgccaaaaagtcacgc

SEQ ID NO: 76405 - DNA, 201 bp, Homo sapiens
tgaacctgggaggcagagctggcagtgagccgagactgcgccactgcactccagcctgggtggcagagtgagactccgtctcaaaaaaaaaaaaaaaaaarggaagtggtgagaatggacttccttgctttgtttttgaccataggagaaaaaaatttagtttttcaccattaagtcactgtaagtctcatgttagctgta

SEQ ID NO: 76406 - DNA, 201 bp, Homo sapiens
ggtgggaacagagatgctacctcttaaaagaatatgtgtgaaaaatctgtggccatcatcaatttatcacagctttgctatgagaaatacaacttctgtgyctcaatgactccatttgcaggttataaagatccaaagctataatgtgtgcaaagcatgctatgcattataaaaaaaacagtatgcactataaatattaac

SEQ ID NO: 76407 - DNA, 201 bp, Homo sapiens
tcttgctgttagagagcaagtgtaaacatagtctctccatcagaaaagcctcagttataactcaatacccttgaaatctctgtaacaagtccctggcaggrgtgagattataatccatttttctttctgtagccaggtttcctgtttatctgtttaacccaatgagccatggtaacttcctgggaggtacatgatttgagg

SEQ ID NO: 76408 - DNA, 201 bp, Homo sapiens
ccttctcctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagcctcggagctaaggctgggcagattcaggatggta

SEQ ID NO: 76409 - DNA, 201 bp, Homo sapiens
tggaagtatcctggagatgcaagtcctgaaagatgtatcataaaccttttgactctgacagtcctttgctcaagtggagggatcttcttttctagcttctrtgatccactcctctgtgtctcatgggtggggaagcagctggggacatgggagggacatggaggctgcgtggggcaaaagatactgtagattgatagacca

SEQ ID NO: 76410 - DNA, 201 bp, Homo sapiens
gcagaacataaaagtttggaaaatttgcagcctgactatatgatagaaaagaaaaacccatttttctggggagaaattcaagctggctgcagaaatttgcrtaagtagcaaggagcctaatgttaatccccaagaccatggggaaaatgtctccaggccatgtcagggaccttcacagcagcttctcccatcacagaccca

SEQ ID NO: 76411 - DNA, 201 bp, Homo sapiens
actcccacggtccctgggcaaagccaagtcttggtcaggagggagaggaggaaggagcctcaggagaacgggacgctgggcagcatgtgtgtggggagccraggcagatggtgatggtggttgtcatcccagtggcataaggaactctctgacctcaagaaactgctggaaagagaagtgatggaagggctggtggtgggg

SEQ ID NO: 76412 - DNA, 201 bp, Homo sapiens
ttgctgcaggggtggggccctcatggagaacctctgctagggcagtgtgcaggggaaatgtggggttgaagcttccacacagagtccctactggggcactrcctagtggagctatgagaagagggccaccctcctccagaacccagaatagtagatccactgacagcttgcgctgtgtgcctggaaaagctgcagacactc

SEQ ID NO: 76413 - DNA, 201 bp, Homo sapiens
ttctacaaatgtattatatgctgaagagtccctcttccccacccccacacccaatctttttgttcttttgatctaagcgtgaaaaacctcaaaaatagcaytcatccttttcagatcagatcctggacattctgaataagtaatcttctattgtagtgagctccccaattctggaaatgatcaaatagaccactatttgtc

SEQ ID NO: 76414 - DNA, 201 bp, Homo sapiens
atggaggcgatatgtttgaatgatcgctcagacatcccctgctgccccacccccaggagtctcctcactttcccgtatgtcacatgtcacatttcactcayacaggaaggagtggattcagaggaagagtgtgtgacttggtgaagcagctcccaagcacccaagatgcccaggagcctctggaagcagcagttggtcccc

SEQ ID NO: 76415 - DNA, 201 bp, Homo sapiens
ggtgatggtggttgtcatcccagtggcataaggaactctctgacctcaagaaactgctggaaagagaagtgatggaagggctggtggtggggagcactagrgtcagaagtgggcgagtacctggagaacttgtagagagaaatgtgggctggagcatgcagggagcagctacttagactcagtgagcacaccaaactcctc

SEQ ID NO: 76416 - DNA, 201 bp, Homo sapiens
tctaaaacccaggaggaaaacagcccttattttctgggaaaacttggggactggaggccttttcgatttgtacaggtctgacccaatactagtcagggccrtaatctgtctttttactaaagttaatatctgctcccaggctgattttcttagcttggacgttttgatatgaatgagacaaaacaataggtcttaagcatc

SEQ ID NO: 76417 - DNA, 201 bp, Homo sapiens
actttctcaccctgttccttcccttccttgacgttaccactgctcttaacgttgtgtttaccattttcatatttttgtacttatattgtgcatacatacastaaatactgtatgatatttttgcagtttgtaaacttcatctaaattgtattatactatacatattatttagcattttgctctttttcttaatgttgtttc

SEQ ID NO: 76418 - DNA, 201 bp, Homo sapiens
ttaaagtcaggccctgggcatgaagcccacccatgtggaagctctggagttctcttagaaatgtgccagcttagagccttgagatatggaacagcttccaygaggatctgagagtgatctctatggggttaccatttcaagagcccttgggtggcactgtgccccaacgttgctacacatctctaccagccctctctagcc

SEQ ID NO: 76419 - DNA, 201 bp, Homo sapiens
ggaggaactggagagagaaaaacgttgatcaatctgtgattacttatttccttagccctgctgctttctccttgatttttctttgggattgagaaaggcarttcagctcgacacaatacacattcactgatgcttacagtgagcaagtctctttgcttggcagtatggggaggcacaacaacgatgaagggagagcttatg

SEQ ID NO: 76420 - DNA, 201 bp, Homo sapiens
cagtgccagtccatgaaagcagccaggagggaggctgtaccctgcaaagccacaggggtgcagctgcccaagaccatgggaaccaacatcttgcatcagcrtgacccagagtcaaaggagatcattttggagctttaaaattttactgccctgcttgatttcagatgtgcattggccctgtaacccctttgttttggtcaa

SEQ ID NO: 76421 - DNA, 201 bp, Homo sapiens
gagagatagtattgattttaatctttctgtcattttattgaattcatttcagatctagatttttcctggctcatttttctcttcagaataaacttcttgcycctgttggtattgggaagtgctagtcacctaggcaacatgcgtacagagccattggcgtctactgttccttaagcagagctttgaccagtcaccaccccc

SEQ ID NO: 76422 - DNA, 201 bp, Homo sapiens
ggtgcagtcagcaggaactacacggaaaggtcaatatggagacttctacaggttccatgggatgtgttaagagttttggtctttttcctaagagcagtggrtgactgttgaaggctttttaatgaggaggcaagaagattagatttttgcttcagaaacctcacttgggctccagtgtagagactgaattggaggtgggca

SEQ ID NO: 76423 - DNA, 201 bp, Homo sapiens
cctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaa

SEQ ID NO: 76424 - DNA, 201 bp, Homo sapiens
tcccagagccacagagcaagctcatctggaattcaaacccaggcctgtctaactctagaaacttttatttttttcacagtactctgtagctgaaggtgccmcagagttccattcagtggatgtcaggctagctggggttccagccctctagtgttaatcccttcaattacccatctcccagggaaaaccatggtgtggtct

SEQ ID NO: 76425 - DNA, 201 bp, Homo sapiens
ctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaat

SEQ ID NO: 76426 - DNA, 201 bp, Homo sapiens
tctgaccatggagtcacactgacctaggctcaaattccatcttctcagttacattcattcatccatccatctattcattcattcagcttgtattgatggarggtcaggaactgttgtaggtttggggaacacaacaggcaacccccctattctatggagctttcattccagtaaggctgcagagtgaccttgggcaactcg

SEQ ID NO: 76427 - DNA, 201 bp, Homo sapiens
tttgcttgtttgtaaaggattttatgtctccttcccttatgaagcttagtttggctggatatgaaattctgggttgaaaattcttttctttaagaatgttraatattggcccccactctcttctggcttgtagagtttctgctgagagatctgctgttagtctgatgggcttccctttgtgggtaacccaacctttctctc

SEQ ID NO: 76428 - DNA, 201 bp, Homo sapiens
atgttgagagaagagacttgagaaggggctaaggcagatgagtggcttgagaagaaagcaccggggctgagctagacaagggacatgatggtgggggaaaytcaggagaggatctcaggtggtttctctggaatttaggcaggtggaaaaacctaggcagagggctaaaggaagggtttcaggtctcgtattcccagctgg

SEQ ID NO: 76429 - DNA, 201 bp, Homo sapiens
caggtacaccaatcagatgtagatttggtcttttcacatagtcccatatttcttggaggctttgtttctttttactcttttttctctaaacttctcttctyacttcatttcattcatttgatcttcaatcactgataccctgtcttccagttgatcgaatcagctactgaagcttgtgcatgtgtcacatagttctcgtgc

SEQ ID NO: 76430 - DNA, 201 bp, Homo sapiens
ttgggattatctcaaggtattcaaagatgttgacagttgggtggctgccaggaattactgcctgcctctggcaaattggttggctcagccgtgaagagacyggggagctcagccttagtcactcagcctgcggcagggactcgggaaaccctcagagatgtaggctcatccttactggtttctttcatagagtccacattc

SEQ ID NO: 76431 - DNA, 201 bp, Homo sapiens
gctgcagtgatctgtcttcctgccttcatctgtggaatttgctttattccacctaccaggacctgcaatggtctttttcatttgcttatttctttttttctttttcttcttcttcttcttttttttttttttttttttgagatggagtcttgctctgttgcccaggctggagtgcaatggtgcgatctcggctcactgcaa

SEQ ID NO: 76432 - DNA, 201 bp, Homo sapiens
actgaacctagtcaagagagacagagaggggattggagaactgggatttttaacttttcatttgagcattttagtctggatgagggcaatggtatgatttycagctgtcatcaactctaacaaaatggcagcaattccttaggctgacattctgcccagtcctcagccctggggcaggaaggcaagctgcatggcagagag

SEQ ID NO: 76433 - DNA, 201 bp, Homo sapiens
gaaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagata

SEQ ID NO: 76434 - DNA, 201 bp, Homo sapiens
caagctgcatggcagagagaagcgaatcagccatgtactaagggtgtccctgccctactcagaggcactgcatctcctgaaagcccaagctggtgcctcgmgtagatctctcttactgtgcttctatccctctccttttgttcatcctgcggtgatctcttctttgtccagtcccgtgagatcacatcccttttagaaaaa

SEQ ID NO: 76435 - DNA, 201 bp, Homo sapiens
aaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagatat

SEQ ID NO: 76436 - DNA, 201 bp, Homo sapiens
actggggaagagacggcagggtggcaggaatgaagaccatgagcatttgagccactttctcatgtaacttacttgtgctttcaggacctgcttgagcccartcacatatataccacttacgtttgatgatggaatgctgctgttcatgacccactttatggttagatgggtcagaaggcacccagttcattataggcagtt

SEQ ID NO: 76437 - DNA, 201 bp, Homo sapiens
cacacacacacgcctattctcacaaactggaataacgcgggataaccaccccatggtaactgagcatttctaagaagacacacccatgagtattagaaaasggaccaagtcaacctgtgtcagcccatctgagtagccacctgctcctttactcatcaccgaatgtgcaggcccttggtttgcacattggatcacagacca

SEQ ID NO: 76438 - DNA, 201 bp, Homo sapiens
tatattccttgcattatacatcccataatgggattgctgggtcaaatggtatttctggttctaggtctttgaggaatcgccacgctgtcttccacaacggytgaagtaatttacattcccatcaaaagtgtaaagcattcctatttcttcctaacctcaccaacatctgttgttttttgactttttaatgatagccattct

SEQ ID NO: 76439 - DNA, 201 bp, Homo sapiens
gtttcaggcatgccaatctaccgagtcagttgggaatgcttttcatggggtgatgagagcaaagaaatgccccagtgctatttcatctgcctccttgtgtwagaaaccagcatggacaaagacgaatttcctctccgccaatcctgtgtgttcagctaaagtttcctttttgaatggtccctcctgttttcttcttgtaag

SEQ ID NO: 76440 - DNA, 201 bp, Homo sapiens
agcattttgcaaggataatttcctctactcttcacaacttccccaggggacagggttttacagatgtggaaactgaggcttagagaattgaaataatgatycagaatcaagtgacagagacaggattcaaacccagcaatcataaccactgcagtcaaggtggcccacctgaagtgtgttgggagtggctggaactgacac

SEQ ID NO: 76441 - DNA, 201 bp, Homo sapiens
tatacactgaggttcatctaaggggagctctggaaattcctgtccatggtatctagttagcaccacagaaaataggggtttaagaaagatgctgatgatgygggtagtggtcctgcagggttgacaggtttggctgacagcctgtaagagcacaagtatgcttttcatgttgtgggggtgcagagggaagtggagagagtg

SEQ ID NO: 76442 - DNA, 201 bp, Homo sapiens; identical to SEQ ID NO: 30114

SEQ ID NO: 76443 - DNA, 201 bp, Homo sapiens
ctcccatattccccaccctttgcctagccctccagcctgagagagctggggtggaggagtaggagagagagacagacagagagagagagagagagagagaragagaaagagagagatagatagatcagagaatatagtttataactcatcaagagtctataattcaatctagtagaaatgctcatttatctcttaaaatct

SEQ ID NO: 76444 - DNA, 201 bp, Homo sapiens
catacacacatgtgcacacacacatgcatgtgcacacacacacacacacacgagctgactcccttaaaccaggtagctgacctccatgggtccacactctrggtccaaactcaactgaaggaaagtgaactgaaggagacatttgtgaatttgattctccaacctaaggactttgcttttcaaaccaagagtgttcagaag

SEQ ID NO: 76445 - DNA, 201 bp, Homo sapiens
tgaggcaggagaatgacatgaacctgggaggcagagctggcagtgagccgagactgcgccactgcactccagcctgggtggcagagtgagactccgtctcaaaaaaaaaaaaaaaaaaaggaagtggtgagaatggacttccttgctttgtttttgaccataggagaaaaaaatttagtttttcaccattaagtcactgta

SEQ ID NO: 76446 - DNA, 201 bp, Homo sapiens
aagacttctgttaccattaacatagttccccggctccatgagacatgaacagcctctctgagaatgcaccgacaactcagcatgccttgtaaacagaccayaattatagagcttggttttgactttttttccagggccttaaagttgatatatttttacatttcctggattggagggtagggagcatggctttgggtttag

SEQ ID NO: 76447 - DNA, 201 bp, Homo sapiens; identical to SEQ ID NO: 30118

SEQ ID NO: 76448 - DNA, 201 bp, Homo sapiens
gagtccttttgtctgggaccagctcctatctgtcatgcaatttaagctgccctggtttactgaagtcattcgtggaaacaggctcccccaagtgacttccytcagaaaccctgtcctggccctgccaaccctctccatccacagttccctgtggtgtctctgaccacaggcatttggcttcagtcacctcccaatccgtag

SEQ ID NO: 76449 - DNA, 201 bp, Homo sapiens
caggcatttggcttcagtcacctcccaatccgtagatgacctcggcctgctgcaatgtctgggtcccctgtcctgggaaatcaaggcagacaaagtgtccrtgaagacagggatgagaaactgtccattttatttctacctgccactggcctcagtgaattctaatagtgtctaggccatgccctgcatgcctccttacat

SEQ ID NO: 76450 - DNA, 201 bp, Homo sapiens; identical to SEQ ID NO: 30119

SEQ ID NO: 76451 - DNA, 201 bp, Homo sapiens
tacaaattaatgacaaaccccgatggtgaagaggttacatcttgcaatactaacataatcaattggtagcagcttcccagagtgctgtgctgagatcatgwtgtaaagttggaagcacgggccaaacatcactcatcattgccgttcatacacctcaggcccacctgctgcccagaaatctgttgcacaatcacttcatcc

SEQ ID NO: 76452 - DNA, 201 bp, Homo sapiens
agcagaatctatctgaaagcaaccggcaaagcgctggcacgaaagtccaggcaataagtctatgtaactttagaacccactagccacaaatcatttacaartggggtccttggttggaggttggagaggctatcggggaagagaaataaaaatttgacaagaagcacaggaatgctcacccctgacataatgaataaatac

SEQ ID NO: 76453 - DNA, 201 bp, Homo sapiens
tgggtagacagaggattcaagattaactgagtttcccttgttttggattcagcagaaaggtctggcaacttgaaatctggaaggtggttggactgccagtktgagtcttggtaacaacagttctataaacaagccaggagttcccagttccccagagcccaccgtgtgtcatcgtccagctttcttccaggaaggtctata

SEQ ID NO: 76454 - DNA, 201 bp, Homo sapiens
gactggaaaagaagcagcctgggggaaagataatgagttcaattttggatgtgttgaatccaggtgtttataaaatatccatgtggagaagtcatttaggmagttgggtccagagctcagaagagaagtctgggccagaaatagaaatttggcattcagatggcactggacacatgggagtggacaatattgggatgtctt

SEQ ID NO: 76455 - DNA, 201 bp, Homo sapiens
atcctctccagcatctgttgtttcctgacttttaatgatcgccattctaactggtgtgggatggtatctcattgtggttttgatttgcatttctctgatgrccagtgatgatgagcattttttcatgtgtctgttggctgcataaatgtcttcttttgagaagtgtctgttcatatcctttgcaccctttttgatggggtt

SEQ ID NO: 76456 - DNA, 201 bp, Homo sapiens
tggagtcggagatggatggcatgaatctagaataccatgggaatgggtccttgccctgggccagtaaacatttgagactcagagccaggagataggatgaraagattgcagtgatgagacccacagagggcagcagccatctcttaaggggtcaacttggagaccaaatccatcacttcttggaggtccagtagcccctgc

SEQ ID NO: 76457 - DNA, 201 bp, Homo sapiens; identical to SEQ ID NO: 30131

SEQ ID NO: 76458 - DNA, 201 bp, Homo sapiens; identical to SEQ ID NO: 30133

SEQ ID NO: 76459 - DNA, 201 bp, Homo sapiens; identical to SEQ ID NO: 30135

SEQ ID NO: 76460 - DNA, 201 bp, Homo sapiens; identical to SEQ ID NO: 30137

SEQ ID NO: 76461 - DNA, 201 bp, Homo sapiens; identical to SEQ ID NO: 30139

SEQ ID NO: 76462 - DNA, 201 bp, Homo sapiens; identical to SEQ ID NO: 30141

SEQ ID NO: 76463 - DNA, 201 bp, Homo sapiens; identical to SEQ ID NO: 30143

SEQ ID NO: 76464 - DNA, 201 bp, Homo sapiens
ggcaaggtgctggagctggcaggttgaggagcagtgctgttctttgcctctcatccctgtaaccattcactcagcactttctcagctcatgcctcctttgmttccaataaactttctattagagtacagtaagaagacaaaactcattctacgtgggtcagcagagacaatacgaagagctaattctaaaggtgttagaag

SEQ ID NO: 76465 - DNA, 201 bp, Homo sapiens; identical to SEQ ID NO: 30144

SEQ ID NO: 76466 - DNA, 201 bp, Homo sapiens; identical to SEQ ID NO: 30145

SEQ ID NO: 76467 - DNA, 201 bp, Homo sapiens; identical to SEQ ID NO: 30146

SEQ ID NO: 76468 - DNA, 201 bp, Homo sapiens
tttatcacgtgggcatttatcatattatttttaattttaaaagaggaacgtttttgccttattcttttctggtccattctaccccattacactttaaaaartgctatttgaaaaccatgaaatttatatcataactaattaataggttaaacctgttatcctaaaagtagtgacttagtcatagggaacagtcaatggcta

SEQ ID NO: 76469 - DNA, 201 bp, Homo sapiens
ctagcagtttggtttgtgcccttccaggtcttttctcatgcatttttattcacgtataaattcatatttgttctgggctctggttgtgggtttatttacgygtgcacacacacacacatacgaaagtcatggacaaatgatttcatcagatcgtggttcccaataacccgagacaccccagggtgccataggaaactcaca

SEQ ID NO: 76470 - DNA, 201 bp, Homo sapiens
actcctcgggtggcccaggccatcagatggggggccctggtccacttcaactgagagttgattcttagcatcaggagttctggctaaaataagaccttctsctctgctcactgtatacatttctactggccagggtctaaattaggaagttacaaataaggagagccctgaggcctgggttatggaagcaaagctatagag

SEQ ID NO: 76471 - DNA, 201 bp, Homo sapiens
caaatccatcacttcttggaggtccagtagcccctgcaccctctgcgctttgcagagacatcctgcagttcagggaagaaacggagctgaagggcatgtgraagaagaatgtcacggagatgcaaggggttgggttattggttggcttaaggtcaaatcactatttgctgcctgaagaaaaaaaaaagaccttgcttaggg

SEQ ID NO: 76472 - DNA, 201 bp, Homo sapiens
ttatcacgtgggcatttatcatattatttttaattttaaaagaggaacgtttttgccttattcttttctggtccattctaccccattacactttaaaaaaygctatttgaaaaccatgaaatttatatcataactaattaataggttaaacctgttatcctaaaagtagtgacttagtcatagggaacagtcaatggctag

SEQ ID NO: 76473 - DNA, 201 bp, Homo sapiens
tttaattttaaaagaggaacgtttttgccttattcttttctggtccattctaccccattacactttaaaaaatgctatttgaaaaccatgaaatttatatmataactaattaataggttaaacctgttatcctaaaagtagtgacttagtcatagggaacagtcaatggctagtagtctatttggagcagtgacactgagt

SEQ ID NO: 76474 - DNA, 201 bp, Homo sapiens
ccactgagtgactgttcatgtcaaatctccatatttctaagccttgctcaacagagcctttcccaaatttccaccaacctaacagatttaacccacctcasacttatgcataccacaggtggggagagatactcaaaggcagggatggaggatggatctaactcatctttgatccttactgcagcctgacacacggtaggt

SEQ ID NO: 76475 - DNA, 201 bp, Homo sapiens
gctcaacagagcctttcccaaatttccaccaacctaacagatttaacccacctcacacttatgcataccacaggtggggagagatactcaaaggcagggayggaggatggatctaactcatctttgatccttactgcagcctgacacacggtaggtgctcaatgagtgggtgtttcattgagcaggtgctcaaattgaaat

SEQ ID NO: 76476 - DNA, 201 bp, Homo sapiens
gagacggagtttcaccatgttggccaggctggtcttgaactcctgacctcaggtaatccatttgcttcgatctcccaaagtgctgggattataggcgtgarccaccatgcctggcccttagcttatcttaataagtaaataaaatagactgggtgcagtggctcatgcctataatcacagcactttgggaggctgaggcca

SEQ ID NO: 76477 - DNA, 201 bp, Homo sapiens
ccttagcaaaataaacttctaaattgattgagacctgtctcagaataagttttggtttacaaagtataccttgtgttcatggagctgaagaatcaatattsttaaactgttcatactacttactcttcaataaatgatattgggaaaactggatatccacatgcatgagaatgaagttggacccttattttataccataca

SEQ ID NO: 76478 - DNA, 201 bp, Homo sapiens
caggggtcagggatctggagtccacatggaggaaaggatcccactgaactgagaagacagagataaaaatttggagcagcaaaatgcctggaaatgcttaytaaatgcctggaaattatggggaagaacacagagaggaggaatgtgtgtgaaaggaggtgcccagagggctctttggggacccttcgtgagtccttggct

SEQ ID NO: 76479 - DNA, 201 bp, Homo sapiens
caaaattttcccccactagttattatgctatctccagtcacccttaaagtctgacccagtaatgatgggagtccctaggtgtgtctccagtgccttcatgmacaatcctctcgactttcacatggtgttaccattgtggtggatgtttgctattgaacctccttttctcacactctgccctcaaagattattatgtaccag

SEQ ID NO: 76480 - DNA, 201 bp, Homo sapiens
gtggtggatgtttgctattgaacctccttttctcacactctgccctcaaagattattatgtaccaggtcatatgctcagggcttaggatacagaggtgaayaagataggtactatgcctatcctcaagcagtgtgcaactagcccattaagctcactgtctatacaatatgaattcactcataccagttaaaaaagctgta

SEQ ID NO: 76481 - DNA, 201 bp, Homo sapiens
agtcactagcaggagatgacagtgggaaggttgacaagaaagatggtaaagggccttgtaggccatgttaagaagtgtgcactatacaccagatagggccstttctgtgcccctcaaatctcaccacgtagctggccccttgtggggactccgcaggcagaaaatgagggtgaggaggctagcagtcattgctctcaggag

SEQ ID NO: 76482 - DNA, 201 bp, Homo sapiens
caggagggccataatctcaaccagccaggcccgaggcccattgcaatggatcatacaaatcactgcctttcttcctggagtctcctttcctcctttgcccrttggtagatgcctagttaattcttctagttgcatgcaaaagccgtgtcctctgggagcctccctgacagctctagggagagctgagggcttctgcttcca

SEQ ID NO: 76483 - DNA, 201 bp, Homo sapiens
cagatttctttgtcaccaattttccaatcatgcttcttccaagtccctgaccatccaaccaaaccattggctacagcccgtgaatcagtatataattgcayatctggccatttctccttgcttgcaaagtgcacaaccaggtgcactactcgaagtgcccactgggaagatttcccttcactgctgtccttagggatgtcc

SEQ ID NO: 76484 - DNA, 201 bp, Homo sapiens
gctgaggtcacccgctggtgaacactcacatgggatacaaatatcttcacagtttttgaccactcagagaggtccatctacatacctcttccccagatttstttgtcaccaattttccaatcatgcttcttccaagtccctgaccatccaaccaaaccattggctacagcccgtgaatcagtatataattgcacatctggc

SEQ ID NO: 76485 - DNA, 201 bp, Homo sapiens
gtataaaacactgggaattaaagctaaacagaatgtggctccttccatcaaaccctgggtaatcacaaggaaggaaggcctataaggaaagaaggcagacragtgaggaaagaaggtagactagtaaggaaggaagactggtaagaaagtgactaataaggaaagaaggcagacgagtgaggaaagaaggtagactagtaa

SEQ ID NO: 76486 - DNA, 201 bp, Homo sapiens
gaggttaaatgaggaaatggtcgttggaagccctgatggtagatggacagtggagggtggaatacagggcacagaagctggggaggggctttgggcaggcycagaaaggagatttcggaaggactggtttggggagactctgaaaacaggcttcacctgttttttcattgagatttgggcctctccatccttcagtctctg

SEQ ID NO: 76487 - DNA, 201 bp, Homo sapiens
tgctgggctggggagctggtgtgctagagcagaggtgtatggcgggaccccagggagccagcaggagagagggggtggagactggcggggcagaatgcagrgtcccagcccgagagccatgggagccccataagtttgtgctcttgagggtgtcctggccagatggatgtttgtaaggacccctggctgccttgtggggaa

SEQ ID NO: 76488 - DNA, 201 bp, Homo sapiens
tcgcgttccccttggccttcctctcacgtctgaaggtggctcccttgtgtctttattgcctggagtgcctctccagagctgggacggctgggatggctgawccgtgtgctgtgctctaatcacttgtggggagagggagagaagggaagcagagttcccaggcagccggatccgtgtgtcagagagcgagccgggggagca

SEQ ID NO: 76489 - DNA, 201 bp, Homo sapiens
tcttttcctgaagagaaaacatatgtaattgctattaagcattatttatcagtgtgaaaaaaattggtgtttccacactgagctgatagaattccagttaraaagcaaagaaacttggcattttagttagcttcagtggccctttaggagggaaaggtaattccatttagctttggaaatgattggaaattgttctcaggt

SEQ ID NO: 76490 - DNA, 201 bp, Homo sapiens
ggcaactcgcggttccagtggggtctgtacaaagtgcagctggactatctactctctcagttccctccaattctagcatgcagtcattccatcacctactrgggacttttcccttcaggggagacactggaatttttctgaagtggtcctgcattcctgccgagaaggggctgcagacctctggggcctgggtagaggcag

SEQ ID NO: 76491 - DNA, 201 bp, Homo sapiens
actgatagcagaagttggctttaaaattcagcgtggcctggcatcgccagcaggtctacgggctgttcttggaagggacagcgtaccatcagggaagtctsggggcccacagctgctttcgggaggtggagccctactctgtctcggtatcaggtgtgaatccaggaatttcccaaatcctttctctgcagagaggagact

SEQ ID NO: 76492 - DNA, 201 bp, Homo sapiens
tctgctcaaaaggcggatgacccttgttctgagtggactcatgattctgtgtggagtgaaggccattctccagaggagataatgctcctgtttacattcargcaccaatacaagcaatggtgcaccccacttattccctgccttccctattctgtgcacacaattgtaagggaaaacaaagcgacagttacaatggaagca

SEQ ID NO: 76493 - DNA, 201 bp, Homo sapiens
gtggattaggcatccccaaagggagaaggtgcagggagtttactgtcttgttaggaaattagaaaattcatgaacagagagttaacagttcaaggcatatrtgccaattgcctcttttctgggctcccagagtaaaaggtttcacaaatactggttatttgaataccatgattatgagtttgaataccactacttactaga

SEQ ID NO: 76494 - DNA, 201 bp, Homo sapiens
cctccctgtgcatgcgtgtgtgtgtgtgtgtgtgtgtgtgtgtgtgtgtgtgtgtgtgtagtccagcacagcttattttttcagggagccttccacctgcygttttctctccctacgttttctatttagtccttcatagccagtgcccattctctgtcctgcggaggaaataggacctgaacagcttcctttacagaaaga

SEQ ID NO: 76495 - DNA, 201 bp, Homo sapiens
tgtttatgtggaatcagcttcacgtggctccttagctctgaccctgcttctgcttcctttcccttttccccatccttatacctggggagcaggaaatgcaracagcttcagtgtcaagccatgttttaagtggagaaggatgaagaacactgtcatgttctcgcaggccttccacacttgtagacgcaccaactgtcccac

SEQ ID NO: 76496 - DNA, 201 bp, Homo sapiens
agagtagcattgtagtccacaccttgtggacttcagcaaattgcatcacttttccatgcccgtttcttcatctccaaaatggtcacgtgactgggttggtrctctgcaagttcctgcagctcgaaagctctgtgaatcttgagatgctctgggaaacaccaaacgagaggttcagagcttgatttctatagtgggatagga

SEQ ID NO: 76497 - DNA, 201 bp, Homo sapiens
gagaaggatgaagaacactgtcatgttctcgcaggccttccacacttgtagacgcaccaactgtcccacttttagtgttcctgatggtcaatttctctttytttcttcaaaccaaatgttaagcctgagcaggacatgattagcaatctgcttgaggataaaatgttataaggtatgcgtttgttccctgctccatctcct

SEQ ID NO: 76498 - DNA, 201 bp, Homo sapiens
gttatgacccaggcattgtgccagggctggtaacacagtgggggacagaactggtgcccgcccaagggggcagcgtggtattatggaaaagcacttaagtsctatagacctgagcatgaatctcgattccaccactccttaatgtgtgatcctcaccagatgagtcaacctctctgagcctcagtttcttcatctataaaa

SEQ ID NO: 76499 - DNA, 201 bp, Homo sapiens; identical to SEQ ID NO: 30256

SEQ ID NO: 76500 - DNA, 201 bp, Homo sapiens
ggctgtgccaggatggcagggaccacacgttaaatgcggaggtagagcaaatgctcccccatgtttttttttttaaagggagagttcactttagttttttkttgttgttgttgttgttttccattttattttatggtaagccctcgatgactcagaaagagttggaagggacctttgagagtctttaattagcgtctcatt

SEQ ID NO: 76501 - DNA, 201 bp, Homo sapiens
tacatggataagttctttagtggttatttctgagattttagtggacctgtcactgagcagtgtacactgtacccaatatgtagtcttttatacctcacccsccttccagtccccaaagtccattatatgattcctatgtctttgtgtcctcatagcttagctcccacttataagtgagaggatagaatatttggttttcca

SEQ ID NO: 76502 - DNA, 201 bp, Homo sapiens
ttgcatcaatttatattccccattagtagtgtaggagagttccagtttccctacatcctaccaacacttaatattgtcagtcatcttaattttagccattytgatacatgtgtagtggtatgtcagggtggttttaatttgcaatatctggtgactgctaatgagataaaaaccttttcatatattttttttccagccatt

SEQ ID NO: 76503 - DNA, 201 bp, Homo sapiens
actaagctcagagaaagggtttgtcttggggcagggtgctggtggtgaggccttcctccggcaacatcacatgggtcctcgtggcctgcacctcctcccartcctgcacaacccaacttgtggaaccttactcatgtctaggttggaaggaaattagctttcttagtagtatctgaatattccagtcttacaccttgatta

SEQ ID NO: 76504 - DNA, 201 bp, Homo sapiens
ggccacagcacagggtttagatgtattcaaagttcatagtcatttggcttaagatgttcgtatgatggtatagaaaaggctgtatatcaaggattcatatstcaggatgctccttgacttacagtggggttatggtggataaacctgtcataagtcagaaatattaaaagtagaaaatgcatttaatggcctgataaacct

SEQ ID NO: 76505 - DNA, 201 bp, Homo sapiens
ggccaggtgcagatatgtctatcagtaaagcctgtcctagagcaggagttagcaaactgtggcctgcaagccaaatccagcttcccacctacttttgtaartaaaattttaccagaattcacctacacttattcacttatatattgtttatgacttcttttgtgactcaacatcagagttgagtagctgtgacagaaacca

SEQ ID NO: 76506 - DNA, 201 bp, Homo sapiens
agtgagggaccctgggttagactatgagctccttggggccatcccaaggacttctttacctggaaaggatgtgggttgaatgacaggtaagccaggatgargatgagtttttggtacttgctctctggatgcccaggacatagactggtcaaagtgagaccagagcaggtgcgcgatcctatggagagctctggggaaaag

SEQ ID NO: 76507 - DNA, 201 bp, Homo sapiens
tttcattcttccaaacacatttttcctgtcattcattcactcattcatttattcaatgcatgttcatagtagagcacatctggcaatagctggggtctgcytggaagatgtctctctgggactttgcttatggagagaagccctccaaactgtatgcgggggtggggcaagagtgggagtgtggcgagcgcgagggttcag

SEQ ID NO: 76508 - DNA, 201 bp, Homo sapiens
ttcctgcaataacccttgctatagatgaatttttaatattaaaatctgtacgtgtctacctatatttctattaaatcttttacaacatttttaccaaatayggtatttcctaaacaatgcattatgcggttgaagatgctcggcaaagtaatcctattcactacagttctcaatcccattgagttttctctggcagcttag

SEQ ID NO: 76509 - DNA, 201 bp, Homo sapiens
ggaagggaaagaaatccattaggtgactgcattaatggatggggagagacttccaggacacagactttggcaaaatatggtcatcataaagaaaatggctragtatatctctaggctttcgagtattgtcatttgcactgtgttatttttccctccaaggggttatttggggaaaattgtatacatcccaggattgaactt

SEQ ID NO: 76510 - DNA, 201 bp, Homo sapiens
ggagtgcggttgtgaggggtttgctgctgcaggtacagtctgtgtgtgagtgtgtgtgtgcatggatgctggagcatgtgtgaaggcaccgatgcccagaytgtcaacaggtgggtggagggcctcgcaagctggcatgacagattaacttaggccattcggtccttttactgggggcactgggggcctttgggcctgaga

SEQ ID NO: 76511 - DNA, 201 bp, Homo sapiens
gcaatcttggctcactgcaacctccgcctcccgggttcaagtgattctcctgcctcagcctcctgagtagctgggattacaggtgcacaacaccatgcccrgctaatttttgtatttttagtagagacagggtttcaccatgttgctgaggctggtctccaactcctgactgtgtgatccgcctgtctcggcgtcccaaag

SEQ ID NO: 76512 - DNA, 201 bp, Homo sapiens
aaagagaacctgtttatggggttgtaataaccatgtattcatggacacaactgcttatgtctgtgaaggatcagcaattcatcagacacttagtgagttaytttcttctctgattgtcagagtgaaaggtgagtaagatcacttctctcagggagctcacagtcatatgcactgagtcacatgacatagagtggagagtga

SEQ ID NO: 76513 - DNA, 201 bp, Homo sapiens
aggatcggatggttttaaacattttgggccccaggatgatgttcatacgcatctccttctgagattacttcatacatggcgagcagcgtggctgaatctgrtcttgtggtatttattatctgaatccatggatgggaatttccctcctcccctccctgcaccttgcctttcccatatatgttcatgcaaaatagactttgg

SEQ ID NO: 76514 - DNA, 201 bp, Homo sapiens
ggatcggatggttttaaacattttgggccccaggatgatgttcatacgcatctccttctgagattacttcatacatggcgagcagcgtggctgaatctgakcttgtggtatttattatctgaatccatggatgggaatttccctcctcccctccctgcaccttgcctttcccatatatgttcatgcaaaatagactttgga

SEQ ID NO: 76515 - DNA, 201 bp, Homo sapiens
aagcgcagtattagggtgagagtgacccgattttccaggtgctgtctgtctcagcttcccttggctaggaaagggaattccctgaccccttgcgtttcccrggtgaggggatgcctcgccctgctttggctcatgcttggtgcgctgcacccactgtcctgcacccactgtctgacaagccccagtgagatgaacccggta

SEQ ID NO: 76516 - DNA, 201 bp, Homo sapiens
ctctctttattagtgatgttgagctagagtttttctttcttacattttgtgtctggtttaagggccaagattgtacaagccacacagtatgagtttggagygctccttctttttctgttctctggaatacattatagaaaggcagggttatgtgttgcttgagagtttgataaaactcatttaaaaaaaatgtgtgccaac

SEQ ID NO: 76517 - DNA, 201 bp, Homo sapiens
gtgccaacttctgggttttgtgagcagatttttaatttcaggcttttttttagtggttttgttatattcatgttttcattttcttcttgattccatattgktatattttcctatttatgtattttcaagttattggtatgaaatttttcatagaattgtcttttgaagaattgctacatctttgctgcatctgcaattatg

SEQ ID NO: 76518 - DNA, 201 bp, Homo sapiens
cagaaaaatctgttgaaagttgtccacagccagcagcaaactagcggcttgaggaactattcagcagacacttatgtagcacttaagtatgcaccagacayggttctgagtggttttacaagtgccaactcacttcatcttcataccaggtcttgacagagttagttactatccctgtttctctaatgaggaaactggacc

SEQ ID NO: 76519 - DNA, 201 bp, Homo sapiens
attccctggccgtcactccccaaccatgcagtgagtcagggcctggagtgcaaagagatgatgtgttgactccctgggtgggggtgggggtggggggtggygggaccagagtgggaccagggactggaatgtggggcaggctgcagagtggagaggctcgctcagatgaaggcactactgtgtcaccattggctcctgggt

SEQ ID NO: 76520 - DNA, 201 bp, Homo sapiens
gccaggactctattcggattccttttggcctactccggacacctcctgggcatcattggcagtagggtgtgcagttagcactggtttcctatgcccatggrgaagagcagtggtgcagatctccaggaagacagatgagataaagtttgtgttggctttgagtggagtcagccttaatggactaaggacccctttcttgag

SEQ ID NO: 76521 - DNA, 201 bp, Homo sapiens
ccgtcactccccaaccatgcagtgagtcagggcctggagtgcaaagagatgatgtgttgactccctgggtgggggtgggggtggggggtggtgggaccagrgtgggaccagggactggaatgtggggcaggctgcagagtggagaggctcgctcagatgaaggcactactgtgtcaccattggctcctgggtcctggctcc

SEQ ID NO: 76522 - DNA, 201 bp, Homo sapiens
catgcagtgagtcagggcctggagtgcaaagagatgatgtgttgactccctgggtgggggtgggggtggggggtggtgggaccagagtgggaccagggacyggaatgtggggcaggctgcagagtggagaggctcgctcagatgaaggcactactgtgtcaccattggctcctgggtcctggctccaggtggggagaagca

SEQ ID NO: 76523 - DNA, 201 bp, Homo sapiens
atactagctcaggaatcttaattagccatggacagtcctcaatatccccatcatggctcattaaggattgcaaggtgttgaggggcatttcaaagaactcrgggctagctagtaacgttgcacagtggttaagggcttgaactctggatttggactgcctggattcaaatcttgactctgccactctgggaaaacctttct

SEQ ID NO: 76524 - DNA, 201 bp, Homo sapiens
ctctctctctctgtctctggtaaacccttctgctaaggaactgaagcagagatcctcgaagctttggggactggcgcaggttggtggtgcacatttttttrtagtggagagttttggaatcaaacagagctggtaaattggccaccttctagttttgctatgttgatggaggcctcactctgttgcaggcacaaactctgg

SEQ ID NO: 76525 - DNA, 201 bp, Homo sapiens
tgagcaaacccagatgcaagtggaggagctggtcatgtggcagtgaggggaaaggaatccgggcagaggaagcagcaaatgcaaaggtcctgatgtagagyaaactcgtgcaaggaacagcaaagaggtcagtgtggccggaccagccttgagagaggcagtggctggagaagaaggaaggagagggtctgggccagggta

SEQ ID NO: 76526 - DNA, 201 bp, Homo sapiens
cttctcctcagcgtgtcctcagtatctagcacagagcctggcccattggcactgttcagactgtgtctgttgagtgggactgaaccaagactccagggggrctcaggaaaagtccctccctggcccctcaaatttctcttcagaatccctattgagtgttatcattcgtcagcccatcctcagttttccttgtcaacagct

SEQ ID NO: 76527 - DNA, 201 bp, Homo sapiens
gcatgaaagaaagaggtcaaggatgacgccaagattttgatatgaacttgaagaatatcggtgagggaagacatcaggtatttacttatgaacatgtgacrtttgtgacagctgctgcatatccatgtagaaacgtgcaacattcaagggaatctcttagctggagagtcactgacatttagatgatttttcagccatgag

SEQ ID NO: 76528 - DNA, 201 bp, Homo sapiens
caatacttttcaatcttctttgttctcagtctctcttttcctttgcctggcggaagcgttccctcacactgtctgcctcatgaacttcaggccctactacrgggcgcaggggacagcttcgtgccatcacacctccagaccacctaggctactgacatctcactacaaaatcaggctgtttcttgatgcaggggtttcaca

SEQ ID NO: 76529 - DNA, 201 bp, Homo sapiens
tcaggccctactacggggcgcaggggacagcttcgtgccatcacacctccagaccacctaggctactgacatctcactacaaaatcaggctgtttcttgaygcaggggtttcacaggaaaactgcatggcaggtacatggcagcccacacttgggcactgtgaattgccgccaggacctgaacttagattcttgccatttt

SEQ ID NO: 76530 - DNA, 201 bp, Homo sapiens
atcttacataaagaaaatgaggaggacgaaaacgtaggagtcatcctagattctctgtgttccctcaaaccccatagttaatccactggtaagtgcctttractctactactaaaatctatccttgctctgaacatctttcactctgttcatactgcaaacctagtccagatccccagcagttcttgccaggggtattgca

SEQ ID NO: 76531 - DNA, 201 bp, Homo sapiens
ctggaaggctcttactcaatgatggctttggctacctgctcctcactctgccctctcctcatcaccatctcagccctggctgcagtgatctgtcttcctgycttcatctgtggaatttgctttattccacctaccaggacctgcaatggtctttttcatttgcttatttctttttttctttttcttcttcttcttcttttt

SEQ ID NO: 76532 - DNA, 201 bp, Homo sapiens
gttaccttgttctcattgtgtgatggaaagcctgttgggctaagagtctagcaaccggattctatcactaagtctgtgcaaacctgaatctattgcttgtktacataatctgtaaatgcaagtgctaattaccaagtgaattcagctataacactcatttctaccacaatttagtaagccaactcgacccatcgctcagtt

SEQ ID NO: 76533 - DNA, 201 bp, Homo sapiens
tgcccaatttacagatgaaaaaataaatgtcagaaatgttaataagagacatatctaggatcacacagctgataagtggttgaactagaaattcagccccrtgtgaggctgaaatcaaatcttgttttttcactgtagtttttccaggctatgccaacttatctagaaattacaaaattagaagggcagttgttgatatgg

SEQ ID NO: 76534 - DNA, 201 bp, Homo sapiens
aatccagagtgagaaaatattgaggctcagaggagggaaatttcaaagccagatgttttggtgctgactttgggactggattctgagttttcttttgagamctttgccactttccctgtagtgtgttggtgtccgccttcaatcccataagctcggttgagaatgcctgtattagggagtgacttcatcattaactccagc

SEQ ID NO: 76535 - DNA, 201 bp, Homo sapiens
aaaaataaatgtcagaaatgttaataagagacatatctaggatcacacagctgataagtggttgaactagaaattcagccccgtgtgaggctgaaatcaartcttgttttttcactgtagtttttccaggctatgccaacttatctagaaattacaaaattagaagggcagttgttgatatggagagtaaggcatcagtga

SEQ ID NO: 76536 - DNA, 201 bp, Homo sapiens
acctgatgaactttgcctccatcttattcatggtaatttccttgagggaccacttgcctgtgactgcatgcatgtagatgctgttatgtgactactgtggrtattatattctgctatggaaataatgagcggctggtaaaggggaagccacagtcctgtgtagaggggcaggatcttgtctgatagtgaggccattgacca

SEQ ID NO: 76537 - DNA, 201 bp, Homo sapiens
atggtaatttccttgagggaccacttgcctgtgactgcatgcatgtagatgctgttatgtgactactgtggatattatattctgctatggaaataatgagmggctggtaaaggggaagccacagtcctgtgtagaggggcaggatcttgtctgatagtgaggccattgaccacccatgctagaatttggaacttccaggga

SEQ ID NO: 76538 - DNA, 201 bp, Homo sapiens
tttggttgaggttaattctttgccccacagccaccaaagagtcttcatctgagaacatctaaatggccaacttttggagatcagggggaaaaaaggggtgractaagtaatgagcatagttctgaaaactgttttattttttcaaggtaaaatttggtaacgaggagcttaaacaatttttttttccttctgggtcatgaa

SEQ ID NO: 76539 - DNA, 201 bp, Homo sapiens
tcgtaagaattggagataaaatacatcacgcacaatctggtttgtacagtgcctcacatttaatagacagagagtcataattattattcccattcatagtrgtgattgtagtaaaatggaaaaccagaactttgtgtgccttggcttactgcaatagctgaaatttatagtggtacattccctgataacagacatgactct

SEQ ID NO: 76540 - DNA, 201 bp, Homo sapiens
gcctggagtgcaaagagatgatgtgttgactccctgggtgggggtgggggtggggggtggtgggaccagagtgggaccagggactggaatgtggggcaggmtgcagagtggagaggctcgctcagatgaaggcactactgtgtcaccattggctcctgggtcctggctccaggtggggagaagcagtttctctttctgggg

SEQ ID NO: 76541 - DNA, 201 bp, Homo sapiens
gaagcagtttctctttctggggcaacaaataaaatccctccgagcacaggagtgctcattgctggttggttatgccagtctgtctctatttttagaaagarctacaagagggaggaaaagaatctagagaaataagtacagatggattcctccctgaggcagaagctggggtctgtgggatgaagcacagacacaaagcca

SEQ ID NO: 76542 - DNA, 201 bp, Homo sapiens
agcagcccctgggtttgtgctgtagaaaacattgcccatcattaactgggtttccttatcagttggggccacagggtccctggtggataaagcaatgatgrtgatgatgctgctgttgctgatgatgattttaatgatgataatgatgttgatgatgatgatgatattgatgacaaggataatattgatgctgctgatgat

SEQ ID NO: 76543 - DNA, 201 bp, Homo sapiens
ctgttgcaaaatgcactggcagcagcattgtagtgggcagtacagccagcacaggccagtctcagccccctggatccccaggctccattcagtttcaggcyggctggtctctacatgctgcacattcctctctgcacctgtgttcatccacttcttctcttccatgccgctcacaacggcatgtgcaaatctcatcatgta

SEQ ID NO: 76544 - DNA, 201 bp, Homo sapiens
gaatctgctgtgtctgccctgcctcctccctggtgcttttgctttttcttttttttttaactacatcctcaacacagccacttgcagccaccaccgtctcrccactgcctcatttattccttccgaggtgtagtgttggtcatatccctccggtgtccaaaaaccatcagggttcccgtgctcctagcgaggccctcccag

SEQ ID NO: 76545 - DNA, 201 bp, Homo sapiens
attccttccgaggtgtagtgttggtcatatccctccggtgtccaaaaaccatcagggttcccgtgctcctagcgaggccctcccagagcatccttctcgtytatttaatcctaggtccttctccatgtcctgtggtccaggaaagtgaatcctccgcaccctacagctccctcctgccctgcctgtcctgagtgctctccc

SEQ ID NO: 76546 - DNA, 201 bp, Homo sapiens
tatttaatcctaggtccttctccatgtcctgtggtccaggaaagtgaatcctccgcaccctacagctccctcctgccctgcctgtcctgagtgctctcccrgccctgggcttgcctgcgccttctcatgcgtgcatccaaagccacctctcgtgtcacctgctccttaccacctcccccttccccctgccccacaggattt

SEQ ID NO: 76547 - DNA, 201 bp, Homo sapiens
ccaagagatggccatgacattaatcatcactgtcccctaccccaaaatggggcttcaaagctccattgccgcaggcccctcacagccctgtcatggggttwtcctcagggctgatgagaggaaattcttcatttgctttaagagctgcaagcttaagttctctggacacttgcagccatttgacttttcctcctgagcaga

SEQ ID NO: 76548 - DNA, 201 bp, Homo sapiens
ccatgacattaatcatcactgtcccctaccccaaaatggggcttcaaagctccattgccgcaggcccctcacagccctgtcatggggttttcctcagggcygatgagaggaaattcttcatttgctttaagagctgcaagcttaagttctctggacacttgcagccatttgacttttcctcctgagcagaaggatgtaggc

SEQ ID NO: 76549 - DNA, 201 bp, Homo sapiens
agaattgtattccatcaaaatcttctccaccaatcctggcaagtccattctattttatctactatactgtttgtgttctctaaacagattgtcttgaaacrtccttgttgaatattgtcttggttagtttaacccactcttccttgttattttaacctaaactcaggaaatcactgatgcagaaatgtctccagcttcagg

SEQ ID NO: 76550 - DNA, 201 bp, Homo sapiens
accttaagtttgtgtctgtttagcatataagtatacagtatacattgcagtcatctgtacatgttgatatttattccaataagaataaaattacacataawagataccatttattaaacagttattatgtatccaacattgtacatattgtacattgtatgtacattgtacatattttgtatgtaatatcatttacccttc

SEQ ID NO: 76551 - DNA, 201 bp, Homo sapiens
ccaggaacatatcagccagctcagtgcacacaaagaaagccacagcccttttcccttgggaggcaaacagtgatttgactctgacctgatttcctacccasatcacataaaatggctggaaggtgtgaggtgaggcagagcaaatcagcccactgcattttgaatgttgtgatgtaggaagtgcacatctcgaggcttaga

SEQ ID NO: 76552 - DNA, 201 bp, Homo sapiens
ggcttgctcaacagcaatgttagatatctcagaagtggtttaatccttccagcaccaaatggtccaaattgacttagcatgctttgctgcagtggttgacrtgtgctcttttgacagccactgtctggtggacttattatacttatacacatcaaagatggaaaaggcatgtgactcagctgcatgagctcagggacctga

SEQ ID NO: 76553 - DNA, 201 bp, Homo sapiens
tggtctggttgagaagaaaataagcagaacagataggaaatagcaggttatttggtgagcttatgtatggaccatgagcattgtgggtgctcagaggagarggagattacttgagggactagaatggaaagggtgggcctcctggaggggcagctaggtgttgtaagagagaaaagaaaaacattctaggtggggagtcgt

SEQ ID NO: 76554 - DNA, 201 bp, Homo sapiens
caaagaaacaaatacctgggcactagagctgcttttaccttgagaacattttcccatctcggcaaacctaggctttggttttggtggttttatgggagcarggaggatagaaattagggttgatggatggccccaaatggggattgtaacaggatgtcctcaccaaattaaatcagaactccaaagggctatgttcagagt

SEQ ID NO: 76555 - DNA, 201 bp, Homo sapiens
ggatccctggcctaccagatctgggtttaaatccaggctttacaatatactcactgtgtgaccttggcaaagttattctagaaatattgccatctaacttaaaaaaaaaaaaggtttttacgttaaaacaaaactaaactaaaaaccagcttggataaatgcttagctatccagaaaacataaaatgtggacatcggagga

SEQ ID NO: 76556 - DNA, 201 bp, Homo sapiens
tgagaatctcactatgcctggggtcccacaactgccaccagcaagttccgggaactgaaccatgtgggcaggagctgggagcagagtggtgggaatggggrgagccccctttacacatcacccttcacagtcaggtgctcaagctcgtccaggcttaagcttccagaccagggagaattattaatagcacttcttctttac

SEQ ID NO: 76557 - DNA, 201 bp, Homo sapiens
ttgtgattgtgtgtggtggggcagttcatatccaatagcatccaatcctaaacgctgacgttaatgtacatgtgtctggttataaccctaaggccaaggtsattcttccttttgtttactaaccactcactgctctttggtttaggaacattccaggcctgagtatgaaaccaaagttcgagagaaaatgctaaaggagag

SEQ ID NO: 76558 - DNA, 201 bp, Homo sapiens
ctatttgcacactgcccctgacagatcatcagcatgctaacttttaaaacctaaaccaactcacatcactcctctgctcagaactctctgatggcttcccrtctcctgaggtgtggaagcccacatcctcacactacagggccccctcctggctgcctgcccatctcccactcctcctgtccccttgctcactcagtgtca

SEQ ID NO: 76559 - DNA, 201 bp, Homo sapiens
ggctttggattaattaagaaagccctctgattagagtagagaggggtgaccagtcctgctggtgatgggttgtccttgcttcggcctcttgtagcactcarccagcctttgcctcccgttctccagttcaggccaggcttccttccctttgctaatttcccaaagcactgcacattccaaagccatccccattccccaaga

SEQ ID NO: 76560 - DNA, 201 bp, Homo sapiens
ttcttttgcactttcttccccaccattgtctctgtcttctctttctgattaagtgttggagtttcaggccgggtgtggtggttcgtgcttgtaatccttgwactttgggaggcctaagtgggtggatcatctgagcccaggagtttaagaccagcatgggcaatatggtgaaaccctgtctttactaaaaatacaaaaaat

SEQ ID NO: 76561 - DNA, 201 bp, Homo sapiens
cttgtagcactcaaccagcctttgcctcccgttctccagttcaggccaggcttccttccctttgctaatttcccaaagcactgcacattccaaagccatcyccattccccaagagaatgggtgagctcagccccactgctcaggtcccgatttggagtacggttttggcatattttccatcacagttgttgtttctaggtt

SEQ ID NO: 76562 - DNA, 201 bp, Homo sapiens
atattagctgggcctggtggtgcatgcctgtagtcctagctacttgggaggctgaggtgggatgatagcttgagcctgggagacagaggttgaagtgagcygaaatcacaccactgcaccccatcctgggctatgcagcaagactcttgtctcaaaaaaaaaaagagttcctagatcaattaattttttaatgttttcttt

SEQ ID NO: 76563 - DNA, 201 bp, Homo sapiens
tcaatggtcttgtcagattttacaggatgttcatgatgctaattcagcagtccttataatatatacctttctttaatgcttttaaatctcaacacaaggtyaaggcaaagtcaggagagggaaccagtgtgggacattggacctgacctcctggtgttgttgttgttgttgttttggcagtcctgtatttgctgtgtaacc

SEQ ID NO: 76564 - DNA, 201 bp, Homo sapiens
gagggtctggaccagctcgaggcctttccagtagcatctaggtcttctcaaagcagggtctaaagctcacatctctctaagagcgcaggtctccacctccrtgtccaatgggaggcagcaccagtgtgacttgtcgtgtgggaaagccaggctcacatcgtctgtttctttagttgctctagaagcacttgtcctcagagc

SEQ ID NO: 76565 - DNA, 201 bp, Homo sapiens
tgcctgctgtgtgaacttgactgggtcactcaattctctggagatttagaaagcagaggcataacctctatggatgtctttctaagtcaggaattgagatycttgagataattccgtatacatatatgtgtacatggaagagagagagagagagagaagaaagagagaggggaggaggaggagaagggactatgatagaga

SEQ ID NO: 76566 - DNA, 201 bp, Homo sapiens
gcgctgggatacacattttgggagttccactctgtagatcagggacctaggttcggaaatggggaatgacttcctcggtctcttacaggtagtaagtggcrtagctgctccaggtgcagactagctttttagacaggctagttgtctcattattggaagtctctccttattagaaaactcaggggaactctcaaaatttat

SEQ ID NO: 76567 - DNA, 201 bp, Homo sapiens
tggcttaccatcagttcctaacggagctacacttagcctatctgcatcgagctattttcaagtagagttttctgaacagatctctgtgttagtctttctgmagatcctcaattagatggatatgcttgttaaacttaaaacatgttttagacactgagggaggacaaagtgacatttccaaaagctggggtgagttaatag

SEQ ID NO: 76568 - DNA, 201 bp, Homo sapiens
ttggtctggatcagccttctttttggttcaagaatgcagccatgaagcaaggccagcccctctagtggccgtagtcctgaagcatctggaaggggaagaascccaagactgcctgctggtgtctgcatcttccccaacccccccggctgcagagcaccattcagggtgtctgggtctcccctacccacacagaggccacag

SEQ ID NO: 76569 - DNA, 201 bp, Homo sapiens
ggtaacctagcttaactcagttggttaaaacactgttcctcaactattctcagtccaagatgtgccaagtgcttaactcagttggttaaaatgattttctrtatttcctagatggcatccctctttctctttcatccagggggtgtctgtcaccctttccctccatccagataagggcatgtgcatgcacacccatatgtc

SEQ ID NO: 76570 - DNA, 201 bp, Homo sapiens
actttcatcactggtcttcactgcaaaagtgatttttggggaaaagaatctcacaccacattttctaggcccttactatctggcagtgacaatcccagagraatgggaagtgaaaatgtctacattgttggagaggggtgatgtcatgtccaggttttcccagttacacgatagtagtccctacttagtcctggaggctgg

SEQ ID NO: 76571 - DNA, 201 bp, Homo sapiens
taacaccacatttctctttgggcaggtttaaggattaccgagagccgccatgggccccgaacccttatgagttttcgaaacagtactggtttattctgtcygcccgtctggcttttgtcataatcttccaggtgagttgctgggatagggaatagcccattcgaatccgggctgcaggagtaaggacactgcactcattgc

SEQ ID NO: 76572 - DNA, 201 bp, Homo sapiens
ggcatgatggtgtgggtaatgggggtatagggggaaggccagcagtggatgagtgttgggagatgaagtggtccagacgggtaggtgcggactcgatcatraaagaccctgtatgtcatatatgacaatttggtcttcatcctaagaagagtaggcaaccacagagtgggactaacttggtgagattgtttcaaaatggta

SEQ ID NO: 76573 - DNA, 201 bp, Homo sapiens
cacccatatgtcctctgctagggctgagatctttcacctttgctgtcaagtctgttttgcaaaacctacccaggtttccagaagcactaagtgggacttgrtggatgcacttgaggcttaagtgacaaggtgggctcatagtgtttccattgtctgtgtgaggaaggaactaagggcattgatggaactggtgttgcgagt

SEQ ID NO: 76574 - DNA, 201 bp, Homo sapiens
cattgttgtcctatattcattcattgagacagtaagtgctctggggaaaaggtagtcctagcctactgtgtgcaccagcaaagggatgtggcttagcagcyaggaggaagtccactgcaagtgtgtgccaaagcctagacccaatcggggcaagctggatgcaggggttcccagacaggcagggttagccgaggtggctgc

SEQ ID NO: 76575 - DNA, 201 bp, Homo sapiens
gcacaagtatgcttttcatgttgtgggggtgcagagggaagtggagagagtggggaggggaaggggactttactgttctcgagagctacccgggacttgcycctgggggagtttcccacctgcttgctaggtggaggttatcccccttgcctgggggctggcttgtctctgctgcctgataccaaagctgatccttttcag

SEQ ID NO: 76576 - DNA, 201 bp, Homo sapiens
gccagtgtgggtggtgttgacatttgcaggaagcagtgacagtccatggtcaaggttgagggctgcctccaccgccaagacacccacttggctccaactgygctatctccaggcccactggctgctcatggctggttcaggacccacttgtttttcttcctcttttttaaattaaaagaaacatttttgtatcatcataaa

SEQ ID NO: 76577 - DNA, 201 bp, Homo sapiens
gtttctgtttgctggattctgtatgttttcttccttgctttatatccttggttggtgaaattcatcctccaggagcttcatgagaatggatgcatgcataraaagttcatttttttgaaaccttgcatacttaaaagtgtctttagtctgtctttgactttcgtctatactttggctgggtataggagtctatgctgaaaa

SEQ ID NO: 76578 - DNA, 201 bp, Homo sapiens
acttaccactatattactgcctacagtattcagtacagtaatatgccgtacaagtttgtagcctgggagcaatagactatactttatagcctaggtgtgaygtaggctatatagcatctagatttgtataagcacgttctgtgatgtttgcaaagtcacctaatgatgcatgtctcagaacatatccccatcgttaagcaa

SEQ ID NO: 76579 - DNA, 201 bp, Homo sapiens
tatgcttttcatgttgtgggggtgcagagggaagtggagagagtggggaggggaaggggactttactgttctcgagagctacccgggacttgcccctgggkgagtttcccacctgcttgctaggtggaggttatcccccttgcctgggggctggcttgtctctgctgcctgataccaaagctgatccttttcaggatggga

SEQ ID NO: 76580 - DNA, 201 bp, Homo sapiens
tgcctgataccaaagctgatccttttcaggatgggaagcagccagctggttttaagagaatgctctcttctgcccttgaggggagtgctgctccagcggtrggactggggaaatggccagccctctgtgggcagatcagctatttccagaagccaggcaggcaggagaagcctacgtcaccattctgttggacgagccagg

SEQ ID NO: 76581 - DNA, 201 bp, Homo sapiens
attttttgtagaggcagcatttcgccatgttgcccgggctggtcttaaactcctgggctcaactgatctaccagcctctgcctcccaaatgttgggattayaggcctgagccactgtgcccagccccaggctcttcctgtggcttctcttctctgttccagttgggcagaggtggcatggtgagggcagtgctgggagtga

SEQ ID NO: 76582 - DNA, 201 bp, Homo sapiens
ttgagggaccacttgcctgtgactgcatgcatgtagatgctgttatgtgactactgtggatattatattctgctatggaaataatgagcggctggtaaagsggaagccacagtcctgtgtagaggggcaggatcttgtctgatagtgaggccattgaccacccatgctagaatttggaacttccagggagtgggttgcgag

SEQ ID NO: 76583 - DNA, 201 bp, Homo sapiens
cccaaatgttgggattataggcctgagccactgtgcccagccccaggctcttcctgtggcttctcttctctgttccagttgggcagaggtggcatggtgarggcagtgctgggagtgaaggaaaggacttgatctgactgggagggccaagctgtcttgggaccttgcccctcccatccttccccaccatggagactcgtg

SEQ ID NO: 76584 - DNA, 201 bp, Homo sapiens
tgctaccctgtaagcccccacttccctagcactcttccccagtcctctgagaatggccaggttcagagacagcccattgagcctgatgacctgaggaccargcccttctccaagtggctgagcaaatacttggagctttcttggcctttcctgccactcaccagcccaggagtggacaggactcgtgcctcatacctgagc

SEQ ID NO: 76585 - DNA, 201 bp, Homo sapiens
cagcagtcctggtgttagctgtgacccaggctgtgaaaaaccagagagcagctggcatttctggtggggctgcttgctgacagatcttggtgccacatggygagcagaggagccccagggcttggtggaggtgtgggagggacacctggcatgaagggtcccagggcatatacttggcctgcctatgccttgcctgtgact

SEQ ID NO: 76586 - DNA, 201 bp, Homo sapiens
ggtttcagcaccaggtttcctctaagatttctttaaaaaattaaaataagtaaacggtatggcgactctgttttctgaactgaaaattaggacatggacawgtgatgtggcatgagactggatgtgaaagttgatgctgttcagaaaaatacggtgtatgtggccaacacagagatgactccatggccctcctccaaggtc

SEQ ID NO: 76587 - DNA, 201 bp, Homo sapiens
gtatgttgcaacagttggagaagtcctcctggaaggggtgggactgacgtcccctcggagaatgggtgaggatagaatggcaccgcctgcagttgttttakttatgcttgttagtcacttacatggtctgtcctctcctgcatcatggcgtgtcttgggaaagccagagacaggtcaaaagcctggcccgttgacctttgg

SEQ ID NO: 76588 - DNA, 201 bp, Homo sapiens
accttggttctgccttcactgtaatcctgatgctgcatatcctcacctctccttactttccttcctgttgaatggtaaaaagctaccatttactgaggccyagagtggtgcgcgaatttgcttaagaccacgtagctggttgtggggaagctggtaatcaaacccagctctgcctgatccccaaggcctgtttgcttttct

SEQ ID NO: 76589 - DNA, 201 bp, Homo sapiens
aatatgcatatatatgaataatttttagcttattcacagatgtgtgcaattatctacacaatttatatttaaaacatttttattatccgaaaaagaaaccstgtacccaatagttgccaagccgtgggtaacaactaatctactttctgtctctatagatttgcctattctggactttcacgtaaatggtattatagaata

SEQ ID NO: 76590 - DNA, 201 bp, Homo sapiens
ttcatattgtagcatatatcagtacttcgttcttttatattgccaaataatattctatattgtggatctgcttcattttatttatcgatgcagttgatggwcatttgggtggtctctacttttgggctattaggaataatgctgcaatggacatttgggtacaagttttttttttttgccgtatgctttcatttttcttgg

SEQ ID NO: 76591 - DNA, 201 bp, Homo sapiens
atattttatccctgcttgctccacccatttcctaattgccctgattggaatctcctgtacaatgctgaatagaagtggtgaggccgggtgcggtggctcaygcctgtaatcccagcaccttgagaggccgaggtgggcggatcatgaggtcaagagatggagaccatcctggctaacatggtgaaaccccatctctactaa

SEQ ID NO: 76592 - DNA, 201 bp, Homo sapiens
tggcgtgaacccgggaggcagagcttgcagtgagccgagattgcacgactgcactccagcctgggggacagagcaagactctgtctcgaaaaaaaaaaaaraaaaaagtagccgggcgtggtggcaagcacctgtagtcccagctactggggaggctgaggcaggagaatgacatgaacctgggaggcagagctggcagtg

SEQ ID NO: 76593 - DNA, 201 bp, Homo sapiens; identical to SEQ ID NO: 30483

SEQ ID NO: 76594 - DNA, 201 bp, Homo sapiens
gtactcatggtcaccaccactcctctgtgctttctcttgagtgtggaaaagaacaactcagcatcatcttgtccttccgtctgcttccaaataagatcaarctttacccattccacccagatgagcatctgttttgaatgctcatagatatctgctagatggttagctccttaaaggttcagatccacagtttatcccttc

SEQ ID NO: 76595 - DNA, 201 bp, Homo sapiens
tatttcttggcttgcagggcatgacctgagctggggggcagaaagttcccaggacattggaactgaacagcatgaactgcaggagctcttagccttgcctscagcccgaacccttgactgccataagcacagttctttttatctcagacccattactacccaggcctccagccccattgtcaccactgacctcccatattc

SEQ ID NO: 76596 - DNA, 201 bp, Homo sapiens
tgagctggggggcagaaagttcccaggacattggaactgaacagcatgaactgcaggagctcttagccttgcctccagcccgaacccttgactgccataakcacagttctttttatctcagacccattactacccaggcctccagccccattgtcaccactgacctcccatattccccaccctttgcctagccctccagcc

SEQ ID NO: 76597 - DNA, 201 bp, Homo sapiens
ctgcaggagctcttagccttgcctccagcccgaacccttgactgccataagcacagttctttttatctcagacccattactacccaggcctccagccccaktgtcaccactgacctcccatattccccaccctttgcctagccctccagcctgagagagctggggtggaggagtaggagagagagacagacagagagagag

SEQ ID NO: 76598 - DNA, 201 bp, Homo sapiens
attactacccaggcctccagccccattgtcaccactgacctcccatattccccaccctttgcctagccctccagcctgagagagctggggtggaggagtargagagagagacagacagagagagagagagagagagagaaagagaaagagagagatagatagatcagagaatatagtttataactcatcaagagtctataa

SEQ ID NO: 76599 - DNA, 201 bp, Homo sapiens
gccatcaagtctcctccacgcctggccccaactccaaaaactccttaaggaccttgtctcctgggacactctgctttggcctcatcctggtgggatattgrctgcaccttgggcactctgcccttccccaaatcttctgtccagtgaccttgatgtcactgagacaaaagtgaaattcatgattcataaaaaatgtgagtg

SEQ ID NO: 76600 - DNA, 201 bp, Homo sapiens
tgaaatgctgcctgttgctctgggtttacctggagtctctttcctgcttagcaatcacctccccacatggagcagaaggcagtgctctgtgcaaatccctktgtgcaggttgtgtggcaggaaccaatgtcgggaggagagaggacactgctattaccagggcctggaactagtacccatgttcccctttattctgctttt

SEQ ID NO: 76601 - DNA, 201 bp, Homo sapiens
ggagcagaaggcagtgctctgtgcaaatccctgtgtgcaggttgtgtggcaggaaccaatgtcgggaggagagaggacactgctattaccagggcctggarctagtacccatgttcccctttattctgcttttgtctcgctttgagcttggggcagaggaactcttctgctcttccctgtacaacaggtctgtcatgcaga

SEQ ID NO: 76602 - DNA, 201 bp, Homo sapiens
gaacctgggaggcagagctggcagtgagccgagactgcgccactgcactccagcctgggtggcagagtgagactccgtctcaaaaaaaaaaaaaaaaaaargaagtggtgagaatggacttccttgctttgtttttgaccataggagaaaaaaatttagtttttcaccattaagtcactgtaagtctcatgttagctgtag

SEQ ID NO: 76603 - DNA, 201 bp, Homo sapiens
aaggaggcctcaggaagtttataatcattgtggaaggcgaagggggagcaggcacgtcacatactgaaagcaggagagagaaaaaggagtgagttataggkgaggtggtgccacacacttttaaatgaccagatctcacaggaactcactcacttttgcaaagacagcaccaagccatgagggatccacccccatgatcca

SEQ ID NO: 76604 - DNA, 201 bp, Homo sapiens
agcatgtgtgagattgtgttagtatgtatgtgtgtggatgggtgagtgtgccagtggtgtgagattgtgtttgctgtgtgtgtgtgtgtgtgtgtgtgtgwgagagggagacaaggagagggaccatgtctgagtgatggtgtcattggagtgacacagatgggctcagataacagaaagcttcaaagaggagcaaagata

SEQ ID NO: 76605 - DNA, 201 bp, Homo sapiens
tggactctggctattaagggctgaattaggatacctgggacctttgttctctcctgtacgcctgcatgagctgaggaagaattggcagaaaatggcctggkttctgtcccaagctgaagggcggttggggagtcaagcccctgtgctctcagaccagtccctgagccggtctgataagggctgagaagctgcgggttggtt

SEQ ID NO: 76606 - DNA, 201 bp, Homo sapiens
ggttggttcagctctgcagtcctgtgcttcagaggatctgtgcacactgccccttggccttctcatatttggtaataaggacacttcatttcaggggacaygtagctccctggaacctgtgtcacaaaagtggaattgttgctgaaggctgccccctgacaattttatgtactattttttaaactttagctttaatttttt

SEQ ID NO: 76607 - DNA, 201 bp, Homo sapiens
catttcaggggacatgtagctccctggaacctgtgtcacaaaagtggaattgttgctgaaggctgccccctgacaattttatgtactattttttaaacttyagctttaattttttatttttgacagtgcatggtttctgtctctggctcctctctctctctttctttctctacccgcgcccccgccccccacccgccctgc

SEQ ID NO: 76608 - DNA, 201 bp, Homo sapiens
aggctcttgaaaaaaatgccgtaaggaatttcagtgagtgagccagaagcgctcatccacagtgtacccacagtgtgttggagtttgggactgaccctttmtaaacagaatttagcactctcttacatggcaaggttgtttgttgttgtcgttgttgttgtttataattacacaagttatacatgaaagcatcttcagaaa

SEQ ID NO: 76609 - DNA, 201 bp, Homo sapiens
gagcccccgtgcccggccagtactttgttttttaatgtcatcatgttttagtgaagctgacttttctgtggttgcagccagtgagaactgcacaaaatcaytgtggaacaggaagcatgagtgttgctgttcaatctgataccaagattagaaaagttggaagttctctaacaggtgcacacatcctgttagctagtaatt

SEQ ID NO: 76610 - DNA, 201 bp, Homo sapiens
tattaatgtataatctcttttgaatttggtagtgttcaagatttgatattcagttttggttttcagtattttgactctgatgtatctaggtgtggttttcttttttttttttaacttgagtttgctggacttcttaaatctgttattacaagttattgtattttatcaaattttgagacaatttcagccactatttattca

SEQ ID NO: 76611 - DNA, 201 bp, Homo sapiens
acatggaactgttaagtatttcttttagcctaagagcattgcataaaagttgctgggaccttaagggtactgtgaaccaagaaagtttgggaacagctgcmtaacgaacttcctaagttgggcgcagtggctcacgcctgtaatcccagcactttgggaggctgaggcgggcagactgcttgagctcaggagtttgagacc

SEQ ID NO: 76612 - DNA, 201 bp, Homo sapiens
aattcaaatgctaaattttgctaaatgtagttaacttgtgcctaaatgatttgatccagtttataggtgtactggaggcatgcccaccttccatatcaaasgggaaggcaagcatctttctctaaattgacaacatcgatatgtggcattccaggaggagcctcaagaagcaacagaatctgttggccaactactgtcaca

SEQ ID NO: 76613 - DNA, 201 bp, Homo sapiens
gggcaacgtagtaagaccgtgtctctacaaaataattaaaaaatatagctatgcatggtggcatgggcctgtagttccagctactcgggagcctgaggcargaggatggcttgagcccaggagttagaggcagcagttagctgtgattgtgccactgcactgaaacctgggtgacaaagcgagtctctgcctcttaaaaaa

SEQ ID NO: 76614 - DNA, 201 bp, Homo sapiens
tgcctaaatgatttgatccagtttataggtgtactggaggcatgcccaccttccatatcaaacgggaaggcaagcatctttctctaaattgacaacatcgrtatgtggcattccaggaggagcctcaagaagcaacagaatctgttggccaactactgtcacacaagctcaccatccatccatctatccatccatccatcc

SEQ ID NO: 76615 - DNA, 201 bp, Homo sapiens
taggcaaatgacctggatagacatttctccaaagaagacataaaagtggccaacaggtatatgaaaaagtcctcgacgtcaccagtcattagggaaatgcraatcaaaactacagtgagatatcatcgcatacctgttaggatagctaatataaaaaagtcaggagataactcttttggaaggaatgtggagaaaaaggag

SEQ ID NO: 76616 - DNA, 201 bp, Homo sapiens
ttctttgggaggttggggtggggatgatatacgtgcagtatttcacatctctgttcgttcattgcagacccatttaacttcccaggtattgtataaaacaytgggaattaaagctaaacagaatgtggctccttccatcaaaccctgggtaatcacaaggaaggaaggcctataaggaaagaaggcagacgagtgaggaaa

SEQ ID NO: 76617 - DNA, 201 bp, Homo sapiens
ctagtaaggaaggaagactggtaagaaagtgactaataaggaaagaaggcagacgagtaaggaaagaagatagactagtaaggaaggaagactggtaagaragtgactaataaggaaagaaggtagacgagtgaggaaagaagatagactagtaaggaaggaagactggtaagaaagtgactaataaggaaagaaggcaga

SEQ ID NO: 76618 - DNA, 201 bp, Homo sapiens
ggaagactggtaagaaagtgactaataaggaaagaaggtagacgagtaaggaaagaagatagactagtaaggaaggaagactggtaagaaagtgactaatraggaaagaaggtagacgagtaaggaaagaagatagactagtaaggaaggaagactggtaagaaagtgactaataaggaaagaaggtagactagtaaggaa

SEQ ID NO: 76619 - DNA, 201 bp, Homo sapiens
atttttgtattttttgtagagacggggcttcaccatgttgcccaggctgttcttgaactcctgacctcaagagatccacccacctcagcctcccaaagtgmtgggattagaggggtgatccacagtgcctggccagactccattattttaatgaatgagcagtttgcagccaccacagtgtacctagtcactcccctagta

SEQ ID NO: 76620 - DNA, 201 bp, Homo sapiens
aaagggggatatcttgggtgtgtgacatcgtgccctcccagggaggcccatttagcagagaggactgagaaaatcagaatgtcgcctcactttcttttttctttttttttcttttttgagatggagtctcactctgtcacctaggctggagtgcagtagcgcaatcttggctcactgcaacctccgcctcccgggttcaag

SEQ ID NO: 76621 - DNA, 201 bp, Homo sapiens
ggactgcccctgagacaggtgtatgggtctggagccagcaggcaggggtgagaggtggcaaggcttcccagggggagcaaggctagaggatgacactgcamaatttgaagatcgagaaggagcatcgggtgctgtggcatgtcggggccgtgtggtaccagggtcacctggggctctggcagggaggacaggacgatgtgg

SEQ ID NO: 76622 - DNA, 201 bp, Homo sapiens
gcagtgctctgtgcaaatccctgtgtgcaggttgtgtggcaggaaccaatgtcgggaggagagaggacactgctattaccagggcctggaactagtacccrtgttcccctttattctgcttttgtctcgctttgagcttggggcagaggaactcttctgctcttccctgtacaacaggtctgtcatgcagaggctggttct

SEQ ID NO: 76623 - DNA, 201 bp, Homo sapiens
acactgctattaccagggcctggaactagtacccatgttcccctttattctgcttttgtctcgctttgagcttggggcagaggaactcttctgctcttccytgtacaacaggtctgtcatgcagaggctggttcttataaaagattaaccttgtctccctcctatagcctaagaccacctgtgagtcacctcccattaatc

SEQ ID NO: 76624 - DNA, 201 bp, Homo sapiens
tattaccagggcctggaactagtacccatgttcccctttattctgcttttgtctcgctttgagcttggggcagaggaactcttctgctcttccctgtacarcaggtctgtcatgcagaggctggttcttataaaagattaaccttgtctccctcctatagcctaagaccacctgtgagtcacctcccattaatccacctct

SEQ ID NO: 76625 - DNA, 201 bp, Homo sapiens
cagctaggaatgaagcccagcatccattagctattcttcctgatgctcttcctcccaccataaccaccaccaacaggccccagtgtgtgttgttcccccartgtgtccatgtgttctcatcattcagcttccacttataagtgagaacatgcggtgtttggtttctgtttctgtgttagtttgccgagaataatggcttcc

SEQ ID NO: 76626 - DNA, 201 bp, Homo sapiens
ctcccaccataaccaccaccaacaggccccagtgtgtgttgttcccccagtgtgtccatgtgttctcatcattcagcttccacttataagtgagaacatgyggtgtttggtttctgtttctgtgttagtttgccgagaataatggcttccaactccatccatgtccatgcaaaggacatgatctcattcctttttatggct

SEQ ID NO: 76627 - DNA, 201 bp, Homo sapiens
gtcagtgtttaatgaagaaagcagaaggcaggaaattgcccagggtcatgcaggatgacccatgtacatgtgtgggtttcctccatgtgggggctactcayggagggtgagtgcttaatctgctcaccacctcttgcattctgggtcaccccttcctgctgctaggatgctcagaagtgggagctaattcagtcattaatc

SEQ ID NO: 76628 - DNA, 201 bp, Homo sapiens
tgcatgtatgtcttcttttgagaagtgtctgtttatgtcctctgcccactttttaatggggttgtttgttttcttcttgtaaatttgcttaagttccttgyagattctggatattagacctttgtcagatggataggttgcaaaaattttctcccattctgcgggtcatctattcactctgatgatagtttcttttgctgt

SEQ ID NO: 76629 - DNA, 201 bp, Homo sapiens
tgggaagagaaggctcaggccaccaaaaagaaacctttaggcaaagaagtgaaggcgctggcagttggaagttggactcaaaattatcctggtaagctttkagggaatttggagcagacactaacggtatcagggtctcctaagtcctaaagtgcatgagttaagatctagtcagacaatcagcaatcctggagttcagtg

SEQ ID NO: 76630 - DNA, 201 bp, Homo sapiens
gctgctgcaacaagtgactgcaaacgggagggcttaaaacaacacaagttcattctctcatagttctggaggccagaagtccaaggtcaaggtgtcatcargcccacgttccctctgaagtctctaggagagaatccatctttgcctcttccagcccttggtggctccaggcatttcttaaattgtggctaaaccactcca

SEQ ID NO: 76631 - DNA, 201 bp, Homo sapiens
ctgcaatttttattctctgggcctctgtatgaattagttttgcattgccatacaggaatatctgagaccgggtaatttataaagaaaagagattcatgtgkcttatggttctgcaggctgtacaagcatggcaccagcatctgcttggccgctggggaggcctcaggaagctttcatggtggaaggtgaagagggagcggg

SEQ ID NO: 76632 - DNA, 201 bp, Homo sapiens
tttttttttttttttgagatggagtgtccctctgtcacccaggctggagtgcagtggtgcaatctcggctcactgcaacctctgcctcctgggctgaagcrattctcttgcctcagcctcccaagtagctgggactataagtacgcgccaccacgcccggctattttttgtatttttagtagagacagggtttcaacatgt

SEQ ID NO: 76633 - DNA, 201 bp, Homo sapiens
gggatgcaaactaattctcagtgcttggtaaactatttacaagaggcttaagtgttcttggtcatctctgccctgcatcactgacaagagggagaccttaktgtcaggcctcaggcctctttctctttgtagatctgaatacaccattagtgtctctgagctgctcttgcagcagccagggcctgtcccctctctccacag

SEQ ID NO: 76634 - DNA, 201 bp, Homo sapiens
ccccaagaccttctggcctaagatgctctgtccttacagaacagctgatgaggagaaggtaaggagaggagagcaggagtgaggctaatggacacactcayttgtcctaaaagtgtcgcttgtagaaaatatgaatagactctcaaagggattgaccagactgcgaatgaacacagagctgggtatggtaacctaaagagc

SEQ ID NO: 76635 - DNA, 201 bp, Homo sapiens
ggatagaggggaacaactatcgagctctgtgggacagcacatttagttgatcgtgtactcggtgtagtacataaggggcggcttttggaaaagtgaacctraagggaatttgcaaatggtctcaggtgatgttttatttaataatgtatttaaaaagtgcttattgagcacctactatgtgccagccactgtgctagcagc

SEQ ID NO: 76636 - DNA, 201 bp, Homo sapiens
tcctacctaactcaccgagtggtaatgactataaagaacagacatgatatagacctaaaggaattatgtaaattgtaaagctgtgcacatttgaaaagctrtattgtattagtttgttttcacactactataaagaactgcccgaaactgagtagtttataaaggaaagggatttagttggctcagttccacatggctggg

SEQ ID NO: 76637 - DNA, 201 bp, Homo sapiens
ggggattacaattcgaatgagatttgggtggggacacagagacaaaccatatcatatattgttaaatacaattcaagattcagagtgatgtcattgtcccmaggtcacctggctggcaagtgcagaagttgggagtagaatcccggtcttacaagtttcagtgagaagcatgagcattggctgtgaattagtagctctatg

SEQ ID NO: 76638 - DNA, 201 bp, Homo sapiens
ccaaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttct

SEQ ID NO: 76639 - DNA, 201 bp, Homo sapiens
taacaggccaggcagttgcaaagccagcgtacaatgcactttctctgaccctcggccacccttctttccacggcatcccgaatctcccccagaagggcacygtgtcaacctagaaagagcttgaacccttaagcaaggtcaaagactcttcctcattcccaagccacagggctttgtgaaccttgtcgacctggcagcatt

SEQ ID NO: 76640 - DNA, 201 bp, Homo sapiens
caaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttctt

SEQ ID NO: 76641 - DNA, 201 bp, Homo sapiens
tgtttaaagtggatagcattcatgctcttccccccttttctttctctccttttttcttctttctctttcaattttttcttcttttttctcctctcttgccrtgagcagatgagcaatgtttgatttgctctctattagatttgtaattgtttataagttaactacccacatagctaacacccagcataaaccccctaaaag

SEQ ID NO: 76642 - DNA, 201 bp, Homo sapiens
aaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttcttg

SEQ ID NO: 76643 - DNA, 201 bp, Homo sapiens
tgcaatagctgaaatttatagtggtacattccctgataacagacatgactcttagtgctgcataggtattaatgctttaaaccaggggtctccaacccccmggccgtgggccggtagtggaggtgagctgcatgtgaacaagtgaagcttcatctgtatttacagccactccccatcactcacattactgcctgagctcca

SEQ ID NO: 76644 - DNA, 201 bp, Homo sapiens
tctttctctccttttttcttctttctctttcaattttttcttcttttttctcctctcttgccatgagcagatgagcaatgtttgatttgctctctattagrtttgtaattgtttataagttaactacccacatagctaacacccagcataaaccccctaaaagacaatgttatcatggaatctccattccccataaaacat

SEQ ID NO: 76645 - DNA, 201 bp, Homo sapiens
cagttccttcatatctgaatcttggcaggctcagaaattaaaacatttcgtcagaaagcttagaaaatatggggcacaattgggaatatgtataggatgtstgtgttttggatacacacacacacacacacacacacacatacacacaccaagcacttactcttgctaaagaagctcacggtggggacttccaagggcaga

SEQ ID NO: 76646 - DNA, 201 bp, Homo sapiens
acccatttaaaagctatgctattataaaaagtaaagaacgagttgctctcaccagggcgcatggtgggtatgtgacctgttgagctgtgaatgactggttrgtgatgctgcagaagccacatgggcggggtggatgcagattctaatagatattatggcagccttcataatgcaggagtcgtgagggttcccatacatttc

SEQ ID NO: 76647 - DNA, 201 bp, Homo sapiens
gtttgctaattgtggtttcacatcttctgtatacctgctgattttttgtcttcttacattatcaattactgaatgtgttgtgctgaaatctcccctatgarggaacatttatgaaagttgaccatacaccaagccagaagttctgaacatgtttcacagaatttacgttataaaaatcacattctttaacctccaattcta

SEQ ID NO: 76648 - DNA, 201 bp, Homo sapiens
ttgtacactgcttttcccatgacaactcacattttacaaatcaaacagtggagtaaagcagtcaagaacacgggctttgccaggggttttaaaccccatcrgttattagcttgtctacactatctgtgtgatcttggctgagatacttaactctcttggctttgcaacatattttaagattagcactaaagtacattgaaa

SEQ ID NO: 76649 - DNA, 201 bp, Homo sapiens
ggttgaaaattcttttctttaagaatgttaaatattggcccccactctcttctggcttgtagagtttctgctgagagatctgctgttagtctgatgggctkccctttgtgggtaacccaacctttctctctggctgtccttaacattttttccttcacttcaactttggtgaatctgacaattatgtgtcttggagttgct

SEQ ID NO: 76650 - DNA, 201 bp, Homo sapiens
tcttggagttgctcttctcgaggagtacctttgtggcattctctgtatttcctgaatttgaatgttggcttgccttgctaggttggggaagttctcctggrtaatatcctgaagagtgttttccagcttggttccattctccccgtcactttcaggtacaccaatcagatgtagatttggtcttttcacatagtcccatat

SEQ ID NO: 76651 - DNA, 201 bp, Homo sapiens
atcacattgttgcctcttgggcttcagtttccttatgtatgagactaaagactgtacatagatgattcctaaatgctaagattttaaaatttctaccatgrtccagaagagtagcattgtagtccacaccttgtggacttcagcaaattgcatcacttttccatgcccgtttcttcatctccaaaatggtcacgtgactgg

SEQ ID NO: 76652 - DNA, 201 bp, Homo sapiens
cttggagttgctcttctcgaggagtacctttgtggcattctctgtatttcctgaatttgaatgttggcttgccttgctaggttggggaagttctcctggawaatatcctgaagagtgttttccagcttggttccattctccccgtcactttcaggtacaccaatcagatgtagatttggtcttttcacatagtcccatatt

SEQ ID NO: 76653 - DNA, 201 bp, Homo sapiens
cttctcgaggagtacctttgtggcattctctgtatttcctgaatttgaatgttggcttgccttgctaggttggggaagttctcctggataatatcctgaakagtgttttccagcttggttccattctccccgtcactttcaggtacaccaatcagatgtagatttggtcttttcacatagtcccatatttcttggaggctt

SEQ ID NO: 76654 - DNA, 201 bp, Homo sapiens
tttggttttgttcattcttcctattgtttgtcttctatttccttcattcaggctcttctatttattatgtccttcctttttctttctttggactgaactcygtttttctttgttgttggatgtttaactcattaatttgcagacactaaaaaaaaagcatgtaaactttttatcatttagttttttcatttactatttttt

SEQ ID NO: 76655 - DNA, 201 bp, Homo sapiens
tgaatatcttcttagagaggaacaggagacttgtaaagttttatgtgggctcacagtttaaagagaacctgtttatggggttgtaataaccatgtattcayggacacaactgcttatgtctgtgaaggatcagcaattcatcagacacttagtgagttactttcttctctgattgtcagagtgaaaggtgagtaagatcac

SEQ ID NO: 76656 - DNA, 201 bp, Homo sapiens
ccttgtagatcctgaaaagtattttgggttttcttctacctgtgatataaagtcagaaaatcatcctgagcagaggaagaaagaatctgacagaagtgtartgaaaagattgcatggggcaagggtagaagcagggaggtctttgcagggaccgtgtttggccagggtattggtggtggagatggtgacacatggttggat

SEQ ID NO: 76657 - DNA, 201 bp, Homo sapiens
tcacagtttaaagagaacctgtttatggggttgtaataaccatgtattcatggacacaactgcttatgtctgtgaaggatcagcaattcatcagacacttwgtgagttactttcttctctgattgtcagagtgaaaggtgagtaagatcacttctctcagggagctcacagtcatatgcactgagtcacatgacatagagt

SEQ ID NO: 76658 - DNA, 201 bp, Homo sapiens
atgtgagttgcctaaggtcacccagatgactcactagtggaattgaggttagagccactttccagaccattccacgggagacgtgcttcaagacctgtagkaacttgggcttctgtggaaggatggaatgaagtgaggcttcctccctccttcctaactggctagacctcccccgttccagaagggcccatgtcttggact

SEQ ID NO: 76659 - DNA, 201 bp, Homo sapiens
ctccctcttggttcttcctgggcatcagccatgccatttcctctccttgtctcttcactgctgtgagtaagggcttcattagagtcgcttcctttgaaccrtccaaggggaattgtttcctgctgcaatcctcagtggtagaggggtcaggccaacatccgaagttaaacatggagatgcctgggtagaacctgcccttcg

SEQ ID NO: 76660 - DNA, 201 bp, Homo sapiens
tcaaacgtaaagttgagttcccttcctctttcctataagaaaggctagggtttggaaatacgagggtctggaggaggtgacaattggctccctttcccccwaaagaagccagccaaccagaaagtgcttcttaagagcctgatttaagctgagactgagactaagaagtccagtggctcagaagtggtctctgcccccaga

SEQ ID NO: 76661 - DNA, 201 bp, Homo sapiens
ttgttttcacaaccttccattcattgaaatgccactctgctgctcgtccctttctaagatgctaagaggatgtggcctatgggagaaggggagccgtctarggaaattgcccccatgctggaagtgggaacggcagggaagagggccctattttccattgaagaaaagccgggacaaatgcttcttttctctttcccagga

SEQ ID NO: 76662 - DNA, 201 bp, Homo sapiens
attagagatggagtcttgctctgtcacccaggctgaagtgcaatggtgagatctcggctcaacaaaacctccgcctcccaggttcaagcgatgctcctacytcagcctcccaagtagctggggttacaggcacgcgccaccaggcccaactaatttttgtatttttagtagagacggggttttgccatgtaggccaggctg

SEQ ID NO: 76663 - DNA, 201 bp, Homo sapiens
caggtttgttttcacaaccttccattcattgaaatgccactctgctgctcgtccctttctaagatgctaagaggatgtggcctatgggagaaggggagccrtctaaggaaattgcccccatgctggaagtgggaacggcagggaagagggccctattttccattgaagaaaagccgggacaaatgcttcttttctctttcc

SEQ ID NO: 76664 - DNA, 201 bp, Homo sapiens
gttcactagttagtggcatatgaaggaaaaatctggttccttgaaacttgcttctctgtaaactctttgtggggacactcgggagctggtgatcctagcgygggtcttaggaggcctggctcaccactcgctagtgggtctgaactgctcatccttccccaaagaggacccatgttggctgcctgtatctgacactctttc

SEQ ID NO: 76665 - DNA, 201 bp, Homo sapiens
gctttctggactgtaaatcagatcacatcactcgcccacataaaacccaccagagactttccccattatagcccaccaggcctcacaagatctggctgccrtctttcttcccttccatgcttcaccttattcaccactcttgaactacattcacttttttttttttaagatagtctcgctctgtcacccaggctggagtgc

SEQ ID NO: 76666 - DNA, 201 bp, Homo sapiens
ccttattcaccactcttgaactacattcacttttttttttttaagatagtctcgctctgtcacccaggctggagtgcagtggcacatgatctcggcccacygcaggctctgctcctgggttcaagggattctcctgcctcagcctcccaagtagctgaaattacaggcatgcaccaccatgcctggctaattttgtatttt

SEQ ID NO: 76667 - DNA, 201 bp, Homo sapiens
agagaatttgtggcaggaaatttgccctggaaatgtactcagctgaatacttgcacttcttagcatggaaagactcccatccaagaatctcagcatgcttrtctataaacatgaatgaattaatcctcctagcaccactgtgtgctctttgccagctgggttattttaagggaagtgaccaacccagcagcctgtagtgag

SEQ ID NO: 76668 - DNA, 201 bp, Homo sapiens
tcctgccttcatctgtggaatttgctttattccacctaccaggacctgcaatggtctttttcatttgcttatttctttttttctttttcttcttcttcttyttttttttttttttttttttgagatggagtcttgctctgttgcccaggctggagtgcaatggtgcgatctcggctcactgcaacctccgcctcccaagtt

SEQ ID NO: 76669 - DNA, 201 bp, Homo sapiens
aaatcctttgtgagggttatagctggggctttggattaattaagaaagccctctgattagagtagagaggggtgaccagtcctgctggtgatgggttgtcyttgcttcggcctcttgtagcactcaaccagcctttgcctcccgttctccagttcaggccaggcttccttccctttgctaatttcccaaagcactgcacat

SEQ ID NO: 76670 - DNA, 201 bp, Homo sapiens
attggacctgacctcctggtgttgttgttgttgttgttttggcagtcctgtatttgctgtgtaaccttgagaaactttctttccatctctgggccttgttsccccacatactgaacagaagtaatcatgctggtcccctccctgcctcagagggaatgagaggatgaatgagatcatgtctgtaagcatgttgaattcctt

SEQ ID NO: 76671 - DNA, 201 bp, Homo sapiens
gtggaaatgcacagatgttgggtatttgtgcagcactccaagttcttggaaacagggcctcatgcagaggacaccttgcacgctgctagcatctggcctasagccaaatcatccataacgtgcaagagggactgggtgtccccaagcctccatcaggaccccacctgaccagcccagactgatggatgccaactctatcca

SEQ ID NO: 76672 - DNA, 201 bp, Homo sapiens
gcacagatgttgggtatttgtgcagcactccaagttcttggaaacagggcctcatgcagaggacaccttgcacgctgctagcatctggcctagagccaaakcatccataacgtgcaagagggactgggtgtccccaagcctccatcaggaccccacctgaccagcccagactgatggatgccaactctatccatagagttt

SEQ ID NO: 76673 - DNA, 201 bp, Homo sapiens
tgtccccaagcctccatcaggaccccacctgaccagcccagactgatggatgccaactctatccatagagtttcttaagcaaggaaattgcacatgcttcrttggaagtatatccagggtttcaagaatcctccctttagggaagtcttctcagtgtggagttgcactcactttcacttcgttttgtcctgtatgcagtgg

SEQ ID NO: 76674 - DNA, 201 bp, Homo sapiens; identical to SEQ ID NO: 30577

SEQ ID NO: 76675 - DNA, 201 bp, Homo sapiens; identical to SEQ ID NO: 30582

SEQ ID NO: 76676 - DNA, 201 bp, Homo sapiens
agccaagaccacttgtcctcccactgcccccagagaagggcagctccccacagagtgtccgaggtccatgcactgacttcttgtactcatctgtttccccyactgcatgatcgacttctccatggcagagaccttctcctgctcattagtagattgcctgtgtcaagcccatggcagggactcaatgaatatttttgaatt

SEQ ID NO: 76677 - DNA, 201 bp, Homo sapiens
tggaggactgacatttctagatggacagccgctcactttcagccaagaccacttgtcctcccactgcccccagagaagggcagctccccacagagtgtccraggtccatgcactgacttcttgtactcatctgtttcccccactgcatgatcgacttctccatggcagagaccttctcctgctcattagtagattgcctgt

SEQ ID NO: 76678 - DNA, 201 bp, Homo sapiens; identical to SEQ ID NO: 30589

SEQ ID NO: 76679 - DNA, 201 bp, Homo sapiens
ttaggataagaagactctcacatgcaaaacagcgaggaaaaaataaaagaaaaatatgtaatgaagatctacagtgtgtggtataagctataaaagtttcrgaattcagagagggaggagaccccacctggtaggtatgttgcaacagttggagaagtcctcctggaaggggtgggactgacgtcccctcggagaatgggt

SEQ ID NO: 76680 - DNA, 201 bp, Homo sapiens
tgaatgcacactaaattttcacaattaatcagattagcaaccaatcaggtttcacattttaggtatagaatcctggatggatctagaagggttctccagargtcatttgattcaactctttttgcccttgggcagtaataatcagaaatgttggctgggttgggctttccttccttttcaatacttccaggaaggagtgac

SEQ ID NO: 76681 - DNA, 201 bp, Homo sapiens
atatgtatttgtctttggaaagatacgaaattactgttaaccacagcaatgccttttaacaaaaaattttcccatcagaaaatgtttctctttggctgatrtaatgaagtcagggtccactccacctggtagaataggtgggaactaggaggcagggagagcccagccaggatggaattgcatctccatggataactccca

SEQ ID NO: 76682 - DNA, 201 bp, Homo sapiens
tgatggatgccaactctatccatagagtttcttaagcaaggaaattgcacatgcttcattggaagtatatccagggtttcaagaatcctccctttagggargtcttctcagtgtggagttgcactcactttcacttcgttttgtcctgtatgcagtggggtgaaagaactgcagggcgttcattcgtatttacttactttt

SEQ ID NO: 76683 - DNA, 201 bp, Homo sapiens
tagaggaaaaacagcagctcaccaaaacaggtcatgtgcttgagtctcccaggctaataagcagtagagccagaatttgcacccaggacccctgactccarcacctgtgctgtgaaccactgttttagcaccagcttctctctgggatctctatagggaagatgaaaacaagtaaacaatgtgggctgcattctcaaggga

SEQ ID NO: 76684 - DNA, 201 bp, Homo sapiens
gacccaggctgtgaaaaaccagagagcagctggcatttctggtggggctgcttgctgacagatcttggtgccacatggcgagcagaggagccccagggctyggtggaggtgtgggagggacacctggcatgaagggtcccagggcatatacttggcctgcctatgccttgcctgtgactgcagtggtggtagggagggaag

SEQ ID NO: 76685 - DNA, 201 bp, Homo sapiens
acagtcacccctgcactccctcctgtccctgcacacatctgccatggtgaattatagatgttgggacactgtgctacccaggaaggacccaaatggagtaractcaagagagagatgaaagtaggaggggagacaagacagcttggaggctgagccttggaagagccaggctacctggtcagcccagtgtgctcactgctc

SEQ ID NO: 76686 - DNA, 201 bp, Homo sapiens
acatctgccatggtgaattatagatgttgggacactgtgctacccaggaaggacccaaatggagtaaactcaagagagagatgaaagtaggaggggagacwagacagcttggaggctgagccttggaagagccaggctacctggtcagcccagtgtgctcactgctccatccttcaagccctgccctgcctcctccaggaa

SEQ ID NO: 76687 - DNA, 201 bp, Homo sapiens
atctgtttgactttttggtgactctgtagtctaccacggtttcagcaccaggtttcctctaagatttctttaaaaaattaaaataagtaaacggtatggcsactctgttttctgaactgaaaattaggacatggacatgtgatgtggcatgagactggatgtgaaagttgatgctgttcagaaaaatacggtgtatgtggc

SEQ ID NO: 76688 - DNA, 201 bp, Homo sapiens
ggattggcatctacttcagagtgcacagggtacacagagtgcacagtatacagtctctactgggtcaagggtgtggcagagaagaggcaggcttggggttktggtgacatcatcacagtccccagtactcaaggggtccacggtccccagtactcatggtcaccaccactcctctgtgctttctcttgagtgtggaaaaga

SEQ ID NO: 76689 - DNA, 201 bp, Homo sapiens
ttttttccatgattttccccaattatcccttccacccgtctgttttccagcagaatctgttcttatcctctggacccatgaaaggaacttccaagagaccrtctgctttcttgggagcctagtgaaagggaaatatagatttgtgggtcaaatagggtaatgagagaaaagtagggccttcaaggaaaagatgtaagagct

SEQ ID NO: 76690 - DNA, 201 bp, Homo sapiens
cttattgttccctgggatcgtttctttcatcattgcatgaccctgaatttatagagtcccagttggaagggacaatttaggggctttcagtaatgtttctwcatatttctggcaggtgctcatttagtgtctgtttgaatacttctagggatgtcgaattcactactttataatgcagcttgttcccccttttgatcaggg

SEQ ID NO: 76691 - DNA, 201 bp, Homo sapiens
gtgctcatttagtgtctgtttgaatacttctagggatgtcgaattcactactttataatgcagcttgttcccccttttgatcagggagcccacaatttccrtgtctcctaaggcagctctctgagcccacacagaggaggcagagccagctccacacggccgttcttcagatgtttgaaggcagccgttctgccttgcttg

SEQ ID NO: 76692 - DNA, 201 bp, Homo sapiens
tcagatgaaggcactactgtgtcaccattggctcctgggtcctggctccaggtggggagaagcagtttctctttctggggcaacaaataaaatccctccgrgcacaggagtgctcattgctggttggttatgccagtctgtctctatttttagaaagagctacaagagggaggaaaagaatctagagaaataagtacagat

SEQ ID NO: 76693 - DNA, 201 bp, Homo sapiens
cttgagagaaatcatcacttgtttctgtcctagtattgtgtttggtacacacgctgatggcatcttactgaattatggtagtattgcttacacatatgttyttcaacagacccagtcaaggagtgactctgaagagcagtaggtagggaccatggcttattcatcttcacagcctccagagtctagcacatttcctggcat

SEQ ID NO: 76694 - DNA, 201 bp, Homo sapiens
tcatctgtttatctaaaacccacaagcttttgttcctctagtcatccaaaaaataatcgctattataatcctgcctcaggaattcaattatctcccttacrgccttcccccagcttcttaaatgcaaccacagttttgaggcccttgggctattactgtgggtgatgagatgaatttcttctgtcattcattcacacagtc

SEQ ID NO: 76695 - DNA, 201 bp, Homo sapiens
aattgtggtaggacattctgatagatgcaggaggaagataagggggacggtccccggagaatcttccaccagcctgcactgggaggagggggtagagactsgggaagtttgagcagtttgcagaggggaggagcctagcctctccagtgcctgggtggtgacctgggattcaatctgtgagatgggggtctgttaacagga

SEQ ID NO: 76696 - DNA, 201 bp, Homo sapiens
ccaggtccccgggccccaggtctgcagggcggttccaacagagatcctggccagccctgcggtggagagagcacccgcagcagctctgtgagtactgggcrggggtggggtggggggataggccagccctgttgcaggccaccaaggagcctctggtctgggggatcctccagttgggagcacatgtgtgcgtgaaagaga

SEQ ID NO: 76697 - DNA, 201 bp, Homo sapiens
ttagaaagagctacaagagggaggaaaagaatctagagaaataagtacagatggattcctccctgaggcagaagctggggtctgtgggatgaagcacagayacaaagccattgtcctgccacccagcagtggagtcggagatggatggcatgaatctagaataccatgggaatgggtccttgccctgggccagtaaacatt

SEQ ID NO: 76698 - DNA, 201 bp, Homo sapiens
gggagctggtgtgctagagcagaggtgtatggcgggaccccagggagccagcaggagagagggggtggagactggcggggcagaatgcagggtcccagccsgagagccatgggagccccataagtttgtgctcttgagggtgtcctggccagatggatgtttgtaaggacccctggctgccttgtggggaacagggacagg

SEQ ID NO: 76699 - DNA, 201 bp, Homo sapiens
agaaataatggtgatggtgtttcagaaatggtgattgagaaagcatactttaggtagtgaattgccttttaaaggaattaatagcaaaaatatctcttacytgtcattgttttcaccatttccggtactctctatttcattgtgtagatccaaatttctactgagattatattccttttgcccaaagatctttctttaaca

SEQ ID NO: 76700 - DNA, 201 bp, Homo sapiens
tctagagaaataagtacagatggattcctccctgaggcagaagctggggtctgtgggatgaagcacagacacaaagccattgtcctgccacccagcagtgsagtcggagatggatggcatgaatctagaataccatgggaatgggtccttgccctgggccagtaaacatttgagactcagagccaggagataggatgagaa

SEQ ID NO: 76701 - DNA, 201 bp, Homo sapiens
agcagctttttgaagcaagaatggattgctttggattttctgggtccctaaggaccaaaatagtaggtggcccacaactagatgaagagtgtgtagggaarcatggtccaggcagcgggaagaatgcatgtaggatgctgggctggggagctggtgtgctagagcagaggtgtatggcgggaccccagggagccagcagga

SEQ ID NO: 76702 - DNA, 201 bp, Homo sapiens
ctctgatcctaccccttcttcatctgcctctgtagagtgacctaaggtacctgcagtcctgcgagtggtgaggttggctccaatgagaagggacagaggtstcacctgaggccactgatatgaaacagccaagactgtaccgaaaggattaaaaaatgtgtggtcatccctgatgagtaaacccacttgtactaataatgg

SEQ ID NO: 76703 - DNA, 201 bp, Homo sapiens
ctggaagcagtggctttgggaggttggggatggaggtggcccctcatttcagggcccttcatacttcagccaccaggagttaggaatgagacagtaatgaygccaagagggaaactcagaggaaaagcccaactgcccagaagtccagttccctcaggacacctcctcctcctgctgctggtctctcttggaggctctgga

SEQ ID NO: 76704 - DNA, 201 bp, Homo sapiens
gcctgtctggttttgctggaagcagtggctttgggaggttggggatggaggtggcccctcatttcagggcccttcatacttcagccaccaggagttaggartgagacagtaatgatgccaagagggaaactcagaggaaaagcccaactgcccagaagtccagttccctcaggacacctcctcctcctgctgctggtctct

SEQ ID NO: 76705 - DNA, 201 bp, Homo sapiens
taaaattttgtgaattttataaagggtacgtgtatcagaaaaacagttaggaatctgtccatccatttattcacctacccacctgtccatccacccacccrcccatccatttatccatccttctcctggcacctcatttatcctcactacagccagggccatctttctaatgtaatctaattatgttgttctcttgcttaa

SEQ ID NO: 76706 - DNA, 201 bp, Homo sapiens
gagagatgagaataagaatgatatctttaatcttggttacacccaggaggaagagatgggagatgtttatgggtggtggagaatgatgagggacacggagrgagcccattgaatatacccaggatgtcaatggaagagcaaacagagcaaatctgttgcaaaacaggttataattaatgagccaacagaccagttttgacc

SEQ ID NO: 76707 - DNA, 201 bp, Homo sapiens
agccattctgacgggcatgtgatggtatctcattgtggtttttgatttgcatttttataatgatcagtgatattgagcttttttcatatatttgttggctkcatgtatgtcttcttttgagaagtgtctgtttatgtcctctgcccactttttaatggggttgtttgttttcttcttgtaaatttgcttaagttccttgta

SEQ ID NO: 76708 - DNA, 201 bp, Homo sapiens
acctcagtcccagtccattttgggtaggagaaacctattcctactttggagagatgagaataagaatgatatctttaatcttggttacacccaggaggaakagatgggagatgtttatgggtggtggagaatgatgagggacacggagggagcccattgaatatacccaggatgtcaatggaagagcaaacagagcaaatc

SEQ ID NO: 76709 - DNA, 201 bp, Homo sapiens
aagtcaaggattttctttcatcatttcattaatcaatactctttagatatgtttacttcaccaattgcaagcccttctaattccacgtagcacagaagacrgcattcagtccccctcagaaatgcgttccagtaaatcccttggaaaattttgaactcagtccccagtctttgcctttatatatctttttacataaaaact

SEQ ID NO: 76710 - DNA, 201 bp, Homo sapiens
ctttcatcatttcattaatcaatactctttagatatgtttacttcaccaattgcaagcccttctaattccacgtagcacagaagacagcattcagtccccstcagaaatgcgttccagtaaatcccttggaaaattttgaactcagtccccagtctttgcctttatatatctttttacataaaaactgtggccccaaatgt

SEQ ID NO: 76711 - DNA, 201 bp, Homo sapiens
agatatagccatcaagcgtatgcagcccatgttccaaactaagtctttctcaatcagcgtcaggacatctttaaggccaccccaggaacctacatgtaaamatctgccagcatcaattatctagcgaccactacctctgaatcaggactgaaaagtagtgcttctcacaaagaagcgagcttggtccacatcagacctgag

SEQ ID NO: 76712 - DNA, 201 bp, Homo sapiens
gatggaggtgggtgggattctcatgctcctctccactctgctcctcagagtggagaacagcatagagaagtttcccaactcatcagaggcacttacccagrggtctcagcggaatcagaacatctgttgctcccctttctgcaagtttgtttcttcctaagatgggagaagaatagggatagagaggggatttgggtgctg

SEQ ID NO: 76713 - DNA, 201 bp, Homo sapiens
acatggatggtaacaccactttacctttttgggtctctagattttagggacagaataatttcttgcttatattctgaaatagtaagtggcttgacactgtkgcctttggggacataatggtttgcatttcctgtttgtgacagcaatttatgcttcatgctaccttctccttccccatgggtgccaaaggcctccccagca

SEQ ID NO: 76714 - DNA, 201 bp, Homo sapiens
agaatcaacagtctccttgtttcggaaggcaggcttactcttcgtcttcttacacaactcacttgattatcttcttaattcacagctctggttttgtcacygttcacactgttcagtgtcttccactgccttgtgtagcagatctccatgcactcatctcagtttgccccaactgagtttcatggagatctgctgcacaag

SEQ ID NO: 76715 - DNA, 201 bp, Homo sapiens
gtagctgggattacaggtgtgcaccaccacgcctggttaatttttgtacttttagtagagacagggtttcaccgtgttggccaggctggtcttgaaatccygacctcaagtgatctgcctggctcggcctcccaaagtgctgggattataggaatgagccaccgggcccagcctgtttccttctttttgattgtatgtcat

SEQ ID NO: 76716 - DNA, 201 bp, Homo sapiens
cttcctagggccaggtaagccttactcaagtttcctgagaacgagttataccttattgtcctgattatttttatcatgattattggttttgaagttatcarctgaaagggggcaggtgtctcagggaagccactctcgtcttgcagaaaacactctcagcaccatggctatgtgaggacagtccccgtcacatgagggaca

SEQ ID NO: 76717 - DNA, 201 bp, Homo sapiens
tgaccatggagtcacactgacctaggctcaaattccatcttctcagttacattcattcatccatccatctattcattcattcagcttgtattgatggaggstcaggaactgttgtaggtttggggaacacaacaggcaacccccctattctatggagctttcattccagtaaggctgcagagtgaccttgggcaactcgac

SEQ ID NO: 76718 - DNA, 201 bp, Homo sapiens
taacattctgtggaaacctcaggcttctgtcgctttgagccttggttttccatgggtaaagtgagaccatggagacccaccttacataattgttgagaggwttgtttaaaatacatattttggccaggtgtggtggctcacaccggtaatcccagcgctctgggaggctgaagcaggaggatcacttgagaccaggagttc

SEQ ID NO: 76719 - DNA, 201 bp, Homo sapiens
tatgtgctgtcttttcatcttttttcactacatgtgtctcatcagtccttttattccaataaacatagattcattcaaaagtgtgtactgaggccgggcgyggtaatccctcaggccgggcgcctgtaatcccagcactttgggaggccgaggcgggtggatcacgaggtcaagagatcgagaccatcctggctaacacag

SEQ ID NO: 76720 - DNA, 201 bp, Homo sapiens
agcaccaattctgtttgtcaatgtggtgggttagggagtagggagaggcaaagcatgtgattgccccccaaggctgcagataaaacagaaagaactttttyccaaagtttcttggtcccagactcgactcagggggactgttttggcttccttttaccacatggccccagatcttccttttctttctttcttttttttttt

SEQ ID NO: 76721 - DNA, 201 bp, Homo sapiens
gaacccttccagattagagcctcttgagaaacaccttggattttccacagcataccctggcaacaacagcaaactcctacataagctcaaagtgatcagcycatagttgaacttcctgctagaaagttaaaaaaaaaaattccaaccccctcgataggaagataatgttttatcattcacaatgtccagtataccataaaa

SEQ ID NO: 76722 - DNA, 201 bp, Homo sapiens
tgattaatcttggcccactaccttagctagatagggtcattgttctagcacatacccagaccaccaagcatgagtttgtgtgtatgcacatgcatgcgtgygcacatatgtgcataagtatatgtaagcactcatgtatgaattttcctgaatcttttccaaagacagaaaatttagaagctcttccaccatgcttccata

SEQ ID NO: 76723 - DNA, 201 bp, Homo sapiens
gagtgactgttcatgtcaaatctccatatttctaagccttgctcaacagagcctttcccaaatttccaccaacctaacagatttaacccacctcacacttmtgcataccacaggtggggagagatactcaaaggcagggatggaggatggatctaactcatctttgatccttactgcagcctgacacacggtaggtgctca

SEQ ID NO: 76724 - DNA, 201 bp, Homo sapiens
atttctccacaaactcaccagcagttgttattattcatctttttattatagccatcctcatggacgtgaagtagtgtgttactgtggttttgcctgaaccyaggagcaagacaagcctgtcactggagaaggaaaagctcctctgcctgcaaatccccaagcatgcttaggcttcctggtcttagaagtgtgtgcctcaat

SEQ ID NO: 76725 - DNA, 201 bp, Homo sapiens
ttgattgtcagactattttccaaagtggctgtaccattttacattcccaccagcaatttatgagggttctgatttctccacaaactcaccagcagttgttrttattcatctttttattatagccatcctcatggacgtgaagtagtgtgttactgtggttttgcctgaacctaggagcaagacaagcctgtcactggagaa

SEQ ID NO: 76726 - DNA, 201 bp, Homo sapiens
ataccataaaatgtaccctttaaaggtgtccagttcagtggctgttggtatattcacagagttgttcaaccatcaccgcaatctagtttaaagcatttgcrtcatcctaaagagaaacttcacactcaatggcagttgctcatttttcctccctccccctagcccttggcaaccgcgaatccactttctgtctccatggat

SEQ ID NO: 76727 - DNA, 201 bp, Homo sapiens
tgaaaaccatgaaatttatatcataactaattaataggttaaacctgttatcctaaaagtagtgacttagtcatagggaacagtcaatggctagtagtctrtttggagcagtgacactgagtctctttttccttctctgtgtaagaaagggatacgcggcactccatcaggaagttcttaggaagaattcttaatcgcatt

SEQ ID NO: 76728 - DNA, 201 bp, Homo sapiens
catcttctcagttacattcattcatccatccatctattcattcattcagcttgtattgatggagggtcaggaactgttgtaggtttggggaacacaacagrcaacccccctattctatggagctttcattccagtaaggctgcagagtgaccttgggcaactcgactgcccatcccttagctttcaagctgcagtactgcc

SEQ ID NO: 76729 - DNA, 201 bp, Homo sapiens; identical to SEQ ID NO: 30692

SEQ ID NO: 76730 - DNA, 201 bp, Homo sapiens
accaagcactgggataaagctttagtacagttaggccattttattcacttaaagagcaaagggctcaaagtttacctttccgtgatctatgagaaaaaagstttaccaagcaaatgagtgctatatgcaagattgccaaggggagattttaaaccacttacaaggacaaactgcttcccagaggcctgccaatgcttctta

SEQ ID NO: 76731 - DNA, 201 bp, Homo sapiens
tgcttccatgttcacaatgacatccataagcttattcaagaaattaataatcatggttacctatggggagtggagaggtaggagtgagacctgggcagatdgagacatagatgggaggaagattcctccccatggatatattgggttttgttgaaccgtaggaatacattacctatttaaaaatttaattcgtgggaaggg

SEQ ID NO: 76732 - DNA, 201 bp, Homo sapiens
atatatttataaatataaatataaatatatttgttttatatatattttataaaacataaaatatgttttatacatataaaaatttgtatataaatttatayctatatgaaatatagatatattttataaaatgtatatatatttatgtataaatatatgcatttatatatttatgtataaatatatgcatttatatattta

SEQ ID NO: 76733 - DNA, 201 bp, Homo sapiens
ttgcaatgagctttttgtctcggcagagtttgctaatacactttaaaatatttattgtgaatgggttggaggaggttgctgtgggaagccctgtgtgttawgtatacctttgcatgcttcagcaatgcctgcccagtgctttggggactcagcagatgtccacagatgatgatagtgactttgaggaacccccatatttct

SEQ ID NO: 76734 - DNA, 201 bp, Homo sapiens
gccagaattgacaaaggggatctaattaaactaaagagcttctgcacagcaaaataaactatcatcagagtgaacaggcaacctacagaatgggagaaaakttttgaaacctatccatctgacaaagggctaatatccagaatctaccaagaacttaaacaaatttgcaagaaaaaaacaaacaaccccatcaaaaagtgg

SEQ ID NO: 76735 - DNA, 201 bp, Homo sapiens
gcagatgccagccatgcatcacaatctagggaggtgggaagtgtgaagttgcatggaggcagggaacctgggctctagacacgactctgcctctaacattytgtggaaacctcaggcttctgtcgctttgagccttggttttccatgggtaaagtgagaccatggagacccaccttacataattgttgagaggattgttta

SEQ ID NO: 76736 - DNA, 201 bp, Homo sapiens
gtacaatatttctcactgccttatggatgagatgacctagtctcaggtcaagtgacttgcctaagatcatgcagccacataggaatatggtgctatcctaraaccatggtttccaaatcccacacgtgtgctcttggcagtatgctctgctgcctctgtgttgatttttccttttgaatatcttcttagagaggaacagga

SEQ ID NO: 76737 - DNA, 201 bp, Homo sapiens
tagagaggaacaggagacttgtaaagttttatgtgggctcacagtttaaagagaacctgtttatggggttgtaataaccatgtattcatggacacaactgyttatgtctgtgaaggatcagcaattcatcagacacttagtgagttactttcttctctgattgtcagagtgaaaggtgagtaagatcacttctctcaggga

SEQ ID NO: 76738 - DNA, 201 bp, Homo sapiens
cctagaaccatggtttccaaatcccacacgtgtgctcttggcagtatgctctgctgcctctgtgttgatttttccttttgaatatcttcttagagaggaayaggagacttgtaaagttttatgtgggctcacagtttaaagagaacctgtttatggggttgtaataaccatgtattcatggacacaactgcttatgtctgt

SEQ ID NO: 76739 - DNA, 201 bp, Homo sapiens
tcacttctctcagggagctcacagtcatatgcactgagtcacatgacatagagtggagagtgatgagcgtaatggcaacagcatgaaccaagtactgaggktgcatggaggaaggttgtttaactcctagcttctgtcttcattaagaattaccaatacttccagccatttatgacaaacccacagccaatatcatcctga

SEQ ID NO: 76740 - DNA, 201 bp, Homo sapiens
atcttcgagaaatctggcaaaaacaagcaatggggaaaggattccctatttaataaatggtgctgggagatctggctagccgtatgcagaaaattgaaacyggacccctttcttacaccttataccaaaagtaattcaagatggatcaaatagttaaatgtaaaacccaaaactataaaaccatagaagaaaatctaggca

SEQ ID NO: 76741 - DNA, 201 bp, Homo sapiens
gctgggagatctggctagccgtatgcagaaaattgaaactggacccctttcttacaccttataccaaaagtaattcaagatggatcaaatagttaaatgtmaaacccaaaactataaaaccatagaagaaaatctaggcaataccgttcaggacataggcacgggcaaagatttcatgacaaaattgctaacagcaatttc

SEQ ID NO: 76742 - DNA, 201 bp, Homo sapiens
aggcgcccaccaccgtgccctgctaattttttgtatttttagtagaggcggggtttcaccgtgttagccaggatggtcttgatctcctgacctcgtgatcygcccgcctcggcttcccaaagtgctggaattacaggcgtgagccactgcgcccggcctcatcattttcttgattgtactctatgctgcaagcattttgaa

SEQ ID NO: 76743 - DNA, 201 bp, Homo sapiens; identical to SEQ ID NO: 30719

SEQ ID NO: 76744 - DNA, 201 bp, Homo sapiens; identical to SEQ ID NO: 30723

SEQ ID NO: 76745 - DNA, 201 bp, Homo sapiens; identical to SEQ ID NO: 30724

SEQ ID NO: 76746 - DNA, 201 bp, Homo sapiens; identical to SEQ ID NO: 5852

SEQ ID NO: 76747 - DNA, 201 bp, Homo sapiens; identical to SEQ ID NO: 30727

SEQ ID NO: 76748 - DNA, 201 bp, Homo sapiens
aggcccgggggaccagcatggggactgctgctccaaatggctttgagttgtcacgtaggggtggtgcatgggaactgtgtctgtgtgcttgtatgtgtgtrtatgtgtgtgtgtgtgtgtgtgtgtacaagaggactggaagggctcccttgtcctgttgccattggatactgccttcaagatttgctcttcatggtaact

SEQ ID NO: 76749 - DNA, 201 bp, Homo sapiens
attttgaactcagtccccagtctttgcctttatatatctttttacataaaaactgtggccccaaatgtgtccatctttcctctggcaaagagaaggccgaraatttggcttcctaacccagagcctggagatacccctgccacccagttggcgccctgaggatctcggctcaagtgtgggcaggcttggagccagtgtcca

SEQ ID NO: 76750 - DNA, 201 bp, Homo sapiens
agcagcctgtagtgagtcatgaaacagcgtgctgacaaccagagagactggactgcaggatggaaagagccaggggccacactgcagcctcccacctccastgcttgagtgtgaggaaggggtcaatgattaacacaataactctgggatctggccaccttttggctcagcacatcctccttcaaggagtttatcacctgc

SEQ ID NO: 76751 - DNA, 201 bp, Homo sapiens
ggaaagagccaggggccacactgcagcctcccacctccagtgcttgagtgtgaggaaggggtcaatgattaacacaataactctgggatctggccaccttytggctcagcacatcctccttcaaggagtttatcacctgccccctagaccatggcttagtcaaattaaatagcttttattttttggagtataaaaataata

SEQ ID NO: 76752 - DNA, 201 bp, Homo sapiens
ccttactatctggcagtgacaatcccagagaaatgggaagtgaaaatgtctacattgttggagaggggtgatgtcatgtccaggttttcccagttacacgrtagtagtccctacttagtcctggaggctggtgtttctgccgctccccacccccaccctgcagcagaagaggggcctcacacagagtgtttttcccatcta

SEQ ID NO: 76753 - DNA, 201 bp, Homo sapiens
cctccagtgcttgagtgtgaggaaggggtcaatgattaacacaataactctgggatctggccaccttttggctcagcacatcctccttcaaggagtttatyacctgccccctagaccatggcttagtcaaattaaatagcttttattttttggagtataaaaataatatgtgctaagtgtggaaaacctaagaagggaagt

SEQ ID NO: 76754 - DNA, 201 bp, Homo sapiens
ctcactgcagctcggcacaacattttggttaaatgtaagaaataactacctaagggccgttagtaggtccttatcattaacttgggctgatatacgtgtgyttggagataggatttggacaccatgacctctgaaaagcctgttcagtcaagaagtctgtttctgcagttttgtttgcttcagaagtacatttttaggcta

SEQ ID NO: 76755 - DNA, 201 bp, Homo sapiens
ttggggaactggtcagtaaattaaagtgtcttacgtatatgagacctgcaatttttattctctgggcctctgtatgaattagttttgcattgccatacagraatatctgagaccgggtaatttataaagaaaagagattcatgtggcttatggttctgcaggctgtacaagcatggcaccagcatctgcttggccgctggg

SEQ ID NO: 76756 - DNA, 201 bp, Homo sapiens
gaggtcccagtctctttaaccagctctcacatgaactaatagagtgagaacttgctgatcaccatgagaatggcaccaagacattcctgagggatctgccyctatgacttatacacctcccaccaggctctacctccaacattagggatcaatttttttttttttttttgagacagagtctcgctctgtcgcccaggctgg

SEQ ID NO: 76757 - DNA, 201 bp, Homo sapiens
acggggtttcaccgtgttagccaggatggtctcgatctcctgacctcgtgatcccgcctcggcctcccaaagtgctgggattacaggtgtgagccaccgcrcccggcccagggatcaatttcaaaatgagatttggaggagacaaacattcatactctatcagcctcagtttattttttttctttaaacagaattgataag

SEQ ID NO: 76758 - DNA, 201 bp, Homo sapiens
cactttcattttgtattttttctatttcccaccactgtcctggatccctgggccatctcccagcgcctatccgtttcctcttgcagtttcatctatgaccmcaagaccttctggcctaagatgctctgtccttacagaacagctgatgaggagaaggtaaggagaggagagcaggagtgaggctaatggacacactcattt

SEQ ID NO: 76759 - DNA, 201 bp, Homo sapiens
ggctgtgctgatgaactgacatttaactaagacttagtaggagctggcaaggcagaagagaggacttgagaggacctagcatatgctgcatgtcttaccamgtgctgggccctgtttgaagcagttttaatctttataacatggggcttatgaggtaggtgcctttattatccctatcttgcagataaggaaattgattaa

SEQ ID NO: 76760 - DNA, 201 bp, Homo sapiens
tataaatattaacaattaccttggtactaaatctatgccttactcaaggcaggtactcattaaatgtttaatactttgaaagcaaactcatttaaacacasatatttcctaagaaaaacataaagaacgggatgctggatgatcacatagaagcgtggcgcagttttagagtatagactttggattaggttgacatgagtt

SEQ ID NO: 76761 - DNA, 201 bp, Homo sapiens
ctaaggttttgctatggaagccggcttggcgtgttctaagaacaggaaggaagccagtgtggctgagatggagtatacaaaagattgcatggcaagagatraagttggagaggagtcaaagcccggatcatggtaagcattggaggccacagcacagggtttagatgtattcaaagttcatagtcatttggcttaagatgt

SEQ ID NO: 76762 - DNA, 201 bp, Homo sapiens
ccgggctccaggctgggggagggggcccgcccctccccgggacccgccagacagaaccccgccttccctgcgattccccgacgtgggcggcagacactgtkccctactccacagacccagggcttcctcccagccctcccgaggctatgtggtctggggtgggctcctctgttttccttacttcctgtgactgccgtccat

SEQ ID NO: 76763 - DNA, 201 bp, Homo sapiens
agctctgctgtcgtccccttttaggtgcacgagatcctgaagcgcacagcctgctcccgagccaacaacacgatgggtaaggaccccagcccgcgggcagrgtgctgacgggcgctgaggcggctcccgccccgtgctttcaacagctcccttggtcggcagcaaagaacaaaacaagcaaatgccccccacggagaggct

SEQ ID NO: 76764 - DNA, 201 bp, Homo sapiens; identical to SEQ ID NO: 30767

SEQ ID NO: 76765 - DNA, 201 bp, Homo sapiens
tgggaccaagtataaggcaggcagtataaggcaggcagtccagatcctgatggattgtgtggaagacatctgtgatggcccaggtacaatgtgagctgtgyccataaccccatgagactgctttttcgaaaaatgtgccaaaaagtcacgcacaaacaccttttgcacaggagtcattcttgcatgttgaacccttgttcc

SEQ ID NO: 76766 - DNA, 201 bp, Homo sapiens; identical to SEQ ID NO: 30769

SEQ ID NO: 76767 - DNA, 201 bp, Homo sapiens
agaggttgagtagtgtccacagaataggtcatcctgtccactccactgctgaggtcacccgctggtgaacactcacatgggatacaaatatcttcacagtytttgaccactcagagaggtccatctacatacctcttccccagatttctttgtcaccaattttccaatcatgcttcttccaagtccctgaccatccaacca

SEQ ID NO: 76768 - DNA, 201 bp, Homo sapiens
gacgttttgggtcccctggaatcaacgtcatctcagagccaatgaccagtagtccccaaaaatctgatcatatccctttccccaatgcacagttaccccawtgcacagttaccctgataaaaggctggaggtctccttggggaaggatgggagaaagattaacagcataaattgtcagtagtatagtggggtccttcctca

SEQ ID NO: 76769 - DNA, 201 bp, Homo sapiens
caatgcacagttaccccaatgcacagttaccctgataaaaggctggaggtctccttggggaaggatgggagaaagattaacagcataaattgtcagtagtrtagtggggtccttcctcaaggggacccaacctccccttcaatcaaggggttctgggtctgtaaactggctcaagtccggaaattgattgatgggccatga

SEQ ID NO: 76770 - DNA, 201 bp, Homo sapiens
tggggaatgagtcagctgtgcagggcctgaactaagccatcagaagtacgaatggacaggagaggaagatcaggaggtttaagaagtagaccccatgacamctggggctgatcaaatgtgagtgtgtgggaggaaataacccaagggaatgcctctgtttcaggtgttgcccgctcaaagggtcatggttcagttcacgtg

SEQ ID NO: 76771 - DNA, 201 bp, Homo sapiens
ctgccacttcaggatccagttattcccattgtatttaaattttatagttgagtgactgtggttcccactgttagatctgacatacagagaagagtgattayagggcccttcaaagatgcaggtgctgccctcacaaatctgttttacaaggcattggtcaagggtatatcttctggacttcccaactaggatgagtaggtc

SEQ ID NO: 76772 - DNA, 201 bp, Homo sapiens
acactcacacacacacgccactcccccccgccaccccccacacagttccttcctttgcagaagagatgagaaaacctctctttctttgtactgtagagcarttcctttggaggacaaagactgttgcaatgagctttttgtctcggcagagtttgctaatacactttaaaatatttattgtgaatgggttggaggaggttg

SEQ ID NO: 76773 - DNA, 201 bp, Homo sapiens
tcttacattaagctgtgcattttgttcactaagtaaagagttgccttgtgcgtgttctggaggccaactccagccacttctgtgcgttaatcatttgttaygatttgagctcattggaaaaaaatcccccagccagtggcacaggggggtggctctgtaccctgtggtacagagtaggaagcctggctggatcagctgagg

SEQ ID NO: 76774 - DNA, 201 bp, Homo sapiens
gagatagcaagtgcaaaggccccggggcaggtatattcctgatgtgttagaggagcagtcaggcgtccagtgtgacaggatgggaaagagcaaaagggagyggggaggggatgagatctgagaggcagctggagacagggtcatgtagggcctcatcagcctccgtcagaactttggattttagtctgagcgagatggaca

SEQ ID NO: 76775 - DNA, 201 bp, Homo sapiens
atatatatatatatatatgtatatatgtgtacacatacatgtatttgcccttgccaggttcctgacatgccccaagaccctggtcagagatttatatataratatatacatatatataaatatatacatatataaatataaatatatttataaatataaatataaatatatttgttttatatatattttataaaacataaa

SEQ ID NO: 76776 - DNA, 201 bp, Homo sapiens
aacaggccaggcagttgcaaagccagcgtacaatgcactttctctgaccctcggccacccttctttccacggcatcccgaatctcccccagaagggcaccrtgtcaacctagaaagagcttgaacccttaagcaaggtcaaagactcttcctcattcccaagccacagggctttgtgaaccttgtcgacctggcagcattt

SEQ ID NO: 76777 - DNA, 201 bp, Homo sapiens
agaataccagaagcttccaatgacaggattgttataaaaacagcattcttttatgcccacccatttaaaagctatgctattataaaaagtaaagaacgagytgctctcaccagggcgcatggtgggtatgtgacctgttgagctgtgaatgactggttggtgatgctgcagaagccacatgggcggggtggatgcagattc

SEQ ID NO: 76778 - DNA, 201 bp, Homo sapiens
tgaatgactggttggtgatgctgcagaagccacatgggcggggtggatgcagattctaatagatattatggcagccttcataatgcaggagtcgtgagggktcccatacatttctccattttgtcaagtagctaaggctttgaaatatttaattgcaattctacaaatgtattatatgctgaagagtccctcttccccacc

SEQ ID NO: 76779 - DNA, 201 bp, Homo sapiens
gtaggtctaaagtgactaatccactccaccatcccaatctccctaaccctttggatctcttcctctacgttaaaccaagggagatcaggcattttcagctygccacagtgggccatgttttaatccatatttcagctaaccaagcaaataaactattagaaccccttttaactccccaggctgcaacattaaatgcagagt

SEQ ID NO: 76780 - DNA, 201 bp, Homo sapiens
agtgtgtgggaggaaataacccaagggaatgcctctgtttcaggtgttgcccgctcaaagggtcatggttcagttcacgtggttgagttaggataaaaaakaaggtttaaggaacaagatgatccattctttttgtgacatttgagcttaggacattccactgaagatgctcactaggcagttggacaaatgagtttggag

SEQ ID NO: 76781 - DNA, 201 bp, Homo sapiens
taggtctaaagtgactaatccactccaccatcccaatctccctaaccctttggatctcttcctctacgttaaaccaagggagatcaggcattttcagctcrccacagtgggccatgttttaatccatatttcagctaaccaagcaaataaactattagaaccccttttaactccccaggctgcaacattaaatgcagagtc

SEQ ID NO: 76782 - DNA, 201 bp, Homo sapiens
gtcacttttagctaggaaaagagtatggggaagtgctggtattaaactcactgcaaccctgtgttccctctaacttcttaagaaagcaaactatagctgckctcccctcaccttccatccacttccttatcatctgcagtgttggttttactcccactattcccttgaaatttcctcacaaaggttgcagatgatcttaat

SEQ ID NO: 76783 - DNA, 201 bp, Homo sapiens
gggggaatatggtcaggggtgtagctcttgctgcctacagcaatatctttctgtacagaaatctttctaaagtctatcacacaatttcctgcttgcttatrtagaacatgtctacatatattctccacataaaggcgtcttatgtagaacatgtctacatatattctccacataaaggcgtatgacaaattttctggatta

SEQ ID NO: 76784 - DNA, 201 bp, Homo sapiens
aaatctttctaaagtctatcacacaatttcctgcttgcttatatagaacatgtctacatatattctccacataaaggcgtcttatgtagaacatgtctacwtatattctccacataaaggcgtatgacaaattttctggattattcaagatcatcattaagaacataatgattttcatgttctctcaagaattatcaaagc

SEQ ID NO: 76785 - DNA, 201 bp, Homo sapiens
gtccttgatgatgggtcggcaggtaagagttccaaataaaaaaagacgtggactctaatccttggaggctctctggatttccatatgtacaactaacacarttcagaggaagatgagctggaggatctggctggggggagctttgcagacatgtgtgaggtttctgattgggaagcggatgccagaaggcacagcaagtcg

SEQ ID NO: 76786 - DNA, 201 bp, Homo sapiens
attatcaaagcattattaggattgtttgccccacactgctctgatttcttgaattcttgactctggtaacctccctccccgagttttgctatctcagtttygctttgcagtgtgggagatggaaaaacaagctcattagaattttgggtaaagagagtgtaaaatgcatggcaggaggtctgaaggattctgctgtggaaa

SEQ ID NO: 76787 - DNA, 201 bp, Homo sapiens
accttaatccactatgacctcatctaaacaaattctatctgcaaaacctcttccataaataaggtcacattatgaggttctgcatggacatgaatttttcrgggtaagggcgctactcaacccacttcaataaccatttgctctttactttaaagtgggaattgatgaaagaatgtttatttactgtcttttttaaaaatt

SEQ ID NO: 76788 - DNA, 201 bp, Homo sapiens
agagtgtaaaatgcatggcaggaggtctgaaggattctgctgtggaaaagggacatcgcattagaaagtaggttttgtgagatctattttagctgctcatktatttttttcttgtttctgggttttctgttgtgagagctgagataaccagataagaggcctctgataaatgaggtgttactgtcaccaaagtaataagga

SEQ ID NO: 76789 - DNA, 201 bp, Homo sapiens
ctcaaatttcttggcttaaaacaatcaaaatccagaagtccaaaatgaaagtgccagcagggtgggttcctcctggaggctctgagggagaatcgtcacayggccgtctcctcgcttcctatggctactggcagtccttcactccaatctctgcctccatctttacattgccttcttctctctgtgtgtctctgtgtatcc

SEQ ID NO: 76790 - DNA, 201 bp, Homo sapiens
aaggtgggcatatgtatagagaaaccatttacaaagggattggcagggagttggggaatgccagggacggcgttgtaacctggaattaacaatagtagagytcttatcatccctagacctgcagaaagatagagaggtcactgcaacgtggaattgggtagaggaggtgaccttgagcaggtgactatttaggcagaaggc

SEQ ID NO: 76791 - DNA, 201 bp, Homo sapiens
acatttcccagactctgtgattcaaaggagccacatgatctgtacatatgagccaacgaggcccagggaggggactggctttcctgaaagttcacagagakcaggtaccaggggtgtggccaggacttggggttgcgtgatgtccgcaggcctcagagaggttgagaggagacaattgtagtgaaagggaagatggagaat

SEQ ID NO: 76792 - DNA, 201 bp, Homo sapiens; identical to SEQ ID NO: 30810

SEQ ID NO: 76793 - DNA, 201 bp, Homo sapiens
agtttcatcctgatccccccaccccaggtccatgcaaaaatggtcttccaagaaactagtccctggtgccaaaaaggttggggaccactgctttaaacaamcatcttatgagctagatacttttattattttgtagcaggggaaactgaggcagaggaaagttaaatagcttgcccaagatcacataattggtaatggttg

SEQ ID NO: 76794 - DNA, 201 bp, Homo sapiens
taacttgtttatttagacttttccttttatcttatcatgtcagaagttcaccaagaaactgaagggcttctgaaattggctttgtttcttgggcttgagtwcagtcccttcttatttacctgcctgcggcttcatctgctgattattgatgatttgaagaaaaaattgtttatgtggaatcagcttcacgtggctccttag

SEQ ID NO: 76795 - DNA, 201 bp, Homo sapiens
catccagagcagttggtgaggatggttggaagaagtttgtactcctatagcaattctttgcatgtgattatgggcgacggtggtcaggtgtggttgcatgyaattggcatcagaatcacctggtgtgcttgctaaaaccctggctgtccaggtcccatgccacatttgctgaatcagaatctgcaggggcaaggtccgaag

SEQ ID NO: 76796 - DNA, 201 bp, Homo sapiens
gtgcttcacacaggtcttgtatcgagagagagagcttacttagcacgtgcttatgactataccgttccctaagattatttttcctcttctgatctgtatcygagctataataacttgtttatttagacttttccttttatcttatcatgtcagaagttcaccaagaaactgaagggcttctgaaattggctttgtttcttg

SEQ ID NO: 76797 - DNA, 201 bp, Homo sapiens
accctggctgtccaggtcccatgccacatttgctgaatcagaatctgcaggggcaaggtccgaagatctgcatatttaataatctacccagtgattcttasgaactctagagtgaacaaaagaaaaagataaaaataaagatagggtgcactgttgtagtcttcatgacctacttacacttgggaatatgaagtgtattgc

SEQ ID NO: 76798 - DNA, 201 bp, Homo sapiens
gtctcttctatgaagtcttctttgaccccttaggtttcctcttccccacttgtattgcaccctgcaaatattgtaataatttgttttcatgtctgtttccstcctagatattgagcttcttgacaatgagaatagtgtcttttgtcctggtaaccctagtgcttcacacaggtcttgtatcgagagagagagcttacttag

SEQ ID NO: 76799 - DNA, 201 bp, Homo sapiens
gttctggtggacaccaggtcatgtcaattccatttcccgtatctgtttctaccttaccttccccattgccacaatctaattccagcactcactatctcccsttgtgtgattgaacttctttctagatttgcccctccaaaccatcttcatgctgtatcagagtgatctttccaaatgcaaatctgattaagccatttcctc

SEQ ID NO: 76800 - DNA, 201 bp, Homo sapiens
tcttggccctgcccctgtggatgtgggacagtgttgctaggcctggttgtgtcaggctgcacagatgtgtggtccatgctgggcagggaggaaacatgagycttttcctttggaggtttttagttctaagcactaggcatgaagtacctggtgatttgaaggagacatgggcacgttgacttcgaggatcagtaaggggct

SEQ ID NO: 76801 - DNA, 201 bp, Homo sapiens
cgtgttctggtggacaccaggtcatgtcaattccatttcccgtatctgtttctaccttaccttccccattgccacaatctaattccagcactcactatctmccgttgtgtgattgaacttctttctagatttgcccctccaaaccatcttcatgctgtatcagagtgatctttccaaatgcaaatctgattaagccatttc

SEQ ID NO: 76802 - DNA, 201 bp, Homo sapiens
gttgggtctctctgtctctccctgggtcgagagctgagaggaaagaatatagatgcaatcctgaagaagaaagctttgccattatggccagatggatggcrcatgatggaaccaattagcccattttttgctgaaaagaaagaaaaaaatcagaatttcaattttcaaagcagggactcttttttaaaaacgtttgattat

SEQ ID NO: 76803 - DNA, 201 bp, Homo sapiens
tccaggagcccatgattctttcctgaatctcctctgcctctatgggcttcctcttattctctttcatgtgttctttcttccttatctgtcattgaagtatyagtgttctcagagttctgtcttcagatgtttttctctcctttttcctttcctttgctcttcttacacacacttttctgggcaatttcatacatttatgtg

SEQ ID NO: 76804 - DNA, 201 bp, Homo sapiens
agtgctctctgacgcaggtcaggcctctggggaacacaaaacaatgagcaaaccttgtcctggaagtgaagcaagctgcccacttccagctgcaccgtgcwcaggaagctttatttaagatgggggatagggcgcatggctttaatgtcccaataatttgaggcatttctgaggatctggcagctgggaccaggagttcag

SEQ ID NO: 76805 - DNA, 201 bp, Homo sapiens
atccacctatccatctcttcatccatctgtcctttcatccattcacccatcatttatcaaatatctactaaattctaggaacactcctaatctgctccttrttatttaatttattttggtatttctattaattgagaagatccattcaatccttgcttgacttgatttttctattgcatttgaaacagttgactccttcct

SEQ ID NO: 76806 - DNA, 201 bp, Homo sapiens
gtccagctgagaattagcagatgagctaagtcggtgaaaacaactgctggacttttccacagagttttgggactgtcttaagggtatatacagctgccacrgcaactgtggggtgtgactgtatggattgggttgggtaggttctggggtgcggtctagctggggccttacccgcctgtgatgcttcaacctctatccatg

SEQ ID NO: 76807 - DNA, 201 bp, Homo sapiens
cagcctttctgtttgaaggtaccattaaagtccatgcctctcaaaattctcttcctcaagtagagaagatagagcagcatagaaacttctcaagaggaagraagtctcattctggaaaataactccaaactgtttctcatttgcagcatgaagaccacaaacccagtgttttttatatccacctccttctagtgtacctgg

SEQ ID NO: 76808 - DNA, 201 bp, Homo sapiens
tgggactgtcttaagggtatatacagctgccacagcaactgtggggtgtgactgtatggattgggttgggtaggttctggggtgcggtctagctggggccytacccgcctgtgatgcttcaacctctatccatgcctacagcactttgtagctttagcttttaactacaaactcccacaaactcccctcccggcttgggac

SEQ ID NO: 76809 - DNA, 201 bp, Homo sapiens
accgtatctctcatctcattcctttcttcacccctgtgcttgaacctaggcagaagatgccaggaccatgggcattaggaaggtttcaggcatgccaatcyaccgagtcagttgggaatgcttttcatggggtgatgagagcaaagaaatgccccagtgctatttcatctgcctccttgtgtaagaaaccagcatggacaa

SEQ ID NO: 76810 - DNA, 201 bp, Homo sapiens
ttgcatgactatgtcgaccaatgtttactgcatgagaagttaaggctgagaaattgtgaaagtgcaagaatacacaaacacacatgccattagccataggkgatgatgtcagcatgtgccacaacaccccactatgtacttgtgaaggaagagtgagaaagcagttagaaaccgttagtgctgttagaaaaatagttttcc

SEQ ID NO: 76811 - DNA, 201 bp, Homo sapiens
agtgttcttccttctctagtttagcagctgggcctcttagagaagaacagaagctgatctccccacgtcttccttcatgtccctcccacaagaccctaaayaaaggatgtttttgccattgttttttttcccctagtccgtctcccaatcccaaccccaaatacacacacacgtacacacacacacacacacacattcact

SEQ ID NO: 76812 - DNA, 201 bp, Homo sapiens
atgtgccacaacaccccactatgtacttgtgaaggaagagtgagaaagcagttagaaaccgttagtgctgttagaaaaatagttttcctccagggaccccygaaagcctcatgaggactcccagggctccccagaccacattttgagaaccactgccctgttgcttcctgcccacctcagggatattatggtccaggcggc

SEQ ID NO: 76813 - DNA, 201 bp, Homo sapiens
gatcttatggggcatttgctaacatacataactatagaagaaatgacagaagcggcagcgctagctgtaaatggtgagcacagatcattatccagatgatyatttggtgaagcagtgcaggatcacccaggtcttttatctcggggggccatacccacccaggcaggaccggaaggagaaaaccacaaagctttccaccag

SEQ ID NO: 76814 - DNA, 201 bp, Homo sapiens
tctaccaaagtttctttgtgtccctctattttttaattctttaaatttcattttgtatttgtggtaagaacatttaacatgagatctagcctcttacattytgaagtgcatgatactattttgttgactgtagccactatgttgtacagcagaactctagaacttactcatctaacataacctaaactttatgcccattca

SEQ ID NO: 76815 - DNA, 201 bp, Homo sapiens
ctgtagtcttcaaaactttgaaaaccacaacttttcagtggcagtgagatgggtgaatacctgcagggtgaggcaggagtgaatcatgacattaaaatacyttgactgaccctggaccactcattgctgacaataatccccagtttgatttttgccaatcatctcaaactgtctcggcaatgatttccccagatgacacaa

SEQ ID NO: 76816 - DNA, 201 bp, Homo sapiens
gaaggcagtcactggaggaaaagatgtcagcccaggtttttgcagaaggccatgcaagatatttatccatcagtaaacatgaactgattgtgtaccaactsagatattgtacctttgtgaattcttcccctgctgcctcctcagggatgcccctgtttcctatgcatgcctttatgatgggcctcactgacttgcgctgta

SEQ ID NO: 76817 - DNA, 201 bp, Homo sapiens
taacatgcaggtacatattaacgaaagatcattattttaaaaaaaattttttttgaagaaaatctctcagaattccttgtacaatgctttggttaagtaargaaaacagaatgactgtaatgaaatctctccttgactggagataatgttacgaacataccatgatacaatgcaatggtattcttcaagacagtttacgag

SEQ ID NO: 76818 - DNA, 201 bp, Homo sapiens
ggaaggacccctgcatttggagctgaaggacatggagaaggcttgggagccgcagtgtagggtggcctctctggggcctgtagggattatttgccatggtrtcccaacctgcccatcctgccagcacctggatgttctccttcactcttccttaccatctgtggctgttcccatgttctccccaaggcccaggctcattgc

SEQ ID NO: 76819 - DNA, 201 bp, Homo sapiens
ctcagaaagagttggaagggacctttgagagtctttaattagcgtctcattttacagatggaggtccatggaagttcagtaacatactcaaattcacaaaygcatttttaaattgtcctctgccctctagatgggtgctaaacactgggcatggaaagtgaaatctctcgtgactaggaggggctcagaaacggatgcctg

SEQ ID NO: 76820 - DNA, 201 bp, Homo sapiens
aggcccaggctcattgcaggcagattctaggcaagccaagaggcgctagagaatgtcagtctccctctcctgaagctcacctggtgctattgtgcagcttscgtgactcagccccaggtaggggctggaagtctctttctttcccctcctggagggtcgttaagaagaggcttcctccgtcttgagaacaaggaattcctg

SEQ ID NO: 76821 - DNA, 201 bp, Homo sapiens
ttcctccgtcttgagaacaaggaattcctgccttcctagaagccaggacaaccggaagagggagcagcgtgggggtagatgggtccctcctggcttccagyagctgcctagttccccatttgccaaagctgcctagtgtcctggaaattcccagagaagtggctgtcaccatctgctcagggctgcccggctcccactggc

SEQ ID NO: 76822 - DNA, 201 bp, Homo sapiens
tggtgctctgtagctccagctgtctgtttcaggggctgcctgatcacggcctcctctgtatgcttctagcttttctgtatcaagcccagatagttctcttrgctcctcctcatctatatccacaagctgtggatacatctttgtgcttagaagagaccatggtgagagagggactttctggaagtctctttcagcagatct

SEQ ID NO: 76823 - DNA, 201 bp, Homo sapiens
taaatacttgttaaatgagtgaatcatgaacattagggctcattttgctggactaggcaagacgtgggaataaagaagacggggttctgctaatcaggtgyaggactgcctcagagtgtgataaagttcatctctgttgtttgaggaaggagaagccagtttccatagcctcccgattctgaacatctccccctggatgtc

SEQ ID NO: 76824 - DNA, 201 bp, Homo sapiens
cagtgttgatccaggaaagggtggatttagcaaatcacatgaggaatatgctggttggcctgacagaatgtggactttttatggcttttccaaattagaarggaggagagactaggccctgggtttcctcccttctgtgttgtcacagaatgatgtcctgttttctggcaccttggacatttccccagcttctgttgaaca

SEQ ID NO: 76825 - DNA, 201 bp, Homo sapiens
tgcagagtccagcctgtggttcccttcctgagccatcacaggccccacaccatgacagttttgctccatgactacttactaccatgcatggcaccctccgkgtgcctcgcggagaagttgccctcatatggtctgtgctggaagagtgacggagcaggggaatctggcacaggcggaacgtgataattcatgcacaggcct

SEQ ID NO: 76826 - DNA, 201 bp, Homo sapiens
ctaccatgcatggcaccctccgtgtgcctcgcggagaagttgccctcatatggtctgtgctggaagagtgacggagcaggggaatctggcacaggcggaaygtgataattcatgcacaggcctggccaaggtctttcccacccgtttctttgggttttcagctcctcatttttagcgccaagcttctgttcctcctctgga

SEQ ID NO: 76827 - DNA, 201 bp, Homo sapiens
ctcagtgtgaacctagaaatgcttttgactgttcctttccttgctgttcttaatgactcttgaagaaaaaaaatacttgtctgttttcagtgtcattcagycctgcctttatcttgccatagttatttacatttgaattctctttctttgccttctctagccacccacccactcatctctaacctttgcctgaaagagtta

SEQ ID NO: 76828 - DNA, 201 bp, Homo sapiens
tgggtggtgaatgctccctactgataaggagctcaggctcacttggaaccctggcagggaagccacaggaagcatctctgctcatgcagcagccgtctttrctctcatatctccccattcagttcttaacctcatcctcataatttcccctctgtttcttcctctgccctcctgtccagcatatctcccctttgtggctct

SEQ ID NO: 76829 - DNA, 201 bp, Homo sapiens
agttttcagcatgctaggcggggagtgacgggaagcccggaaagggaaaatggagccactcatgagattttaggctgacacgggctgtgtgtgttaatggkgctgggggtgggggtttccaatggggcacgtggtgggtggtgaatgctccctactgataaggagctcaggctcacttggaaccctggcagggaagccaca

SEQ ID NO: 76830 - DNA, 201 bp, Homo sapiens
ctgggggacatgtgtcctctacctcaggtgaacctgagttctaatggagggggtgtatgctctgcacttgggcctcagatatttaattgctcagttttcarcatgctaggcggggagtgacgggaagcccggaaagggaaaatggagccactcatgagattttaggctgacacgggctgtgtgtgttaatggggctggggg

SEQ ID NO: 76831 - DNA, 201 bp, Homo sapiens
aagtcatgcagaacgtccagagaccctggcagctgggcagacaccacacacacacacacacacacacacacacacacacacaccaccctaatgtcaaacaygcacacatgcacagaccaccctaggatttgtgctatttccaatcagtggcataaatgactgagcaagagaagtttactcaggatgcatattaaacagcta

SEQ ID NO: 76832 - DNA, 201 bp, Homo sapiens
gttttttcaatctgtaaaacaggaattttaatatatacctgacaatgctgggattaggtttaagttagataatgcacagaaaaggcttagagaaattcctrccacacatggctcaatcaatcaatgttagcaattataacaattaattctaattacatggtgctatttaaagtggatttaagaaatccagaaaatgtcaga

SEQ ID NO: 76833 - DNA, 201 bp, Homo sapiens
tttaaattatgggcttggcattcatatcagcccacatctgaggctggccaggtggacagaggaagaaggatgacacctctgaaactgaagctgcccttgtsctttgaatggaggctagtaatttcatcctcttctcatgaattttgcaatgtcctggtggtggcagctagaatcactgcccacagtggctgttatctggta

SEQ ID NO: 76834 - DNA, 201 bp, Homo sapiens
tttgcaggtatagcagtgatagggccatgggggaaggggacgaaaggacagactttaaattatgggcttggcattcatatcagcccacatctgaggctggycaggtggacagaggaagaaggatgacacctctgaaactgaagctgcccttgtcctttgaatggaggctagtaatttcatcctcttctcatgaattttgca

SEQ ID NO: 76835 - DNA, 201 bp, Homo sapiens
ttgccatgatgcagtgattgcttttcctcaggagtgatttgcaggtatagcagtgatagggccatgggggaaggggacgaaaggacagactttaaattatrggcttggcattcatatcagcccacatctgaggctggccaggtggacagaggaagaaggatgacacctctgaaactgaagctgcccttgtcctttgaatgg

SEQ ID NO: 76836 - DNA, 201 bp, Homo sapiens
gcttccttttacttttgtttggtccattttctgttcagatggtctagagcaatctgcaggtccagcatattgtcctaggtcatgagttgaacaaaaggatytcaatggttgttgtttccttccaatgcacactctcaggcaaggtggaaccatcttcccaaggcaggctggcacctttgcctgggcaccaggaagggcttc

SEQ ID NO: 76837 - DNA, 201 bp, Homo sapiens
tgtgctggaagagtgacggagcaggggaatctggcacaggcggaacgtgataattcatgcacaggcctggccaaggtctttcccacccgtttctttgggtwttcagctcctcatttttagcgccaagcttctgttcctcctctggagccctagtgctcctcctctgtgccaattgtttggaagattctaaaacctctgtgt

SEQ ID NO: 76838 - DNA, 201 bp, Homo sapiens
gcaggggaatctggcacaggcggaacgtgataattcatgcacaggcctggccaaggtctttcccacccgtttctttgggttttcagctcctcatttttagygccaagcttctgttcctcctctggagccctagtgctcctcctctgtgccaattgtttggaagattctaaaacctctgtgtgagccattgagagctcatgg

SEQ ID NO: 76839 - DNA, 201 bp, Homo sapiens
ttttgagtcttggggtttgagacaccgttcctggatgttgaaagtccacagaggggaggcaagacacccttccctgcacccctggcccctgcctccacccrgctgcagtgtcgttcgtgcccagcaggctgcactgtgagactgctgatggcctccagccccgcacggctctcctcccgatcctgcctctgctctggagac

SEQ ID NO: 76840 - DNA, 201 bp, Homo sapiens
gacacccttccctgcacccctggcccctgcctccacccggctgcagtgtcgttcgtgcccagcaggctgcactgtgagactgctgatggcctccagccccrcacggctctcctcccgatcctgcctctgctctggagacctggggcctgcaggcctgagtgtgtgtgtgagcctgtatgagagtgtttgtgtgtgttagtg

SEQ ID NO: 76841 - DNA, 201 bp, Homo sapiens
caagagcccttgggtggcactgtgccccaacgttgctacacatctctaccagccctctctagcctgacatgccacgaatgggatctccctcctactgcaargcacaggtcaccgtccttgccagggttccccagcactgccaccagagactgtgtggtttgatccatccctccttgtctctgggctctgcttccaccctcc

SEQ ID NO: 76842 - DNA, 201 bp, Homo sapiens
gtggcactgtgccccaacgttgctacacatctctaccagccctctctagcctgacatgccacgaatgggatctccctcctactgcaaggcacaggtcaccrtccttgccagggttccccagcactgccaccagagactgtgtggtttgatccatccctccttgtctctgggctctgcttccaccctcctgaactgtgagcc

SEQ ID NO: 76843 - DNA, 201 bp, Homo sapiens
tctagaaacatcagtgtgatgtgatgcagcaccacagacccctcgaattctcagaatacattttaaaaccaagctaggattgcatcactcagtgatttacygaatcatggtaaaacctcacatgtggctgacttaggtcatcacacctaaagaaaacataaccaggctggaactgtttcacagaaggaaaagtaatgtgat

SEQ ID NO: 76844 - DNA, 201 bp, Homo sapiens
tggctctgtggctgtgcccttggctccaggggcagcagctatactgatgacgagtttttccattcccccagccagaaggcaagaggtggtagggtagatgyacatgtactcctccctttcttctggaaagtctgatttggatgcatgcatatgtgggtttctttagattagatggtgtgtgttaaaaattgctcttgacat

SEQ ID NO: 76845 - DNA, 201 bp, Homo sapiens
gagtttattgagatgatttgtgatatagtgcattagaagcccttagtacagtgcctaatatatggtaatctgcgcatttaaagtgagttattattgttathatctggttttattcttgcagccacctttctttggccagctttggtcactggacagtaagcatgaacctcagacatagcctgggctgaatctttagtgcaa

SEQ ID NO: 76846 - DNA, 201 bp, Homo sapiens
aaggctgttgattttattattgatcattgagtttgatctgatgcatttcacagagacttggctctgtggctgtgcccttggctccaggggcagcagctatrctgatgacgagtttttccattcccccagccagaaggcaagaggtggtagggtagatgcacatgtactcctccctttcttctggaaagtctgatttggatg

SEQ ID NO: 76847 - DNA, 201 bp, Homo sapiens
tcagtgagaccaagaacccaccaattgcggacacagaatcaacctctgtatgtctgtcccggaacaatgtaacttagtggttaagcactcatgctttgtgrgcagacaaacctgaattcaaatccctgtgcaccaccaaaggtttcttctctctctcataaaacttcatgtttccactaaaaaaaaaaaagaaaaaaaaaa

SEQ ID NO: 76848 - DNA, 201 bp, Homo sapiens
tggctattggattttatggtttgattggttagccctcataaggggtttatatttctcctgttggagctggagggagtgatggggggctgggggtccataawcccctttaattgttgtattgtgactcacctgaacctggtctctcacctagtcaaaaaccttgacttcttagcatgatgccttgcatccagaggattggtt

SEQ ID NO: 76849 - DNA, 201 bp, Homo sapiens
tttgttcatcctgcggtgatctcttctttgtccagtcccgtgagatcacatcccttttagaaaaactagctcttttgacttctgtggattaagaaggttasgtctcggatgctctgacagccggctagcagcatcaggatcatctctatggggatgatgcgaaagaaaaagaaggcagagcccccagactcagacctctca

SEQ ID NO: 76850 - DNA, 201 bp, Homo sapiens
caaacagccaagggtgcttgtccagcaggaaatccaccatttcaccattttgcaggatggagggcaaaccagggagcagccaacaataaactttggaactstgtgagaaagtggtcagacacctgtgtatcttctgtaggaaaaccttctgcccaattgccagtctaatagggtttcaacaggatatgataaaccagaaag

SEQ ID NO: 76851 - DNA, 201 bp, Homo sapiens
ccgagttcagattcaactggctccctgaatgcttgtccacctgagctggcattgatgtgagctatacccactcgcgtgcttttctgaacctaaatgtagakccttacagttgacccgttcaaatgtcccttgttaagttcagccaaccttgctaggcacctgagatcttcacggatatacctgctgccaagcagtgtttta

SEQ ID NO: 76852 - DNA, 201 bp, Homo sapiens
gcttatgtgagtgcctgtgtgtgggtggtgctggcatggcccattgtcatcagttgaaggatcaggggttcttctggctggggcactggaaaggaactggrattgtgctttttgtgtctaacaggatggtttcctcctatgtgccctttgtccttctgaaggacttgtgggcagcctggccatcatgactctgagcccaga

SEQ ID NO: 76853 - DNA, 201 bp, Homo sapiens
tgtgtccatctttcctctggcaaagagaaggccgaaaatttggcttcctaacccagagcctggagatacccctgccacccagttggcgccctgaggatctyggctcaagtgtgggcaggcttggagccagtgtccaggcacttgtccagatctctggttggacagcccttcagaattcctaatgtaaatgatgctgtcaca

SEQ ID NO: 76854 - DNA, 201 bp, Homo sapiens
ttgtggagcagtgtttctgctgtccataagagaccatctcctatccatctctgctgtgtttgatattatcctacacacatgaatatgctgtttcatttgcmtatatttaccctctcattgagtcctcatgtccccttgcgaggtggcgggccagatctaactatcttctattatagataccaaagtctaggtccatccagg

SEQ ID NO: 76855 - DNA, 201 bp, Homo sapiens
ccaggcacttgtccagatctctggttggacagcccttcagaattcctaatgtaaatgatgctgtcacatctggtggagggtagagatatagccatcaagcrtatgcagcccatgttccaaactaagtctttctcaatcagcgtcaggacatctttaaggccaccccaggaacctacatgtaaaaatctgccagcatcaatt

SEQ ID NO: 76856 - DNA, 201 bp, Homo sapiens
gcattctgtgatctcaaggaagatttctgctagtagacatttttaagatttggctcaaaagatgttttaaaaacattaaatgtggatattttccattggakcccatgctctctagctctcttcaactcccaacataccctgttgccttatagccaatccagtggcttacatttccacaattccatttaaacttgtgacctt

SEQ ID NO: 76857 - DNA, 201 bp, Homo sapiens
tgatatcttgtggaagcgaaaaacgatcaaggtctctccaaataagattatgacacaaagctggagagttgatataaccctgagggaggacagtaaaagtrtattaatggccttgccagctgaagggaaattgcttctggtgggcctaatggacaggaatggaggaaaaggcatttgccaagtcagtggctgcataccagg

SEQ ID NO: 76858 - DNA, 201 bp, Homo sapiens
ccctgagttcaaagggtacaggcctcatagatattaattagcaagagtgaggagtatgtatggaatatgtctggccagttcatattatttgaatgcgtctsatttctccaaatgagagcccttttctaacattcatgatgctagtcaacaggccattgtcttcacccataaaaatcaatttttgacactttgcatgctaat

SEQ ID NO: 76859 - DNA, 201 bp, Homo sapiens
accaagacaggcctcccagtctcagaagggccgtacaactggaagtacatgtgtcccactctccgtggccctgagactggggcaagcacatgagttgcacraatggccacagcagatgagaatgcacagatcattgagatctttattttacagatgaaaaaactgaatcccagaaggagaacattcctatagcaagtaatg

SEQ ID NO: 76860 - DNA, 201 bp, Homo sapiens
tctggtcattgatagtgatatgagggcagcaatgctcatagcagccacctctgagcttgggctgtctgaacacctggccttgagccttctcgattgctacytgagccatatcttcagttcagtaagacaaaactctcacactttctatgatgaagtagttgaaagaaaattttacacattgtaacattttcctagatggct

SEQ ID NO: 76861 - DNA, 201 bp, Homo sapiens
gaaaccacatctggtacagaagctgcaattgaagttaccacttggttaagcttacagtaatcccctgttattctccaagatccatctgtcttctgcacagkccaaatgggagagttgaagagggatgtggtgggaatcaccacccctgtgtctttcagtccttgatggtggcactaatctctgcacaccctccagggatgc

SEQ ID NO: 76862 - DNA, 201 bp, Homo sapiens
gcatttacttttttttagtccgagaatcaacctaggctcacatgtcacatttagttgttatgtctctatatagcctccttcaatctggaatcctttcttcrtctttcatgacattgaaatttttgaggactaaaggatcattttatagaaggtctgtcaatttggctttgtctgatgtttcctcatgactgcattcagatg

SEQ ID NO: 76863 - DNA, 201 bp, Homo sapiens
gggagtggctggaactgacacctgaggagctctgtgacccagcagaattctgtgcttttcctggggagagcttcttctaagaagaggtggccacgacagcygatagaaggctgtgacctgagtgcaagccacgtgccagccactttctgtatgtgagaccgtgctgcttgccaaaagctgttagttccttccattctggct

SEQ ID NO: 76864 - DNA, 201 bp, Homo sapiens
tatgttagatgtggggaagtgcatatttgcattgaggaaatatggtataaacatcagcagcaagacccatcatttgtacttgttcatttattctttcattkatttattcattcagatgtaaaataatgtgacactttctgcaggatggtacaaagaacccctttagcactgagccaaattacagtgaataaagaaaaaaat

SEQ ID NO: 76865 - DNA, 201 bp, Homo sapiens
cttgatggtggcactaatctctgcacaccctccagggatgcgatattgtttctgatttactatttttctaggtagagccagctctaatggcttccatttgwcctttcccaccatagtagctctcaccctaccagtcagggagccgatgtgggggttctgccagctgctaagtatgtctatgctaattatgcattctggcac

SEQ ID NO: 76866 - DNA, 201 bp, Homo sapiens
aaataatatttgaaaactacttagattagtgtctgacacataacactagtcttattagagtagacactcaataaatattaataaatagattggcttgtagrcatgcaattaatctgctttgttataacagtggattacaactgggcattccttttgatgtctaaattgcattcccttctgtctaatagaagccgttctgtt

SEQ ID NO: 76867 - DNA, 201 bp, Homo sapiens
accctccagggatgcgatattgtttctgatttactatttttctaggtagagccagctctaatggcttccatttgacctttcccaccatagtagctctcacyctaccagtcagggagccgatgtgggggttctgccagctgctaagtatgtctatgctaattatgcattctggcactggggaaatgaccacaggattagtct

SEQ ID NO: 76868 - DNA, 201 bp, Homo sapiens
aaatttttgcaatttatccatctgataaaggtttaatatccagaatctgcaaggagcttaaacaagtttataagaaaaaaaaaacattaaaaagtggggaraggacaggaatggacacttctcaaaagaagacattcgtgcagccaacaaacatatgaataaaagctcaacatcactgatcattagagaaatgcaaatcaa

SEQ ID NO: 76869 - DNA, 201 bp, Homo sapiens
tggcctccagctccatccaatttgctgcaaaataaattatttcattcctttttatggctgagtagtatcccatggtatatatgccacattttctttattcrctcattggttgatgggcacttaggttggctccatctttgcagttgtgaattgtgctgctgtaaacatatgcatgcgtgtgtgtttttcatataatgactt

SEQ ID NO: 76870 - DNA, 201 bp, Homo sapiens
gagagccctgaggcctgggttatggaagcaaagctatagagagagacagggcagcctgtgaaatgagagagcagtgggggaggagaagctgtggatccagmctcggagctaaggctgggcagattcaggatggtatttcagaccagaccctcatggcttctgggaaaacacaagacccaaatatgtgcaatgattgggaat

SEQ ID NO: 76871 - DNA, 201 bp, Homo sapiens
cctaagtcctaaagtgcatgagttaagatctagtcagacaatcagcaatcctggagttcagtggagggaatttaatacacggagctagctaggaaggtgtyagaagggctgacaagctaaataaggatgggcaagcaacccagagacagcatcagcaggaagctgcggtacctcccatcagtaggaggtggcccagcgcca

SEQ ID NO: 76872 - DNA, 201 bp, Homo sapiens
ctgatgctggtgcttttcctaaaaaatacttctcaggtttttccagcattctgatgccacattcatgcttttctgcatcatggtttcatttatgcttggtytagggccgtgggcctgtattgatttccacagcacctttgggccatttatgcaactgtggtgggagatattttacataagcttggaagagttactgcccaa

SEQ ID NO: 76873 - DNA, 201 bp, Homo sapiens
cacaataactctgggatctggccaccttttggctcagcacatcctccttcaaggagtttatcacctgccccctagaccatggcttagtcaaattaaatagyttttattttttggagtataaaaataatatgtgctaagtgtggaaaacctaagaagggaagtaaagaataaagaagaaaagtaaatcagctattatttcat

SEQ ID NO: 76874 - DNA, 201 bp, Homo sapiens
gtggaatcaaatccatatgtttgtgatgcagttgccctgaaataataagaaagcattgctgggaaagagcctttggatgtctcaggaaccatgtttacaarccccacattggccttttggtcccctcagttcatgctgccacttgccaggctttgaaaggaccaagttcacatggggacactactcttctttcttctcctg

SEQ ID NO: 76875 - DNA, 201 bp, Homo sapiens
cagttgccctgaaataataagaaagcattgctgggaaagagcctttggatgtctcaggaaccatgtttacaagccccacattggccttttggtcccctcakttcatgctgccacttgccaggctttgaaaggaccaagttcacatggggacactactcttctttcttctcctgattttttgcagcctttgctcccaatgac

SEQ ID NO: 76876 - DNA, 201 bp, Homo sapiens
ttaatatccagaatctgcaaggagcttaaacaagtttataagaaaaaaaaaacattaaaaagtggggaaaggacaggaatggacacttctcaaaagaagamattcgtgcagccaacaaacatatgaataaaagctcaacatcactgatcattagagaaatgcaaatcaaaaaccacaatgagatgctatcttacaccagtc

SEQ ID NO: 76877 - DNA, 201 bp, Homo sapiens
gatcgagaccatcctggctaacatggtgaaaccctgtctctattaaaaatacaaaaaattagctgggcgtggtggcagacgcctgtactcccagctactcrggaggctgaggcaggagaatgacgtgaacctgggaggcggagcttgcagtgagccaagatcgcgccactgcactccagcctgggcgacagagcgagactc

SEQ ID NO: 76878 - DNA, 201 bp, Homo sapiens
atggaaaacccaaacaccgcatgttctcacttataagtgggagctgaacaaatgagaacacatggacacagggaggggagcaacacacactggggcctgtygggagatggaagggggtagggagagcattaggcaaaatatctaatggatgctgggcttaatacctaggtgatgggttgataggtgcagcaaaataccatg

SEQ ID NO: 76879 - DNA, 201 bp, Homo sapiens
atctttattcttgtataatttttaacatgactcatacgggcatatgtgaccttttgggttaagatgagacaatggagattgttcttgttttgtagaatttytctctctctctctctctctgtgtgtgtgcacgtaattatttctattctcttatccgttagtaatattctagtggtagaaaagggaggtgaaattagcagt

SEQ ID NO: 76880 - DNA, 201 bp, Homo sapiens
aatgtttctctactgcatgatgaacaaagatgggtgggaaagagagaaagactctcttcatttctgttatgtattcattgtcctggtagctttttccaggytgcctactcttttcagtgaggtaggtttctcttctctttcccagcctcaaccttcactattctgtttctgtatcagaagacaatcaaaacctaacacatc

SEQ ID NO: 76881 - DNA, 201 bp, Homo sapiens
aattaactcatataaatcttctgatctaagatccagtttctaattgcggctctgtcttgctgttggtggtgattttggacaagtcttgtaatctcccttargctgagttccccaatccataaaatgaaacaattataacagacaagtagtttctaactcccctgacccctttttagactttagaatcttggattatttaga

SEQ ID NO: 76882 - DNA, 201 bp, Homo sapiens
cccagcctcaaccttcactattctgtttctgtatcagaagacaatcaaaacctaacacatcatccacaaattctgacctggcatgtccaggattccagagrgccctggttaccctttgtccagggcctgcagttgggtgatgatgatgagaccaaggagagggcaagctcttacattaagctgtgcattttgttcactaag

SEQ ID NO: 76883 - DNA, 201 bp, Homo sapiens
aattgtgggtcttgagaaaggagactgactagtggcattgtttaatgaatatgaaatgtctctgctcacaaaaattttgaaatcccttttgatatagactmtcttctcttccaacaacacttctgctctttttccttttgcccctagggaaaggaagagaagacaaacactccctgggaatggggtggcgggaatatgacc

SEQ ID NO: 76884 - DNA, 201 bp, Homo sapiens
gtgcattttgttcactaagtaaagagttgccttgtgcgtgttctggaggccaactccagccacttctgtgcgttaatcatttgttatgatttgagctcatwggaaaaaaatcccccagccagtggcacaggggggtggctctgtaccctgtggtacagagtaggaagcctggctggatcagctgaggctgtggattccctg

SEQ ID NO: 76885 - DNA, 201 bp, Homo sapiens
atcaactgtttcaccatctgaatctaatcctaattctaacttttaacttgccttagaaagtttgggaagcattagatgagatactgtgtataaagcatttygcttaaggcttggcacatatagatgctgaataaatgtttcatttcctttctttctctccaatactcactccttattcaccatagtccatttatagtatct

SEQ ID NO: 76886 - DNA, 201 bp, Homo sapiens
cagattattctgattgctgctttgcctctgctgtccattacagtaggtacacccaccttgcctttgatggttgagttggcccctgccacttcaggatccarttattcccattgtatttaaattttatagttgagtgactgtggttcccactgttagatctgacatacagagaagagtgattatagggcccttcaaagatgc

SEQ ID NO: 76887 - DNA, 201 bp, Homo sapiens
tgcacctgcccatgacactactaagaacacccacatttgtttgcctttcatccgtctcctgagggaccaggaaagcctgacatctttctctaagtccaggsaggaaggggcagggccagtggtcagcttggcagagttgagagcagaaattagccctccagctgacagggctggctctctaggtacacgccttgttggcaa

SEQ ID NO: 76888 - DNA, 201 bp, Homo sapiens
tctctttctggggcaacaaataaaatccctccgagcacaggagtgctcattgctggttggttatgccagtctgtctctatttttagaaagagctacaagarggaggaaaagaatctagagaaataagtacagatggattcctccctgaggcagaagctggggtctgtgggatgaagcacagacacaaagccattgtcctgc

SEQ ID NO: 76889 - DNA, 201 bp, Homo sapiens
gccattgttaggcctccatcctgccttgggctgtgctgccgaatgccagccttgcttttcaaggcttactgccttgttttttggaagccttgtcttttgtwagcttggcctcctgtgcttccttcagatgagaactcacctcgcaggttagtctccgactgagccagagtgttacatatgcttgacctgaactgaatgtag

SEQ ID NO: 76890 - DNA, 201 bp, Homo sapiens
gagcacaggagtgctcattgctggttggttatgccagtctgtctctatttttagaaagagctacaagagggaggaaaagaatctagagaaataagtacagwtggattcctccctgaggcagaagctggggtctgtgggatgaagcacagacacaaagccattgtcctgccacccagcagtggagtcggagatggatggcat

SEQ ID NO: 76891 - DNA, 201 bp, Homo sapiens
aggctcctggactgcctctctggctgatagcatttttatgggtagacagaatagtcaactgtttatatggatagttagaagagtctctcacaatatcctaytccttcctttaagggatgaggcattgtatctctgtaaatgtaaatgttttcctgaaggaagtgactaagtactccagtaagctttaatttatcatatggg

SEQ ID NO: 76892 - DNA, 201 bp, Homo sapiens
tatgccagtctgtctctatttttagaaagagctacaagagggaggaaaagaatctagagaaataagtacagatggattcctccctgaggcagaagctgggktctgtgggatgaagcacagacacaaagccattgtcctgccacccagcagtggagtcggagatggatggcatgaatctagaataccatgggaatgggtcct

SEQ ID NO: 76893 - DNA, 201 bp, Homo sapiens
ctgtctctatttttagaaagagctacaagagggaggaaaagaatctagagaaataagtacagatggattcctccctgaggcagaagctggggtctgtgggwtgaagcacagacacaaagccattgtcctgccacccagcagtggagtcggagatggatggcatgaatctagaataccatgggaatgggtccttgccctggg

SEQ ID NO: 76894 - DNA, 201 bp, Homo sapiens
ggagtcaatgggacaaagggtgagctgtggctttatggctttagctccaagaagaaatgtgtcccggttggtaaatgattgaccgaaaaatgtatgaaacycccttcagtaactttaacttctggaaacaatttagaggacaagtagggtcagtctgacttccgagaaagggaacatttttcttattgtttggatgccgat

SEQ ID NO: 76895 - DNA, 201 bp, Homo sapiens
catattcagagacattagtggggagtccatcagcagatgatgacagtgtcttctaggataagaaggaggtgtagatacgactgaagattactcaggagagygttcactgggtttggtgaagggaaaagaaccacgtgtaggtgtctagtttgaacaactggtaggtagtgattttatttactaaggcgtgggaagactgga

SEQ ID NO: 76896 - DNA, 201 bp, Homo sapiens
ccgcttcccagaggggcccatggaggggatggtggcctctagagtaaaggcccctccagccttctcttaacatgtccccacactttcactgggattaatcrctcccctgtgtgcttctgtggtccttaaatatacctctattttatgatgagtgacagccaactatggtttgtggcactccttaacagtaggagtctgttt

SEQ ID NO: 76897 - DNA, 201 bp, Homo sapiens
agtagagccagaatttgcacccaggacccctgactccaacacctgtgctgtgaaccactgttttagcaccagcttctctctgggatctctatagggaagaygaaaacaagtaaacaatgtgggctgcattctcaagggagtcgtgatcagaatgggagtcaatatagcacataggaaagaggcaccagcaacatctgcaga

SEQ ID NO: 76898 - DNA, 201 bp, Homo sapiens
tatacagtctctactgggtcaagggtgtggcagagaagaggcaggcttggggttttggtgacatcatcacagtccccagtactcaaggggtccacggtccmcagtactcatggtcaccaccactcctctgtgctttctcttgagtgtggaaaagaacaactcagcatcatcttgtccttccgtctgcttccaaataagatc

SEQ ID NO: 76899 - DNA, 201 bp, Homo sapiens
ctgctagatggttagctccttaaaggttcagatccacagtttatcccttcatttctcactttagttggcatggcggtagacatgtagcagcagctcaaaawatccttaacacatagggaaagagatggctgagttcttctctgtcacttgtttctgagcttaactgtcttcacatacagggctcttccaatgcctaacgtg

SEQ ID NO: 76900 - DNA, 201 bp, Homo sapiens
tgtgtgcaggttgtgtggcaggaaccaatgtcgggaggagagaggacactgctattaccagggcctggaactagtacccatgttcccctttattctgcttytgtctcgctttgagcttggggcagaggaactcttctgctcttccctgtacaacaggtctgtcatgcagaggctggttcttataaaagattaaccttgtct

SEQ ID NO: 76901 - DNA, 201 bp, Homo sapiens; identical to SEQ ID NO: 30039

SEQ ID NO: 76902 - DNA, 201 bp, Homo sapiens
ataggcccactatgtgttgtgcctctttcttggttgtaaaaggggctaaatgcagcagctgatccttcaccttagaaggaatatcttgacaggccccacascactggacccctagaaattttactgaggtagaagttccctgaattttagtcagatttttttcccatcccctggcatgcaaatgtctcacccataagtctg

SEQ ID NO: 76903 - DNA, 201 bp, Homo sapiens
gtgtctttataatagaatgatttatattccttgcattatacatcccataatgggattgctgggtcaaatggtatttctggttctaggtctttgaggaatcrccacgctgtcttccacaacggttgaagtaatttacattcccatcaaaagtgtaaagcattcctatttcttcctaacctcaccaacatctgttgttttttg

SEQ ID NO: 76904 - DNA, 201 bp, Homo sapiens
ttggctgcatgtatgtcttcttttgagaagtgtctgtttatgtcctctgcccactttttaatggggttgtttgttttcttcttgtaaatttgcttaagttscttgtagattctggatattagacctttgtcagatggataggttgcaaaaattttctcccattctgcgggtcatctattcactctgatgatagtttctttt

SEQ ID NO: 76905 - DNA, 201 bp, Homo sapiens
tggtgactgtatactctttgcttgggaaattgggcagcaagtgcagaggagggatagtaaggctcaggaggaaaagagaaaacacaggtgcaagaattcayttatcaattcattcatcaaacatttattaagcacctggagggaggagcaagtctggagaccaggacagtctcttgagcaattcaggttgttcctgatatt

SEQ ID NO: 76906 - DNA, 201 bp, Homo sapiens
gttaaatgacaccacttttgaacaacccagttgtctacaccagaaactttggagctgttttgaattgctcctttcctcttacttgccacacccgacgagcmccatggcagggttgaaccactcaccatctctggtatttaccccttcctgctcatcccctgagttcagggcctcatcaccacttgcctggcctacttcagt

SEQ ID NO: 76907 - DNA, 201 bp, Homo sapiens
ctctgtgcctccttctttgtgggtgtctgagcacctcagctgtttgttgcaaagcagacttcattgctgggcatctctttatagactggcataggctgggractcaggaggtcactcgttggccagcaggtttacactgacccacctttgtccctccctgattcttttgtgggaagcacccctttcctcccatgtaagaaa

SEQ ID NO: 76908 - DNA, 201 bp, Homo sapiens
agcatgtagcatagtgcctggcacagatgagcacccagaactgggagctgctctccatcagtatggtggtcctcccttgccctcacgactcatctatccakgactcttttgcccctctcatcattccttcagtctgacttcctcccttcatggagacaccagtcggtcagcactctgggcactgttgtgtgcacagccctc

SEQ ID NO: 76909 - DNA, 201 bp, Homo sapiens
caaaattaattaaattcatatcagaaagtattttttcccctgtgcgtgcttgttttgaaaaaaaaaaaaaaagtgaatgtttatttgaagatgaggtgccktcctctcataatctgacacctatttgtaacagtcatagtgacaagggccagatgaattgctgggtcaatgaaacctgactttcaaatacttatcactgca

SEQ ID NO: 76910 - DNA, 201 bp, Homo sapiens
tataattacatttaaaatttattgttttaactgtatttttaaaaagttttaagtaggttgcaaatattgcatgggacctaattatgctaaagattattcaytgtttatctgaaattcacatttaatttgacatcttgtatttttatttgttcgatctggcaacccttagcaagagaaaatgtggagagactggttatagac

SEQ ID NO: 76911 - DNA, 201 bp, Homo sapiens
ttgacagtttaaaggagaagatcaaattctagttttgtttcagtatacttttgatattaaggctcattttaatacctttataataaattcattcaattatwgtcagtttgagcataagattttctttcactttctatctcttcccacctttctatcatcattaagttttatctatatcctttcttccttcattctgaaaca

SEQ ID NO: 76912 - DNA, 201 bp, Homo sapiens
ggagaggctgtgaatgcacctttcactgcaggtcagccactcgcatgataagagcttgtgtctgtttttccacaatttcagctctttgtcttcaggggataagactgtcactcagggccatcttagcagatttgatgctcagaatctgcttttgaagttgggagttagaatccctgagttcatcattttctttcatcactt

SEQ ID NO: 76913 - DNA, 201 bp, Homo sapiens
gagcacacaagtcatgtaaacttgaaaaacatttgggttagtttctatagttctagcaattttaggagtatttggtttatatgagtactgatttatcgctrtgcccaactttaaaataactttttaaaaggagttttataccatgtaaacatagatgtacacatggataaacatatgtgaacatatagacagacacaaata

SEQ ID NO: 76914 - DNA, 201 bp, Homo sapiens
ctccttgcctgtcatgagcagtgaatcaggagtgtcaaatgcatttattttgcataactctctaaacagttcatgccaaggactatcagtgttctccataytattagaagtagagtccttagcatttcggggtctaatcatattaagcagccaactccagaaaccccaaaaccaatgaaagaactccatccttaatattct

SEQ ID NO: 76915 - DNA, 201 bp, Homo sapiens
gggtgtagacattgttttagttaactccttagatatttacatttcagagacgtagtaagatttacaattccaagggactggaagaaaatgtaggttttctytaagaaggagttttggatgagtatttgcttattagagatctagggtaacttttaaagctttttttctctttaagtgtaggacagtctacggaattttttt

SEQ ID NO: 76916 - DNA, 201 bp, Homo sapiens
gtggtgtcctatgcctgtaatttcagctaatctggaggctgaggcaggaggatcacttgagcccaggagttggaggttgcagtgagctatgattgtgcaaytgcactccagcctgggtggcagagtgagactttgtctctaaaaaaagaaaaagagaaaaaaaaaagaaaagaagaaaacaactcaaggatgattgccact

SEQ ID NO: 76917 - DNA, 201 bp, Homo sapiens
atttttaaaaagttttaagtaggttgcaaatattgcatgggacctaattatgctaaagattattcattgtttatctgaaattcacatttaatttgacatcytgtatttttatttgttcgatctggcaacccttagcaagagaaaatgtggagagactggttatagaccagttattgttgtaaactactaaaagatgtttag

SEQ ID NO: 76918 - DNA, 201 bp, Homo sapiens
tcacttgagcccaggagttggaggttgcagtgagctatgattgtgcaattgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgc

SEQ ID NO: 76919 - DNA, 201 bp, Homo sapiens
ttggttataaatcctatataatgactttgatcttctgttgtatctgatttccttcccccacaagcttaattaaaatttttctctttcaatctttggttttyggaaatttgactatgacgtatctaagtatgtggggtttcatttttgtttttgtatttattcttcatgggttctctgaacattgttgatttgtgttttgtt

SEQ ID NO: 76920 - DNA, 201 bp, Homo sapiens
cacttgagcccaggagttggaggttgcagtgagctatgattgtgcaattgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgcc

SEQ ID NO: 76921 - DNA, 201 bp, Homo sapiens
ctctttggtctcttaccttacccattatcttccttatgaggtctatggaaatgaccttgtgcataagggcaaactgctcttgtgtttgaagcttccagttrttacactctgtcatgctaacttatactcatctttctgaatttttaaaattttagctatttcttcttacttttacagggactatcgcatcctcccattctc

SEQ ID NO: 76922 - DNA, 201 bp, Homo sapiens
gagtgttatcattcgtcagcccatcctcagttttccttgtcaacagcttaaagaaaaatcttttaaaaatacccttaggtggctgggtgcagtggctcacrcctgtaatcccatcattttgggaggccaaggcaggcggatcagatcacgaggtcaggagatcgagaccatcctggctaatatggtgaaatcccgtcttta

SEQ ID NO: 76923 - DNA, 201 bp, Homo sapiens
aataattgctaaaaactttccaaatctaggaagagaaatgaacatccaaattcatgaagtctcaatgtacccaagtacattgaacccaaagaggttaacastgagtcaccttaaaattgaatttgatggactggattaagaaaatgtggcacatatacaccatggaatactatgcagccatacaaaatgatgagttcatgt

SEQ ID NO: 76924 - DNA, 201 bp, Homo sapiens
taaagaaaaatcttttaaaaatacccttaggtggctgggtgcagtggctcacacctgtaatcccatcattttgggaggccaaggcaggcggatcagatcamgaggtcaggagatcgagaccatcctggctaatatggtgaaatcccgtctttactaaaaaaatacacacacacacacacacacacacatgcacacatgcac

SEQ ID NO: 76925 - DNA, 201 bp, Homo sapiens
tacctcagtaaactggcttaaaaataaagaaataaaaaccacccataagcccatcatccaaagaaaccattactaatattttattggatttcttctagtcrtttttcagtaagtgtgtgtatgttggtttgcatacccaagtatacatgcccaaatatatgatctgtgtgttttgtttaaataagctagttccaaaaaggt

SEQ ID NO: 76926 - DNA, 201 bp, Homo sapiens
ttttagtttgctgttggggctggattctttctcttggctagctatttcacatgaacagccaagacaggtgtgtgaatgtgattccaatggaatgcacgtcrttccagaaaagctcagttgttgattctttgtactgaagcctccccttccccgtgcaacctccatccctttgttttcgtcacaagaggaatgaatatctat

SEQ ID NO: 76927 - DNA, 201 bp, Homo sapiens
tcattttgggaggccaaggcaggcggatcagatcacgaggtcaggagatcgagaccatcctggctaatatggtgaaatcccgtctttactaaaaaaatacmcacacacacacacacacacacatgcacacatgcacaaacttagctgggggcatcgtggcatgtgcctgtagtcccagctagtcgggaggctgagacagga

SEQ ID NO: 76928 - DNA, 201 bp, Homo sapiens
agactatggtcagtaattctactgtttagaacacagtgtaactggtaagaattccttcccagacatgagctgtgaccatgaacacatctctcatttccctrcaaagtccttgcagcactcatctcttctgttagcaagaagtccaatatcttcctgtctttctctttggattttctaggagcccagggactaaagcatcca

SEQ ID NO: 76929 - DNA, 201 bp, Homo sapiens
atgcacacatgcacaaacttagctgggggcatcgtggcatgtgcctgtagtcccagctagtcgggaggctgagacaggagaatcactcgaacctgggaggyggaggttgcagtgagccaagatcataccactgcactctagcctgggcaacagagtgagactccatccccaccccccaaaaaaatacccttaaggaaaact

SEQ ID NO: 76930 - DNA, 201 bp, Homo sapiens
aggagaatcactcgaacctgggaggtggaggttgcagtgagccaagatcataccactgcactctagcctgggcaacagagtgagactccatccccaccccmcaaaaaaatacccttaaggaaaactttagtgtgtgagtgaaactaagaattaatactgaaggaaaatgaaagaagctctactccctcttgatgtttggcc

SEQ ID NO: 76931 - DNA, 201 bp, Homo sapiens
tacagatgtggaaactgaggcttagagaattgaaataatgatccagaatcaagtgacagagacaggattcaaacccagcaatcataaccactgcagtcaakgtggcccacctgaagtgtgttgggagtggctggaactgacacctgaggagctctgtgacccagcagaattctgtgcttttcctggggagagcttcttcta

SEQ ID NO: 76932 - DNA, 201 bp, Homo sapiens
ctggggagagcttcttctaagaagaggtggccacgacagccgatagaaggctgtgacctgagtgcaagccacgtgccagccactttctgtatgtgagaccrtgctgcttgccaaaagctgttagttccttccattctggctggctgggagagatttctcatggttgtgcgtggggagagttgacatgtttatgtggaggta

SEQ ID NO: 76933 - DNA, 201 bp, Homo sapiens
ccacgtgccagccactttctgtatgtgagaccgtgctgcttgccaaaagctgttagttccttccattctggctggctgggagagatttctcatggttgtgygtggggagagttgacatgtttatgtggaggtaatgactgtgttggctccttaaggaagaattaggatgagagcccagttccctgtttggggacttgaact

SEQ ID NO: 76934 - DNA, 201 bp, Homo sapiens
tgcaggttaatgtaggaagttaccatcccatgacaattttattttactcttctttcctttgcccattagctactgcaaacttaaaattacctatagtggakagtggtaatagtctacttcaaaaacagcaaattcccagggatttgccctcacttttggaatcttagctaaatatttttttctctatgggatcaccctctt

SEQ ID NO: 76935 - DNA, 201 bp, Homo sapiens
tgggctggactgaatattgccagcaggtagtcataaggacccatgcgatcccctaaatcaatactgaatacaaaggaagctgttgtttctgcttctctggmaggagaataggaagtgaccactggcttgagaagggctgtgctaccaaagtaaaccatcacgggactggttctgaaatgatccaattccctgtctctttag

SEQ ID NO: 76936 - DNA, 201 bp, Homo sapiens
gggctcaaagtttacctttccgtgatctatgagaaaaaaggtttaccaagcaaatgagtgctatatgcaagattgccaaggggagattttaaaccacttayaaggacaaactgcttcccagaggcctgccaatgcttcttaagtactcccttgtgtgggcaaacacagacccaggagacaagcgggaaggacctaggacaa

SEQ ID NO: 76937 - DNA, 201 bp, Homo sapiens
aatacattacctatttaaaaatttaattcgtgggaagggcctcctaaaatccagacataagactatgtagaacttccaaacaaaaagaaagtcgtgttggyattacctgttctattatactgatgttggctcttcctaatcattaattttttttctaagtgctcccaaactatccttaaattgttcatttctagactcttg

SEQ ID NO: 76938 - DNA, 201 bp, Homo sapiens
gcttagaaaatgtttgtggaatctgaactatttaatagtacatgctttataattattacctactgtaacatggccagagggtacaatatttctcactgccytatggatgagatgacctagtctcaggtcaagtgacttgcctaagatcatgcagccacataggaatatggtgctatcctagaaccatggtttccaaatccc

SEQ ID NO: 76939 - DNA, 201 bp, Homo sapiens
aggaagaatcaatattgtgaaaatggcccacagtaatttgtagactcaatgctattctcattaagctaccattgaaattcttcacagaattagaagaaackattttaaaattcatatggtactaaaaaaagagcttgtataaccaagacaatcctaagcaaaaagagcaaagctggaggcatcacgctacccaacttcaaa

SEQ ID NO: 76940 - DNA, 201 bp, Homo sapiens
ttcatatggtactaaaaaaagagcttgtataaccaagacaatcctaagcaaaaagagcaaagctggaggcatcacgctacccaacttcaaactgtactacraggctacagtaaccaaaacgccatggtgctggtacaaaaaaaggcacacagaccaatggaacaggatagagaactcagaaataagaccatacgtctacaa

SEQ ID NO: 76941 - DNA, 201 bp, Homo sapiens
tccctagacatctggcctcaggttgaccaagggtggaaaaccccataccgtgccagtgcagtgggtggggcaccagtgggctggtttatatcaggatttaraacttgtgccccgggtccccacatggtaatacacgtggcagcaaccactacagctggaaaggacgtggtctgcacatgctgcaacgatagacgtctatgc

SEQ ID NO: 76942 - DNA, 201 bp, Homo sapiens
gattaatctaaaccatattgaaaaaagattggttactttaggtctgagaccttaatagcagctgtttagtctgaatttcctgaatgattgcctctttgtaycttctcccgttgtgctaacagggctctgaatcacctaatccatgagcaatgatttaccctgaagaacattgctcactttagggtcttggttcaatggact

SEQ ID NO: 76943 - DNA, 201 bp, Homo sapiens
gaaactattttgaaaattatctagcagataatgaaaactaaccaataaacctctatctgctagaaataaatatatatagaaattaacaaaaatattattgktatatatatgatttttatatgccatgtatatatgtgtatatatatgtgtacacacacacacacacacattcacacacacacgaccatggatagatttttt

SEQ ID NO: 76944 - DNA, 201 bp, Homo sapiens
tcagggagagcagctgcgtcccgggagcacacgggcagtgttcagcccatcgagagctggagcagggagcaggaggaaatggaattgtgaccatagactcytgggactgttcacaggcagggttggtagaacacactgaagttggggcttgttgcctgggaagtcactggcagctctgtgtctccttatcaaacaggagca

SEQ ID NO: 76945 - DNA, 201 bp, Homo sapiens
ataaacctctatctgctagaaataaatatatatagaaattaacaaaaatattattgttatatatatgatttttatatgccatgtatatatgtgtatatatrtgtgtacacacacacacacacacattcacacacacacgaccatggatagattttttttttcttgagacggagtctgattctgtcacccaggctggagtgc

SEQ ID NO: 76946 - DNA, 201 bp, Homo sapiens
gagacagggtttcagaactcttttccgaatagaggttaaggacactgacctaggcagacctaatgtgtgtctcagttctgctccttaccagctagggatcmcatggcaggtaaatgtgaacctaactctgtgtcactaaagtcaatactcttgaccaaggtgccctgttaccttgggcagattacttaatctttgagcatc

SEQ ID NO: 76947 - DNA, 201 bp, Homo sapiens
tgttatatatatgatttttatatgccatgtatatatgtgtatatatatgtgtacacacacacacacacacattcacacacacacgaccatggatagatttkttttttcttgagacggagtctgattctgtcacccaggctggagtgcagtggtacaatcttggctcactgcaacctccgccccccgggttcaagcgattct

SEQ ID NO: 76948 - DNA, 201 bp, Homo sapiens
gtgccctgttaccttgggcagattacttaatctttgagcatcgttgtcctcatctgtaaattgagcgaaataatacctaccccacagtgctcttgtgacaygtgattgagtgtgcatgcagagcatgtagcatagtgcctggcacagatgagcacccagaactgggagctgctctccatcagtatggtggtcctcccttgc

SEQ ID NO: 76949 - DNA, 201 bp, Homo sapiens
agcagcagggatgggagatcatgtatgtgtacgggggagaagggaattcagagctgctggcagtgctggtctgggctatattggtgtttgttttattcattgtgtgtgtgtgtgtgtgtgtgtgtaaaatggatttttctgcatgttcacaataaaatttaaaaagacacaaaatacatatattaaataggttggtcaggt

SEQ ID NO: 76950 - DNA, 201 bp, Homo sapiens
ggctcctctgtttttcaccatttccaatagtttctaataacccaagaaaagcgtcttagaggtcctttagtccagccttctcatattatgtaagaagagaygaacctccagagaggggtcatgactgtcctaagcccacacagcacgtgatagctgagtctgagtgagcctcttctaacttcagcattcttctcaccatat

SEQ ID NO: 76951 - DNA, 201 bp, Homo sapiens
gcagcagggatgggagatcatgtatgtgtacgggggagaagggaattcagagctgctggcagtgctggtctgggctatattggtgtttgttttattcattgtgtgtgtgtgtgtgtgtgtgtgtaaaatggatttttctgcatgttcacaataaaatttaaaaagacacaaaatacatatattaaataggttggtcaggta

SEQ ID NO: 76952 - DNA, 201 bp, Homo sapiens
tggacagaaaaggaatagcctggttggtccaaatctgccattgaaaggcatctggaggacagagtccatcagcttccctcccactctgaaactaattaccrcacacatgccatttaaagacacgtgggtatggtatggtgaactccatagtctcagtgcaggtcaggtgcctggtcagaacctgcactgaatggcctataa

SEQ ID NO: 76953 - DNA, 201 bp, Homo sapiens
cagcagggatgggagatcatgtatgtgtacgggggagaagggaattcagagctgctggcagtgctggtctgggctatattggtgtttgttttattcattgkgtgtgtgtgtgtgtgtgtgtgtaaaatggatttttctgcatgttcacaataaaatttaaaaagacacaaaatacatatattaaataggttggtcaggtaa

SEQ ID NO: 76954 - DNA, 201 bp, Homo sapiens
tatttgtcccatttgatttagctgaaatacgtctcatatatatgagagagacagagagagaggaggctgggggaggtgggtagggtagagtgcctactcckctaatgccgtagaatgtttccaaaaaagagaagaagatgcattttggcctccaagcctgtgtggggccagagacaagttaagtgtgtctgctaagtagag

SEQ ID NO: 76955 - DNA, 201 bp, Homo sapiens
gatcaccaagagaatgagagtagatagagaaaatttccaaggaccaagtcccgggacactgctatgctgaagtttgggagcatgaggaggagacagaaaaragaattgaaaagggataggggagaatagagagtcccagaagtcaagaaagcatttcaaaggggcaggacaatcaattgtattagatgccactgataagtc

SEQ ID NO: 76956 - DNA, 201 bp, Homo sapiens
acccattaacttgtcatttacattaggtatttctcctaatgctatccctccccctgccccccaccccctgacaggccccaatgtgtgatgttcctcgcccygtgtccaagtgttctcattgttcagttccaacctatgagtgagaacatgtggtgtttggttttctgcccttgtgatagtttgctcagaatgatggtttcc

SEQ ID NO: 76957 - DNA, 201 bp, Homo sapiens
accctctcacctcagcctccctagtaactggcactacaggcatgcaccgccaaacccagctaatttgtttgatttttttgtagctgtgaggtttcactgtsttgcccaggctggtctctaactccagaactcaagcaatcctcccgccttggcctctgaaattgctgggattacaggcatgagccaccacacccggccacg

SEQ ID NO: 76958 - DNA, 201 bp, Homo sapiens
tgggatcactaggtcaaatggtatttctagttctagatccttgaggaatcgccacactgtcttccacaatcgttgaactagttcacgctcccaccaacagygtaaaagtgttcctatttctccgcatcctctccagcatctgttgtttcctgacttttaatgatcgccattctaactggtgtgggatggtatctcattgtg

SEQ ID NO: 76959 - DNA, 201 bp, Homo sapiens
cacaatcgttgaactagttcacgctcccaccaacagtgtaaaagtgttcctatttctccgcatcctctccagcatctgttgtttcctgacttttaatgatygccattctaactggtgtgggatggtatctcattgtggttttgatttgcatttctctgatgaccagtgatgatgagcattttttcatgtgtctgttggctg

SEQ ID NO: 76960 - DNA, 201 bp, Homo sapiens
gcagccaacaaacatatgaataaaagctcaacatcactgatcattagagaaatgcaaatcaaaaaccacaatgagatgctatcttacaccagtcagaatarctactattaaaaagtcaaaaaacaacagatgctggtgaggttgcagagaaacaggaacgctttacactgttggtgggaatgtcaattagttaaactattg

SEQ ID NO: 76961 - DNA, 201 bp, Homo sapiens
catggaatcaacccaaatgtccatcaatgatagagtggataaagataatgtggtacatatataccatggaatactatgcagccatagaaaggaatgttatyatgttctttgcagggacatggatggagctggaagtcattgtcctcagcaaactaatccaggaatggaaaacccaaacaccgcatgttctcacttataagt

SEQ ID NO: 76962 - DNA, 201 bp, Homo sapiens
caggatggtctcggtctcctgaccttgtgatccaactgcctcggcctcccaaagttctgggattacaggcgtgagccacagtgccaggccatttttttttycttttttgagacaaagtttcaaaaaagtcttgcccaggctggagtgcagtggtacagtcacggtttattgcaaccttgacttcctgggctcaggtgtttc

SEQ ID NO: 76963 - DNA, 201 bp, Homo sapiens
atttagaagctcttccaccatgcttccataatatcctggccatggctatatcacaactactccactgcactgtaactgtttcatagcccatctatctctgytagaacactaagcatcctggaccacaaaggtcatagcccagtccccacaacaccatgaatgcttataaaatcattgtaaaatgattcttctcaattgtct

SEQ ID NO: 76964 - DNA, 201 bp, Homo sapiens
aggtctaggaagtgcttccccatgtcctacccaacttgccttttttggggtcctatcccatttattctggccccttgattttaataaagaagaagaactamccaccattctctgttagttaacaaaatttgaaaccaaaccaacaaacattgcgtgctaggggagttcagtgttatcaaataccatgatgagggccaattg

SEQ ID NO: 76965 - DNA, 201 bp, Homo sapiens
ctggaatcgagaattgaaggctgagctgagggaggagctgggtggagagtgaggagaggagtcatgctaaggttttgctatggaagccggcttggcgtgtyctaagaacaggaaggaagccagtgtggctgagatggagtatacaaaagattgcatggcaagagataaagttggagaggagtcaaagcccggatcatggta

SEQ ID NO: 76966 - DNA, 201 bp, Homo sapiens
ctgctatttgactctttctcagacatagttgaacctgggctttagccttccactgccacctccaccccccatcaagtcaatctctaaatcccactctgccrtgagtccttttgtctgggaccagctcctatctgtcatgcaatttaagctgccctggtttactgaagtcattcgtggaaacaggctcccccaagtgacttc

SEQ ID NO: 76967 - DNA, 201 bp, Homo sapiens
ccagcccgtgtaaacctccttaaacatagcttgaactttccacttttttgtttgcctagaatatcttttcctgtatctgtttaagccttattaatcaaaastatttataagtgaatgttaacagaaatatgaaccaaaacaagatataaaacttatatataaaatgagataaatgcctgtcactggggaaatggctaaaca

SEQ ID NO: 76968 - DNA, 201 bp, Homo sapiens
caacaatagaaaactcattaataagtatttagtgagtacttcccatatgcaaggcggggccttaactcttctgtttgaagccataaataaaatgggctgtracagagctttcacatcatgaagctatgttcactgtttctactggcacaccctccttgcccagaccaaagcggctaccctgggctgttagatcaatgtcca

SEQ ID NO: 76969 - DNA, 201 bp, Homo sapiens
tgctgatcaccatgagaatggcaccaagacattcctgagggatctgcccctatgacttatacacctcccaccaggctctacctccaacattagggatcaatttttttttttttttttgagacagagtctcgctctgtcgcccaggctggagtacagtggcgcgatctctgctcactgcaagctctgcctcccaggttcatg

SEQ ID NO: 76970 - DNA, 201 bp, Homo sapiens
aaaatagacagggtctcactctgttgccccgactggggtgcagcggcatggtcataactcacaacagccttgagctcatgagctcaagggatcctcccacstcagcctcctgagtagctgggactactggtgtgtgccacagcatctggctaattttttttttttaactttttgtagagaaggggatctcattttgtttcc

SEQ ID NO: 76971 - DNA, 201 bp, Homo sapiens
tgggcatcagccatgccatttcctctccttgtctcttcactgctgtgagtaagggcttcattagagtcgcttcctttgaaccatccaaggggaattgtttyctgctgcaatcctcagtggtagaggggtcaggccaacatccgaagttaaacatggagatgcctgggtagaacctgcccttcgctccttgggtctcactcc

SEQ ID NO: 76972 - DNA, 201 bp, Homo sapiens
ctttggaggagaagaggtactctgatttttagaattttcagcttttctggtctggtttctcctcatctttgtggttttatctacctttggtctttgatgayggtgacgtacagatggggttttggtgtggatgtcctttctgtttgttagttttccttctaacagtcagaaccctcagctgcaggtctgttggactttgct

SEQ ID NO: 76973 - DNA, 201 bp, Homo sapiens
ggtgttcttgctttagggtcccctctgctctccattagaagtcctggctgggggctgtgtttgcccttcttcatcatgctgtgggaggagagtgggtttgyctgctggcttccttttacttttgtttggtccattttctgttcagatggtctagagcaatctgcaggtccagcatattgtcctaggtcatgagttgaacaa

SEQ ID NO: 76974 - DNA, 201 bp, Homo sapiens
tttctcccagtctgtggcttgtttttactatgactgtggtatcatatgttgaatcaaattgatattcttttgatttttttaatggaatttacttgtaaaamatgggcttgatatgcattctgcagcagtcagtgtagtgttattggttttttagatcaagtttgctaattgtggtttcacatcttctgtatacctgctgat

SEQ ID NO: 76975 - DNA, 201 bp, Homo sapiens
agttcacccaatctccctgacaatgcctagaatggtgttttgtacattgcagataccttagttgggactggtgcttttgcaggattagaaattcactccarcttactcaaataacaagagatttattttaagaaagcaagagacaagctcctgggtgtaggaaatgaaatataaccaggcctcttgggaactggagctaga

SEQ ID NO: 76976 - DNA, 201 bp, Homo sapiens
caccaacagtgtaaaagtgttcctatttctccgcatcctctccagcatctgttgtttcctgacttttaatgatcgccattctaactggtgtgggatggtayctcattgtggttttgatttgcatttctctgatgaccagtgatgatgagcattttttcatgtgtctgttggctgcataaatgtcttcttttgagaagtgtc

SEQ ID NO: 76977 - DNA, 201 bp, Homo sapiens
cttcatgtccctcccacaagaccctaaacaaaggatgtttttgccattgttttttttcccctagtccgtctcccaatcccaaccccaaatacacacacacrtacacacacacacacacacacattcactcactcctcaataccctcacctccccagcctcatcaatactttcatcactggtcttcactgcaaaagtgattt

SEQ ID NO: 76978 - DNA, 201 bp, Homo sapiens
tcatgtccctcccacaagaccctaaacaaaggatgtttttgccattgttttttttcccctagtccgtctcccaatcccaaccccaaatacacacacacgtmcacacacacacacacacacattcactcactcctcaataccctcacctccccagcctcatcaatactttcatcactggtcttcactgcaaaagtgattttt

SEQ ID NO: 76979 - DNA, 201 bp, Homo sapiens
actgcccaagccagaggcccccacttcccctcccctttcctcctgtgcctctcctcccctcctcttaccccctccttcctgcctccctccctgtgcatgcktgtgtgtgtgtgtgtgtgtgtgtgtgtgtgtgtgtgtgtgtgtagtccagcacagcttattttttcagggagccttccacctgctgttttctctccctac

SEQ ID NO: 76980 - DNA, 201 bp, Homo sapiens
ctgcccaagccagaggcccccacttcccctcccctttcctcctgtgcctctcctcccctcctcttaccccctccttcctgcctccctccctgtgcatgcgtgtgtgtgtgtgtgtgtgtgtgtgtgtgtgtgtgtgtgtgtgtagtccagcacagcttattttttcagggagccttccacctgctgttttctctccctacg

SEQ ID NO: 76981 - DNA, 201 bp, Homo sapiens
tgccaggggagcccggtgccggggctctacgtccagggcacatccagggcacgatggagtgggaaactgtgctgacggagttgaccagaacgtgttttttkttttgttttgttttgctttttgatggaaaatctaaaatgccaggctgaggactccgatttttttcatagacaatggaaaagtgtttgctggagttcccag

SEQ ID NO: 76982 - DNA, 201 bp, Homo sapiens
aacagtaaaggcaaagcctgcagaccaaggctaagcttggagactcttatccacactattcattggatgctgatcaggtactgtctgatcttaccgcatcrcacatatatgtgtgttcccagtgttagaatagactaggctctgctggggtaataaattcatctcaatatcttggttgcatcacataaagtcatctgtgtt

SEQ ID NO: 76983 - DNA, 201 bp, Homo sapiens
attgcctttctttctggcttataaggggtggaagagaagcatgagtgactagaatcggcttatattcctccagaaggttgtttcctcattaaaaaaaaaaragagagagagagaaagggagaacaggactggatttggaatcgtaggtgttttcattgatccttcaccctcagattatcttttgtatggtcatttcttttg

SEQ ID NO: 76984 - DNA, 201 bp, Homo sapiens
gtgcattgatgcacaccctgcttaccctatatctcacacacatgcacacacttgtacacatgcatgcatgcacatgtgcacgcacgcgtgcgcgcgcgcgcacacacacacacacacactctctgcttaccctgtaccaaacactgttctaagcactttacatatatcagtatgtttaatccttaaaacagccccaggagg

SEQ ID NO: 76985 - DNA, 201 bp, Homo sapiens
tgcattgatgcacaccctgcttaccctatatctcacacacatgcacacacttgtacacatgcatgcatgcacatgtgcacgcacgcgtgcgcgcgcgcgcacacacacacacacacactctctgcttaccctgtaccaaacactgttctaagcactttacatatatcagtatgtttaatccttaaaacagccccaggaggg

SEQ ID NO: 76986 - DNA, 201 bp, Homo sapiens
tggcatgatggtgtgggtaatgggggtatagggggaaggccagcagtggatgagtgttgggagatgaagtggtccagacgggtaggtgcggactcgatcawgaaagaccctgtatgtcatatatgacaatttggtcttcatcctaagaagagtaggcaaccacagagtgggactaacttggtgagattgtttcaaaatggt

SEQ ID NO: 76987 - DNA, 201 bp, Homo sapiens
tttccaccctacccatggcactaccagggcaacagcatgacaccaggtacccagacagtccctccacccaccccccattcccaaatgaagggcagcccagwtggttgtgctgtcagcaaacattgctgtttgcaaaggcatgacctgccttagggagaggtaaggggaagagcaggcacttttgcttgggcatcttcttgt

SEQ ID NO: 76988 - DNA, 201 bp, Homo sapiens
gggggagttggtcaggaaaggtatttcaaggtggtagctttatagctgagacccagatggcaggagggagcaacccacaaaaagatctagaaggagaactyttaggaagatggaacagtaaaggcaaagcctgcagaccaaggctaagcttggagactcttatccacactattcattggatgctgatcaggtactgtctga

SEQ ID NO: 76989 - DNA, 201 bp, Homo sapiens
attttttctatttttattttgtactcattaaccattcccacttcctgcccactcccctactgtccttcccaggctctggtaaccacccttttactcttaawggattattttcatagtgctcttgacagctgggttgatctggatatttttggaagctcacgaagtaatcaaatccactggttttttttttttttttttttt

SEQ ID NO: 76990 - DNA, 201 bp, Homo sapiens
gccactctgctgctcgtccctttctaagatgctaagaggatgtggcctatgggagaaggggagccgtctaaggaaattgcccccatgctggaagtgggaayggcagggaagagggccctattttccattgaagaaaagccgggacaaatgcttcttttctctttcccaggaatgaagcaccttttgaaaggtgtaaatcct

SEQ ID NO: 76991 - DNA, 201 bp, Homo sapiens
tacctctctgatcttccctcctgcttatcttgtccaaactgcaggtttgttttcacaaccttccattcattgaaatgccactctgctgctcgtccctttcwaagatgctaagaggatgtggcctatgggagaaggggagccgtctaaggaaattgcccccatgctggaagtgggaacggcagggaagagggccctattttc

SEQ ID NO: 76992 - DNA, 201 bp, Homo sapiens
atggctagttggggtgggtttcctaggtgaagtgatgtttttgagcaagactttgaaggctcgctcaaagacaagtagagttgctgagaagaagttgtackctgtggaggactgacatttctagatggacagccgctcactttcagccaagaccacttgtcctcccactgcccccagagaagggcagctccccacagagtg

SEQ ID NO: 76993 - DNA, 201 bp, Homo sapiens
tggtgtccttgggtgggcgcttgctgcctgctttggtgccacatgcccgcttcccagaggggcccatggaggggatggtggcctctagagtaaaggccccyccagccttctcttaacatgtccccacactttcactgggattaatcgctcccctgtgtgcttctgtggtccttaaatatacctctattttatgatgagtga

SEQ ID NO: 76994 - DNA, 201 bp, Homo sapiens
cttctaagaatcttcagtttccctagggaaaggagaggagaaagggaacaaacatttgttggtcacctgagtccatgccaaatgtatatattaacaaaatygttgtgaagtagcaattgttgttagattattattcccattttacagaaacagaggcttgcggaggtgaagctggggctccagttgagatctgtgactttg

SEQ ID NO: 76995 - DNA, 201 bp, Homo sapiens
tagaccagcagatgacatggttctaagaacagttatctggaatccgagggacctttgcatccctggtttgcagagctctttgcaaaatggagctgtttctstcttctaagaatcttcagtttccctagggaaaggagaggagaaagggaacaaacatttgttggtcacctgagtccatgccaaatgtatatattaacaaaa

SEQ ID NO: 76996 - DNA, 201 bp, Homo sapiens
aaaggaaaagggatgagctgtcctagagactggcagactctgtgctagaccagcagatgacatggttctaagaacagttatctggaatccgagggaccttkgcatccctggtttgcagagctctttgcaaaatggagctgtttctgtcttctaagaatcttcagtttccctagggaaaggagaggagaaagggaacaaaca

SEQ ID NO: 76997 - DNA, 201 bp, Homo sapiens
atcctggtgggtgacgaggggaagtgtacctgtgattcttggcctgagagcccatggacagaagtctgctgcccttgtatctttgctgtttgtttaaagtrgatagcattcatgctcttccccccttttctttctctccttttttcttctttctctttcaattttttcttcttttttctcctctcttgccatgagcagatg

SEQ ID NO: 76998 - DNA, 201 bp, Homo sapiens
aactgaacaaccactgtgcaaaggaaaagggatgagctgtcctagagactggcagactctgtgctagaccagcagatgacatggttctaagaacagttatytggaatccgagggacctttgcatccctggtttgcagagctctttgcaaaatggagctgtttctgtcttctaagaatcttcagtttccctagggaaaggag

SEQ ID NO: 76999 - DNA, 201 bp, Homo sapiens
cctggtgggtgacgaggggaagtgtacctgtgattcttggcctgagagcccatggacagaagtctgctgcccttgtatctttgctgtttgtttaaagtggrtagcattcatgctcttccccccttttctttctctccttttttcttctttctctttcaattttttcttcttttttctcctctcttgccatgagcagatgag

SEQ ID NO: 77000 - DNA, 201 bp, Homo sapiens
ctggggaaataaacagctgcagcttgaaacacaaacacagacacttgtgctgctgtgtgttccccctcccaccatccctcctccctgatctgggaaaagcrcacacacccaaaccatgtagaaacgcagaaacccatgtgcataaactgaacaaccactgtgcaaaggaaaagggatgagctgtcctagagactggcagac

SEQ ID NO: 77001 - DNA, 201 bp, Homo sapiens
tagtggtgcctctccatcctctcagggctcttggttgtccgtgattacattgaaatccagggctgtgatgtgggttgagttggatactgcttatgagagaycatcagaacttgggtgacaggggaactgctgaaaaacggaactcatgcatcctgtcccccttcccaattctcttgcttcctatccactgcagctttggag

SEQ ID NO: 77002 - DNA, 201 bp, Homo sapiens
atactgaatacaaaggaagctgttgtttctgcttctctggcaggagaataggaagtgaccactggcttgagaagggctgtgctaccaaagtaaaccatcaygggactggttctgaaatgatccaattccctgtctctttaggatgaatctctttaatccaagtaccattaaaatggaatgtagtgatcattcagattcaac

SEQ ID NO: 77003 - DNA, 201 bp, Homo sapiens
cacttagtgagttactttcttctctgattgtcagagtgaaaggtgagtaagatcacttctctcagggagctcacagtcatatgcactgagtcacatgacayagagtggagagtgatgagcgtaatggcaacagcatgaaccaagtactgagggtgcatggaggaaggttgtttaactcctagcttctgtcttcattaagaa

SEQ ID NO: 77004 - DNA, 201 bp, Homo sapiens
tagaagctgactactaggtttaatcttttcatgaactaggagtcttcattaggtcaatgtaccagattaggaatgaccacaccaggagaggtgccatctayttatctattaatcaatattaacactgaagttttaggccaactgtaaagagctaaccaactgtgaagtgtgggaacttgatctacacttctgacagcaatt

SEQ ID NO: 77005 - DNA, 201 bp, Homo sapiens
catttgcttttggggtcttagtatgaattctttgcctaagccaatgtccagaagagttttctgatattatattctagaaatgttatggtttcttagatttmagtctttgatccatcttgagttgatttttggatatacttgttttctttcagtctacttagaataaatattttaccacttcaaatgcagtaaagaagcctt

SEQ ID NO: 77006 - DNA, 201 bp, Homo sapiens
cattgatgcacaccctgcttaccctatatctcacacacatgcacacacttgtacacatgcatgcatgcacatgtgcacgcacgcgtgcgcgcgcgcgcacrcacacacacacacactctctgcttaccctgtaccaaacactgttctaagcactttacatatatcagtatgtttaatccttaaaacagccccaggagggta

SEQ ID NO: 77007 - DNA, 201 bp, Homo sapiens
gtgcccttggctgactcctgatttgcactaaaacttgcagcatttagtgcttacatgttcaaaaatccttctggaaagctaggaggaactggaagccgtgrtctacatgctctgtcctcttttaacagaaaaggtgtattccataagtaacctccagtaaaaagagaaagaatagttgctatttattgggttcctctgatg

SEQ ID NO: 77008 - DNA, 201 bp, Homo sapiens
gaattctccctcttggttcttcctgggcatcagccatgccatttcctctccttgtctcttcactgctgtgagtaagggcttcattagagtcgcttcctttgaaccatccaaggggaattgtttcctgctgcaatcctcagtggtagaggggtcaggccaacatccgaagttaaacatggagatgcctgggtagaacctgcc

SEQ ID NO: 77009 - DNA, 201 bp, Homo sapiens
acaacacactcacaatttgtctgtctgcttccacttctgtctctgtgccgcactcccccccacaccattcactttctgtgattttttaaaaatttaatttygtcacatccttcccctgttcagaaatctacaacagcttcccgttgtacttcctgtggctcacagagccacacatttactctccggccttcctctccaatt

SEQ ID NO: 77010 - DNA, 201 bp, Homo sapiens
cctgttcagaaatctacaacagcttcccgttgtacttcctgtggctcacagagccacacatttactctccggccttcctctccaattccccctcccagtayttccaccaggctcaggatgcttcgcttgtgtggactggccagttccttgcacagccttggggctctccatcaagactttgcccaggctgatgcgtccccc

SEQ ID NO: 77011 - DNA, 201 bp, Homo sapiens
acagcttcccgttgtacttcctgtggctcacagagccacacatttactctccggccttcctctccaattccccctcccagtacttccaccaggctcaggaygcttcgcttgtgtggactggccagttccttgcacagccttggggctctccatcaagactttgcccaggctgatgcgtccccctagagctctccccagccc

SEQ ID NO: 77012 - DNA, 201 bp, Homo sapiens
aaaaatacaaaattagccgggtgtggttgtgtgcgcctgtagtcccagctacttgggaggctgaggcaggagaattgcttgaaccctggaggtggagggtrcagtgagcagagaccatgccactgcactccagcctggcaacagagcaagactctgtctcaaaaaaaaaaaaaaaaagcagagaagtttgttccaggatgt

SEQ ID NO: 77013 - DNA, 201 bp, Homo sapiens
atatttatataagtatttatataagtaatataaatttgtatatataaatatatttatataagtatgtgtaatatatacttaaaaaataaaatataatatamatatatatatttatattatatataacataaatatttatatataatatatttatatttatctataatataaatatattatagataaatatacttatatata

SEQ ID NO: 77014 - DNA, 201 bp, Homo sapiens
agggaatgtcatgtccctccctttccagggtgccatgaacatagggcagtaggagtgaggaggacagggtgccatggggactgatgttatggaagaggggracttgagctgggtcaggataggatgagggtagaagctggaggatagcacaggagagagggacaacgtgcgcaagtcgagtatggagatgacggtgagggg

SEQ ID NO: 77015 - DNA, 201 bp, Homo sapiens
tgagacaggaggattgcttgaggccaggagctcaagatgagcctgagcaacataatgagaccctgtctctacaaaaaggaaaaagaaaagaaaagaaaagaaaaaaaaacagtagagtgtagtgttgtacacctatagtcctagctacttgggaggctgaggtgggaggattgcttgagcccaggagtctgaggctgcagt

SEQ ID NO: 77016 - DNA, 201 bp, Homo sapiens
gccagaccattcatttgttatttcagtaaatatttactggaagttcaccagtctgtcctccaggaagtggatcagtagatcttgccaactcaagtctccctagctttgatgtgggacgggagaaagagcagggactgagtctcctttaaacacaaagaaatgaagaaaactcggagccaaatgtgccttactgatctgtcc

SEQ ID NO: 77017 - DNA, 201 bp, Homo sapiens
tacaatcgacacttgcaattctttttatgccagacgttgtcagcccaaagcatagttggcttcccttgctcttgggaaaaggggatccctgggcacagtcrtaaaatatgggctgaggaaataaatagttatgaccttcccctgctgtgctcttacataagtatgtactaatgggctgtttctagcggaatctttcactta

SEQ ID NO: 77018 - DNA, 201 bp, Homo sapiens
cttccaatgacaggattgttataaaaacagcattcttttatgcccacccatttaaaagctatgctattataaaaagtaaagaacgagttgctctcaccagkgcgcatggtgggtatgtgacctgttgagctgtgaatgactggttggtgatgctgcagaagccacatgggcggggtggatgcagattctaatagatattat

SEQ ID NO: 77019 - DNA, 201 bp, Homo sapiens
tctagaataccatgggaatgggtccttgccctgggccagtaaacatttgagactcagagccaggagataggatgagaagattgcagtgatgagacccacaragggcagcagccatctcttaaggggtcaacttggagaccaaatccatcacttcttggaggtccagtagcccctgcaccctctgcgctttgcagagacatc

SEQ ID NO: 77020 - DNA, 201 bp, Homo sapiens
tctacctgccactggcctcagtgaattctaatagtgtctaggccatgccctgcatgcctccttacatagagagggatctaagtgaggctggttaaatgctrccaagattgttttcagaactgaggtcctgatagcacctgataggagacacactggttgaacaaacaattaaagagcttgcactatgtatctgacactatg

SEQ ID NO: 77021 - DNA, 201 bp, Homo sapiens
cactcccatcttgcaggtggataacgtaaacaagagtgagaaagccagaccattcatttgttatttcagtaaatatttactggaagttcaccagtctgtcstccaggaagtggatcagtagatcttgccaactcaagtctccctagctttgatgtgggacgggagaaagagcagggactgagtctcctttaaacacaaaga

SEQ ID NO: 77022 - DNA, 201 bp, Homo sapiens
gagaacccaaaggccagatttccagtgggttgacttctgcccatgaagaccaagtgccctctaagctctttggtgaacttaccaatcttatttagaagataaaaaaaaaaatgaggaatgtgataactccatgaggccccaagataatatggaggcctgagccacagggtaaatttagattttattgcctttctttctggc

SEQ ID NO: 77023 - DNA, 201 bp, Homo sapiens
tttagattttattgcctttctttctggcttataaggggtggaagagaagcatgagtgactagaatcggcttatattcctccagaaggttgtttcctcattaaaaaaaaaaaagagagagagagaaagggagaacaggactggatttggaatcgtaggtgttttcattgatccttcaccctcagattatcttttgtatggtc

SEQ ID NO: 77024 - DNA, 201 bp, Homo sapiens
agattagaaaagttggaagttctctaacaggtgcacacatcctgttagctagtaattaggtttaagaatgaaataaattattattgtttatttcaatttaygcatattttccccaatggctattaatttgttaggacataaatatttattaagttatttggacttaactacttaacacatggaactgttaagtatttcttt

SEQ ID NO: 77025 - DNA, 201 bp, Homo sapiens
ccgccagccctcacatggtcactggattggttcgagtgggctctaaggcaactgccgtgtgccagtctgttgacatgatcaacattaatattcttgcggcggggggggggtgttcattaaattaaggaatgacacagggagccaagagaatggcttatttgtttggattctgaatcacaatcgggaaatagtctttatctg

SEQ ID NO: 77026 - DNA, 201 bp, Homo sapiens
catttgccttggctattgtgaaccatgctgctttaaacatgggtgtacacatatctgttcaaatctctacttttcctctctgcttttaaacttgcttaggwtggtctgggaagcttagatttatgggctgggaagggtctgttcagggtctttcctcctaaaacacagttccggagtcccaggccaggactctattcggat

SEQ ID NO: 77027 - DNA, 201 bp, Homo sapiens
ggttttagaatgctagtctaacatctgttttcgtttccttgttaattccattcatccccacaccctcctggccttatccccattcctgactccaaagtgawttcctcagcaaagctttatttaaaagatgagagagatcctgcattttgaactggcttccagagcttgtttttggggatttctccaccaccctccaatcgt

SEQ ID NO: 77028 - DNA, 201 bp, Homo sapiens
ggggatttctccaccaccctccaatcgttgttggccagccagctagtcaggtgatcactctaaggtcccaaccttgacaaatctgtgtatttcggtgcagktgtcttgctaccgaccagcacttgccggcctcctagggcctgcaggaacctactgggcaccaaggacaatggcagtggacagggttgaatcagcaagaac

SEQ ID NO: 77029 - DNA, 201 bp, Homo sapiens
gtgagaaggcaggaccatggtcgttgctggggagatgctaggagatgaagctagggaggcagattggaggcagattataaagcacctgtatgcaccggtagggactttggattatattcagtgaacagagtggagccaacaggaatttttataagcaggtagataacagaatcaggtgagaggggctgtgtgctggataga

SEQ ID NO: 77030 - DNA, 201 bp, Homo sapiens
catcctgggagaatggtgacaagaaaccccgtcaggaggctgttgcaatggtccaggtagggctggactctttccagctgtctcatgggcatgggctgtgccaccatgcttttgctcacactgcttccatagcttagaaggtctctttgacttaatcctcaagaaaactgcatgcccatctttccagactgtgctgaggga

SEQ ID NO: 77031 - DNA, 201 bp, Homo sapiens
aagttccgtatgattgccaggaactgtggtgagaaataaggcaaatgggtgctactcagccaaaacaaccaatgcccaggacaccaggtattgtgaatatrtgtggatcagattgagctttcttgtatctgccttcagagtcactggattttccggccagctataaggctctgatagttgtctccccattattcccatgca

SEQ ID NO: 77032 - DNA, 201 bp, Homo sapiens
ttgtttgtggcccgttttagaaaaaaatctgacaccgagtggcagaattatcagtgggcacatgcatagaaagtgcactttcattctatatttctgccaaraaaatttatttgcagaaaataaatcatcccaagatcaagctgaagtgactttgaagcatccatcatttttccttcctctctcagtaccagtgaggattac

SEQ ID NO: 77033 - DNA, 201 bp, Homo sapiens
gaggacatctgagccctgagtctctctcctctctgtacctcagttttttcatctgtaaaaatggagactttggaataaaaaatcttcaaagattcttttcttttttttttttaaacttcaggtttaatggcatgtcatttattaatctagttctacaaaaattctaaacattacaggtaaccactccacctctgttttgcc

SEQ ID NO: 77034 - DNA, 201 bp, Homo sapiens
tctctgtacctcagttttttcatctgtaaaaatggagactttggaataaaaaatcttcaaagattcttttcttttttttttttaaacttcaggtttaatgrcatgtcatttattaatctagttctacaaaaattctaaacattacaggtaaccactccacctctgttttgcctccaccctaacccctgcccaaccccaggc

SEQ ID NO: 77035 - DNA, 201 bp, Homo sapiens
acaggtaaccactccacctctgttttgcctccaccctaacccctgcccaaccccaggcatccttccaacagtaatagggtgatacttacgggtgaatgttytctaggcatttttctatgcattaacatagtattaacttgtaggacttttaaggtattgtttcatgggtttgttttataatgaaatatattttgagttaat

SEQ ID NO: 77036 - DNA, 201 bp, Homo sapiens
caaaagctggggtgagttaatagcagaggtggaaccagaattagattatttatggattcttttcagactggaaaaaagaggggtgagcagtggctcgcatmccgaggtcagtgagcagctgttcctgcagagatgcagctagagaacaagagaaatggactttcattgtagcagtagggattgggctgaacccagggaagg

SEQ ID NO: 77037 - DNA, 201 bp, Homo sapiens
gcttcccttggctaggaaagggaattccctgaccccttgcgtttcccgggtgaggggatgcctcgccctgctttggctcatgcttggtgcgctgcacccaytgtcctgcacccactgtctgacaagccccagtgagatgaacccggtacctcagttggaaatgcagaaatcatccgtcttctgcatcgctcatgctgggag

SEQ ID NO: 77038 - DNA, 201 bp, Homo sapiens
tttttggtacttttgagatttgctttgtgacctggaatgtgcttttttttttttttttaagttccatgtgtacttgaaaagaatgctgaccaatgatcttaagattcttttcaacttggtgagtcagtcgttccatatcaatgtcaaataaccctgcctgatctggcatgttgttcaaagtcgtagttaaaagggcctaat

SEQ ID NO: 77039 - DNA, 201 bp, Homo sapiens
cataaattttctcctgaatttgggcatctgcactgagtttagagaatttgtggcaggaaatttgccctggaaatgtactcagctgaatacttgcacttctyagcatggaaagactcccatccaagaatctcagcatgcttgtctataaacatgaatgaattaatcctcctagcaccactgtgtgctctttgccagctgggt

SEQ ID NO: 77040 - DNA, 201 bp, Homo sapiens
gtctgggccagggtattgagggggtctctggatattttgaggactttggattgactccgaatgagatgggaagtcaccagggctctgagcagaagaccacaggatgagtctaatatttctgaatgctcactctggttgcttagtggagactagaccgtgggggcggggacagagtggggagccagtggaggcagttgcagt

SEQ ID NO: 77041 - DNA, 201 bp, Homo sapiens
aacgaggagcaaagataaagtcacaggaaatatctataattagggattcaaactagaaggaagatggttcctaagtaagtcaggtaaggatcaaacagacrtgaggagtcctcgtgcagtggttacaggcactttgtggggttgagtgggtggatcacttgaggccagcagtctgataacccctttatcattttttattgc

SEQ ID NO: 77042 - DNA, 201 bp, Homo sapiens
aatcagccttcccttatagctcttctgaggactagccccccattcccgatgctggtgagccgatgatgggcagtgtgtcgtgcttgctcccatgatctatycccaccataattcctgctcctccaaaagcaaccccactgtcactcagccctcctcccctcttctttcacttccaagctcagcaagcccctctgttctgac

SEQ ID NO: 77043 - DNA, 201 bp, Homo sapiens
tcctgcagttcagggaagaaacggagctgaagggcatgtggaagaagaatgtcacggagatgcaaggggttgggttattggttggcttaaggtcaaatcaytatttgctgcctgaagaaaaaaaaaagaccttgcttagggacagaagtccttgtcctggtcttaggtcagatgagggggtaaaggaactcttccaactgt

SEQ ID NO: 77044 - DNA, 201 bp, Homo sapiens
gagctgaggttcaaactacagcagtatggaacactgcatcatttgacaataggctttacctgatttggggagagtgcggtgaccagtgggaggaagttgtwattgcaaggagcattgatgacacggagattccaggcctatcaaaggaagcaatccccagggatgactgccagtgtgggtggtgttgacatttgcaggaag

SEQ ID NO: 77045 - DNA, 201 bp, Homo sapiens
aagtacagatggattcctccctgaggcagaagctggggtctgtgggatgaagcacagacacaaagccattgtcctgccacccagcagtggagtcggagatrgatggcatgaatctagaataccatgggaatgggtccttgccctgggccagtaaacatttgagactcagagccaggagataggatgagaagattgcagtga

SEQ ID NO: 77046 - DNA, 201 bp, Homo sapiens
ctgccagtgtgggtggtgttgacatttgcaggaagcagtgacagtccatggtcaaggttgagggctgcctccaccgccaagacacccacttggctccaacygtgctatctccaggcccactggctgctcatggctggttcaggacccacttgtttttcttcctcttttttaaattaaaagaaacatttttgtatcatcata

SEQ ID NO: 77047 - DNA, 201 bp, Homo sapiens
aacagtgtgcactcctatccctgagtgatctagcactcgccctgaccagtgctttcgaagaggacagtggtggtggtattcccctcagaagacatgtcctygagccaccctgcatgctttctcttcccctaactcttcccacactgtttgatttcaggtttgtgggcaggcctggaagctacgtctatgtattcgatggtt

SEQ ID NO: 77048 - DNA, 201 bp, Homo sapiens
acccaaggctttcacaccatagtccaatctccttttgaaatcgtggtttattcttcatttttctgccttgtaagtcatgagctttcttcctcaaagtgaggtttggttctggatgtttgaattactgaacatattttggagctgccattgaagaataatagaaatagttttcacttgcattaataagtgccataaaatatc

SEQ ID NO: 77049 - DNA, 201 bp, Homo sapiens
aattctttttatgccagacgttgtcagcccaaagcatagttggcttcccttgctcttgggaaaaggggatccctgggcacagtcgtaaaatatgggctgakgaaataaatagttatgaccttcccctgctgtgctcttacataagtatgtactaatgggctgtttctagcggaatctttcacttactgcctcctgagtgag

SEQ ID NO: 77050 - DNA, 201 bp, Homo sapiens
ttttggactgttcactgccagtatatagaaatataattgatttttctatattgatctggtatcccataacttttctgaactcatttattagttctaataakttttaatggattccttaggattttctatttgtgagatcatgttatctgtgaatagtgatagttttacttcttttttccaatctggatatattttatccct

SEQ ID NO: 77051 - DNA, 201 bp, Homo sapiens
acctgctcctcactctgccctctcctcatcaccatctcagccctggctgcagtgatctgtcttcctgccttcatctgtggaatttgctttattccacctaycaggacctgcaatggtctttttcatttgcttatttctttttttctttttcttcttcttcttcttttttttttttttttttttgagatggagtcttgctct

SEQ ID NO: 77052 - DNA, 201 bp, Homo sapiens
tagaaagagctacaagagggaggaaaagaatctagagaaataagtacagatggattcctccctgaggcagaagctggggtctgtgggatgaagcacagacrcaaagccattgtcctgccacccagcagtggagtcggagatggatggcatgaatctagaataccatgggaatgggtccttgccctgggccagtaaacattt

SEQ ID NO: 77053 - DNA, 201 bp, Homo sapiens
ggtcctggctccaggtggggagaagcagtttctctttctggggcaacaaataaaatccctccgagcacaggagtgctcattgctggttggttatgccagtstgtctctatttttagaaagagctacaagagggaggaaaagaatctagagaaataagtacagatggattcctccctgaggcagaagctggggtctgtggga

SEQ ID NO: 77054 - DNA, 201 bp, Homo sapiens
ttgactccctgggtgggggtgggggtggggggtggtgggaccagagtgggaccagggactggaatgtggggcaggctgcagagtggagaggctcgctcagrtgaaggcactactgtgtcaccattggctcctgggtcctggctccaggtggggagaagcagtttctctttctggggcaacaaataaaatccctccgagcac

SEQ ID NO: 77055 - DNA, 201 bp, Homo sapiens
atacagggttcctgggacatttttcgtttttgccttcagggcagtggcagataggtgttctcaagctcaggttttgcctggacatatgacttggggaggartttgctctggaggtcagagcctatgaggcagacagtgacgtcccatagctctcgagggggtgccctgcctgcatctcctgacgcaagcatatctcccttt

SEQ ID NO: 77056 - DNA, 201 bp, Homo sapiens
ctggcccaagtcccttgctctgccccacgaattagcaggcaatccagggttggaaggaaatgaggctggatgcatgaagggaagctaaggagagatgacaygtgggatcagcaccatggcatttgcacgggtcttatcatttgatggttgggtttagctggaaaacattttgcagcctggaaggaaataatacctcatagg

SEQ ID NO: 77057 - DNA, 201 bp, Homo sapiens
gtgttcatgtgtctttgggttgaatgggaaagctctgtttcaggctgagagttagttggtcctggctctgggctgtggattgtgtttagtttgccccaggygtgcacattttgcttagattcaacagcttctgggacacattctgctcacagagactcagcagagcacaggaaagaaggaaaacatgaagtacttcttgcg

SEQ ID NO: 77058 - DNA, 201 bp, Homo sapiens
ctgagagttagttggtcctggctctgggctgtggattgtgtttagtttgccccaggtgtgcacattttgcttagattcaacagcttctgggacacattctkctcacagagactcagcagagcacaggaaagaaggaaaacatgaagtacttcttgcggtacctgctgacatcacatttgctagcattccattggccaaagc

SEQ ID NO: 77059 - DNA, 201 bp, Homo sapiens
cccgggggaccagcatggggactgctgctccaaatggctttgagttgtcacgtaggggtggtgcatgggaactgtgtctgtgtgcttgtatgtgtgtgtakgtgtgtgtgtgtgtgtgtgtgtacaagaggactggaagggctcccttgtcctgttgccattggatactgccttcaagatttgctcttcatggtaactggg

SEQ ID NO: 77060 - DNA, 201 bp, Homo sapiens
taaattgacaacatcgatatgtggcattccaggaggagcctcaagaagcaacagaatctgttggccaactactgtcacacaagctcaccatccatccatcyatccatccatccatccatccatccatccattgatttaaaaaccatttaataagcatttaccatatccctgccttgtcctgggtgctgaactggatctgag

SEQ ID NO: 77061 - DNA, 201 bp, Homo sapiens
gatggtcttgatctcttgacctcatcatccgcctgcctcggcctctcaaagtgctaggattacaggcctgagccaccttgcctggccacaaaattattttwaaaaaaaaatattggccttggttacaggtgctcctgtggcctacctcaggacaagaaaaaaggttgggatcttagcttatcttgtttttttctttttgag

SEQ ID NO: 77062 - DNA, 201 bp, Homo sapiens
cttatgtttctgtcaaggcttcaccatttttctaagcaatggaggcccatgctgaggatctaaaatagctcgtgccttttcttctcactgtcttttcctakttatgtgtacaatcgacacttgcaattctttttatgccagacgttgtcagcccaaagcatagttggcttcccttgctcttgggaaaaggggatccctggg

SEQ ID NO: 77063 - DNA, 201 bp, Homo sapiens
attagggagtgacttcatcattaactccagccagtcaactgtttctcagcaccaaaatctgcttgaatcactggagaattgactttgccctgctgtgcctrcttgtacagggtctgtggagagccagtttctgcaagtggtctgagacttacacatgtcactgctgctctcacactgcccacatggggcagtcactatagg

SEQ ID NO: 77064 - DNA, 201 bp, Homo sapiens
ttgcataagaaacattttatccaccttgctttgggaaacatcctttcccattagaagactcaaagaagggaagtcaaatgcaactatttcttgagtgcttrctatgtgccagacacttggctggggactcaataaggccacatcttaagctgagccacagggaagatcaaagactgtgggagggcagatgtcacttcttaa

SEQ ID NO: 77065 - DNA, 201 bp, Homo sapiens
cataagaaacattttatccaccttgctttgggaaacatcctttcccattagaagactcaaagaagggaagtcaaatgcaactatttcttgagtgcttactrtgtgccagacacttggctggggactcaataaggccacatcttaagctgagccacagggaagatcaaagactgtgggagggcagatgtcacttcttaagcc

SEQ ID NO: 77066 - DNA, 201 bp, Homo sapiens
agcagtttctctttctggggcaacaaataaaatccctccgagcacaggagtgctcattgctggttggttatgccagtctgtctctatttttagaaagagcyacaagagggaggaaaagaatctagagaaataagtacagatggattcctccctgaggcagaagctggggtctgtgggatgaagcacagacacaaagccatt

SEQ ID NO: 77067 - DNA, 201 bp, Homo sapiens
cttaagcctatccagtgctgtaggcttcccctacaggagtccgtgtccacctacttgtgtgttatgctgggatggaagaaaagcacaccaaattcagagawcctaggtgagtttggaaggaaagatagaacccgtcacagcggtgagccagtgtcagtgagagcttggaagcaggatctcgttcaccaggttaccatcaat

SEQ ID NO: 77068 - DNA, 201 bp, Homo sapiens
ggtcctggccacccttaatgctactatcaacaccactgcccatcttggctgcccccgtctccccaccatgcttcattctggtttctgtcagatgttccccrctttggctgggaatttggagggcaaagagatggctcttgcgactgaccagtgttagactggggtcctggattgttgttcctgttgtataaccacccagac

SEQ ID NO: 77069 - DNA, 201 bp, Homo sapiens
ctgcaccctctgcgctttgcagagacatcctgcagttcagggaagaaacggagctgaagggcatgtggaagaagaatgtcacggagatgcaaggggttggrttattggttggcttaaggtcaaatcactatttgctgcctgaagaaaaaaaaaagaccttgcttagggacagaagtccttgtcctggtcttaggtcagatg

SEQ ID NO: 77070 - DNA, 201 bp, Homo sapiens
aggtcaaagattctgccctcctaattaaactctccctcagatatgtacctgcctcaagttcccttgcttttggtaccaacctctcccttttctcaagaccrttcttcttgaaattcccactttggtttccttacattcctttggcttctttagtaacctcacaatttgtttttttcctcaaatctcctgaaactggtctct

SEQ ID NO: 77071 - DNA, 201 bp, Homo sapiens
gtaaaatttggtaacgaggagcttaaacaatttttttttccttctgggtcatgaaacgtcacacagcagataaataatggcagagctcaggtcgctgtgcrtttcatgagtgcttgtcaaccagtggtgatggtgagccctgactcgggcagtcctgggatacctgcccaaatgaataaggggtgaaagaagaggacacaa

SEQ ID NO: 77072 - DNA, 201 bp, Homo sapiens
ttttcaaggtaaaatttggtaacgaggagcttaaacaatttttttttccttctgggtcatgaaacgtcacacagcagataaataatggcagagctcaggtygctgtgcatttcatgagtgcttgtcaaccagtggtgatggtgagccctgactcgggcagtcctgggatacctgcccaaatgaataaggggtgaaagaaga

SEQ ID NO: 77073 - DNA, 201 bp, Homo sapiens
aacacattagatctggagaggacttcagagtcctgaattgggtcagaaaacttgcttctgatgctttctaaatgcaccaccttgagtcctctgaacttctsctctctataaaggatactatggacccatcctacctaactcaccgagtggtaatgactataaagaacagacatgatatagacctaaaggaattatgtaaat

SEQ ID NO: 77074 - DNA, 201 bp, Homo sapiens
gcatatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataag

SEQ ID NO: 77075 - DNA, 201 bp, Homo sapiens
aggtgactgcattaatggatggggagagacttccaggacacagactttggcaaaatatggtcatcataaagaaaatggctgagtatatctctaggctttcragtattgtcatttgcactgtgttatttttccctccaaggggttatttggggaaaattgtatacatcccaggattgaacttccaaacaaatgcaagctgca

SEQ ID NO: 77076 - DNA, 201 bp, Homo sapiens
catatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataagt

SEQ ID NO: 77077 - DNA, 201 bp, Homo sapiens
cagggtgagatgatctctttcagacttggctctgacctcaactccaaggccacatccctgcctctgcagtgactcccctcctgccctcccccggggcagcrctgtggtgtctgcactgctgccaggcactggggacacagagacaacagacatgcctgttccctccagagtttcagggtctggtgtgagagagagatgtgt

SEQ ID NO: 77078 - DNA, 201 bp, Homo sapiens
ttaacatgactcatacgggcatatgtgaccttttgggttaagatgagacaatggagattgttcttgttttgtagaatttttctctctctctctctctctgygtgtgtgcacgtaattatttctattctcttatccgttagtaatattctagtggtagaaaagggaggtgaaattagcagtggaaagaaaaagtttggaatt

SEQ ID NO: 77079 - DNA, 201 bp, Homo sapiens
tcaactcccatgacagagtcatgtgaatttctataacaaggaatgctagttagccaatttgcgcaagaataatatcaccagcccattcaatagaaagccarcgcttgtgaccgtagctcttcttctacagtcgttttgccttcatgtcaagtgtttgaattttgtaggatgattggttctaataaaaatctgcatatggcc

SEQ ID NO: 77080 - DNA, 201 bp, Homo sapiens
attctatggagatcacttcccagaagctggggtgggtgggggggccagctgctgcaaaggcgctctttggttgaggttaattctttgccccacagccaccraagagtcttcatctgagaacatctaaatggccaacttttggagatcagggggaaaaaaggggtggactaagtaatgagcatagttctgaaaactgtttta

SEQ ID NO: 77081 - DNA, 201 bp, Homo sapiens
caggttttcccacaccagagcttgtgttctgtgatctctgttataccacaaaagataccaataccgactaatatctcatagacaatatccagttatacaattttttttttcaattgaattagttgctaatgtttaaaaattagaagtaaagatttctaacttttcttagcaaattgtaggatgtggcaacgctggtctcat

SEQ ID NO: 77082 - DNA, 201 bp, Homo sapiens
aaagttgtgaccctggaaccatggcaatttgtactcacacttatacaatcctagaagctgactactaggtttaatcttttcatgaactaggagtcttcatkaggtcaatgtaccagattaggaatgaccacaccaggagaggtgccatctacttatctattaatcaatattaacactgaagttttaggccaactgtaaaga

SEQ ID NO: 77083 - DNA, 201 bp, Homo sapiens
tttccagactctttctggtactaattattagtgttggggggaaatacaatttttcctcaaccctcatacatttgtagttgagacagatcaggtaacaggasacaaattaagaagagaaaagcaaggcatgattgataagaaaatttgcttatttctatagtacataccattttaatataataaccaaaattatgactaata

SEQ ID NO: 77084 - DNA, 201 bp, Homo sapiens
agttttcttaattaaagacctaataaaagacaatatgaagcacaataaattattttggtaagacacaagtttttgtttaacttaaaaggcgaagaaaaaattttcgctatctcttatcaatactccaagaaagtcttgacagtttaaaggagaagatcaaattctagttttgtttcagtatacttttgatattaaggctca

SEQ ID NO: 77085 - DNA, 201 bp, Homo sapiens
ttttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgta

SEQ ID NO: 77086 - DNA, 201 bp, Homo sapiens
tttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgtaa

SEQ ID NO: 77087 - DNA, 201 bp, Homo sapiens
ttctctaagaaggagttttggatgagtatttgcttattagagatctagggtaacttttaaagctttttttctctttaagtgtaggacagtctacggaattttttttttttttttttttgctgtgggggtccaaaatttgggacgtcctggagctgatgaagttttactacagagccccacggaagtaagaggagttgtaag

SEQ ID NO: 77088 - DNA, 201 bp, Homo sapiens
acttttctgacgcacgctctatccatagttggcattgctcattcctagggcttccgccgctctttccacgatgattctcagatctccatcagtcccagatygttccagggctctaggcacagatatgcagttgcctactggacatctctacttagttgtctcgtgggtttccccacttagacatggcaagaacaactcctc

SEQ ID NO: 77089 - DNA, 201 bp, Homo sapiens
tgcacaacagcaggaaaaggacataggaggcaggtgtgctgatcctcctgtgttaggtaggagacatagagtcttccttggcacttgagaagctccgaccaaaaaaaaaaaaaaaaaaaaggatactcccatgggtcagggttttgtctttaacaaagtgaaggaacaggaaggcctgagttagaggcaccctagacttgg

SEQ ID NO: 77090 - DNA, 201 bp, Homo sapiens
atgggtagatagatggatggaatgattaatcttggcccactaccttagctagatagggtcattgttctagcacatacccagaccaccaagcatgagtttgygtgtatgcacatgcatgcgtgcgcacatatgtgcataagtatatgtaagcactcatgtatgaattttcctgaatcttttccaaagacagaaaatttagaa

SEQ ID NO: 77091 - DNA, 201 bp, Homo sapiens
ccacagccagcagcaaactagcggcttgaggaactattcagcagacacttatgtagcacttaagtatgcaccagacacggttctgagtggttttacaagtkccaactcacttcatcttcataccaggtcttgacagagttagttactatccctgtttctctaatgaggaaactggaccacagagaggttagggactaaggg

SEQ ID NO: 77092 - DNA, 201 bp, Homo sapiens
cttgggttatttatttaaatctccccctgactctgcactgcctgctacctcgcaggcagtcattccaaggcatcgtcgttctggaaaagatacagtgtttktttttttttttaaattaaaaaaaagactttattgtgtagaacagttttagatgtacagaaaaattggaagattgtacagagtttccatctaccccattcc

SEQ ID NO: 77093 - DNA, 201 bp, Homo sapiens
tctatccatccatccatccatccatccatccattgatttaaaaaccatttaataagcatttaccatatccctgccttgtcctgggtgctgaactggatctsagagcctacttggggagataaatgtggaaatgtataactttaacacaatataaggtgtgaacatgctacaccaagcttttcatttttggtaggcctctgt

SEQ ID NO: 77094 - DNA, 201 bp, Homo sapiens
cttctcctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagcctcggagctaaggctgggcagattcaggatggtat

SEQ ID NO: 77095 - DNA, 201 bp, Homo sapiens
ggctgagtgttcttttcatttctctccatatgtccatgagatcttgtttctgtggcttgacgcctttctaaacgcatatttcttgctttggtatctgggtkcccagagaacatcttcccctccaggagaggccatcagtgacttttgctgcaactttgtctgctcttgatcctgtgactgggaaggtcagcatatctcatc

SEQ ID NO: 77096 - DNA, 201 bp, Homo sapiens
cagagggagtttctgaggttgcagaggtgactgagcaatatcttccaagctccctggtgtattctggtttggccaagcaatgtgttgctgcaagagctcawggaaaagttaacacatgggaagggaaagaaatccattaggtgactgcattaatggatggggagagacttccaggacacagactttggcaaaatatggtca

SEQ ID NO: 77097 - DNA, 201 bp, Homo sapiens
ggcaaaatatctaatggatgctgggcttaatacctaggtgatgggttgataggtgcagcaaaataccatggcacacgtttacctatgtaacaaacctgcaygtcctccacatgtaccctggaacttgaaataaaaataaacattttttaaaaagagctatcaatacttccaaaagttgtgaccctggaaccatggcaattt

SEQ ID NO: 77098 - DNA, 201 bp, Homo sapiens
cactctaagctaatggattattattattttttattttaaaaacatttttaacttttgtgggtacctagtacatgtatatattaatggtgtacactagatamcctgatacaggcatgtaattcgtaataatcacattgtggacaatggggtatctgtcccttcaaacatttatcctttgtgtaacaaacaatccaattgtac

SEQ ID NO: 77099 - DNA, 201 bp, Homo sapiens
tgtcatgcaatttaagctgccctggtttactgaagtcattcgtggaaacaggctcccccaagtgacttccctcagaaaccctgtcctggccctgccaaccytctccatccacagttccctgtggtgtctctgaccacaggcatttggcttcagtcacctcccaatccgtagatgacctcggcctgctgcaatgtctgggtc

SEQ ID NO: 77100 - DNA, 201 bp, Homo sapiens
gtggaaacaggctcccccaagtgacttccctcagaaaccctgtcctggccctgccaaccctctccatccacagttccctgtggtgtctctgaccacaggcrtttggcttcagtcacctcccaatccgtagatgacctcggcctgctgcaatgtctgggtcccctgtcctgggaaatcaaggcagacaaagtgtccatgaag

SEQ ID NO: 77101 - DNA, 201 bp, Homo sapiens
ccactggcctcagtgaattctaatagtgtctaggccatgccctgcatgcctccttacatagagagggatctaagtgaggctggttaaatgctgccaagatkgttttcagaactgaggtcctgatagcacctgataggagacacactggttgaacaaacaattaaagagcttgcactatgtatctgacactatggttagaca

SEQ ID NO: 77102 - DNA, 201 bp, Homo sapiens
agatcccctagagctgctgaccagcgaatctttaccaaaccagttctacgggaggcgctgctgtgaagtggcttaaggcacagaatgtggtaaaagacaarcctccttttgacctagttggaagagattgaccacaaacatggaatatacccagtgcagtgggtcgcacaataagcggccagaaaatacgtattgaactta

SEQ ID NO: 77103 - DNA, 201 bp, Homo sapiens
tcagtgggagacctgagcttatttttctgcaactagacagtcccatctgggggtgacgggagacagtaacagatcatcaggcattggattctcataaggascacacaacctagatccctcgcatgcacagttcacgtagggttcacactcctgtgagaatctgatgccgccaccggcctgacaagaggcagagctcaggtg

SEQ ID NO: 77104 - DNA, 201 bp, Homo sapiens; identical to SEQ ID NO: 30192

SEQ ID NO: 77105 - DNA, 201 bp, Homo sapiens
gtaaataaactaggtggaggtcataggcagcgtactatgtcgatgatgaagttgctagtgtgtgcgcgtgcctgtatttttatacttgagctactatcgtrtgccatgctggggatcagcagaggttacttgtgccttgtgcattgctacttgcccctcttcccttttctggaaagttcttccttcttattctttcctcta

SEQ ID NO: 77106 - DNA, 201 bp, Homo sapiens
ctgggggtgacgggagacagtaacagatcatcaggcattggattctcataaggaccacacaacctagatccctcgcatgcacagttcacgtagggttcacrctcctgtgagaatctgatgccgccaccggcctgacaagaggcagagctcaggtgttaatgaggatggagagtggctataaatacagatgaagcttcactc

SEQ ID NO: 77107 - DNA, 201 bp, Homo sapiens; identical to SEQ ID NO: 30194

SEQ ID NO: 77108 - DNA, 201 bp, Homo sapiens
gcgtttcttttatttaatgtggcctaaaatgtaatgatcatatttggtctgcacagttacttacttttcatctctgaaaagtattcttccagcacaggaayggatctcagcatatctattctgactgtttcggttgctttgggaaaacactccagttttagcttggttctccagtttttaatcttcagtccaccatcttct

SEQ ID NO: 77109 - DNA, 201 bp, Homo sapiens; identical to SEQ ID NO: 30196

SEQ ID NO: 77110 - DNA, 201 bp, Homo sapiens; identical to SEQ ID NO: 30198

SEQ ID NO: 77111 - DNA, 201 bp, Homo sapiens
agtgatttattaacaaagtagaaacatttaaaatacagaaagaaatgcagaaataatggtgatggtgtttcagaaatggtgattgagaaagcatactttargtagtgaattgccttttaaaggaattaatagcaaaaatatctcttacttgtcattgttttcaccatttccggtactctctatttcattgtgtagatccaa

SEQ ID NO: 77112 - DNA, 201 bp, Homo sapiens; identical to SEQ ID NO: 30200

SEQ ID NO: 77113 - DNA, 201 bp, Homo sapiens
aacaccgcatgttctcacttataagtgggagctgaacaaatgagaacacatggacacagggaggggagcaacacacactggggcctgttgggagatggaarggggtagggagagcattaggcaaaatatctaatggatgctgggcttaatacctaggtgatgggttgataggtgcagcaaaataccatggcacacgtttac

SEQ ID NO: 77114 - DNA, 201 bp, Homo sapiens
tagaacataaagaaaaggacccaaattaagctgcaggcctggagttcagactaagaaattctatgtgacccaaagggacaggaagcactaggcagaggagstgagtgtggctgcaggatggccgttgtagacgtctttgtgatgagcacaggaggctcatggcctgctcgctagaggcaggagggtagatcagatcatagc

SEQ ID NO: 77115 - DNA, 201 bp, Homo sapiens
cttagtagcctaaagcaacagtcatttcattttatctcatgattttttgttcaggaacttgggcagagctgggctgggtgattattctgcttcatgtggtrttgactggggtcacttggtggtagccagcttggaggtgggatggacgggagggttcaggaaggctttagttgtatgcctgctgcttggcagggcagctgg

SEQ ID NO: 77116 - DNA, 201 bp, Homo sapiens
acccccatatttcttgaatttttcataatgagtgtagaaagaggtcccagcactggaaaggaaggtggggagctgttcccctcattgcttacagtggtctrcctcttgtagacacaaacctctaccttgaggagcccctttctgagggcaagtgtgcttctgagagggcagatgccagccatgcatcacaatctagggagg

SEQ ID NO: 77117 - DNA, 201 bp, Homo sapiens
atggaggcttgaagagtcagttgacctgcagaccgagatagagcttaaggtggaaacttggatgaaacctttaggctgtcccttccagtcctcagcgagamcctagggatcaccatgtgcaatgctatgtggatgtggcgtgtgacaccacaggcaccagagggagtttctgaggttgcagaggtgactgagcaatatctt

SEQ ID NO: 77118 - DNA, 201 bp, Homo sapiens
ctcccaggttcaagcgatgctcctacctcagcctcccaagtagctggggttacaggcacgcgccaccaggcccaactaatttttgtatttttagtagagayggggttttgccatgtaggccaggctggtttcgaactcctgacctcaggtgatctgcctgcctcagcctcccaaagtgctgggattgcaggcatgagccac

SEQ ID NO: 77119 - DNA, 201 bp, Homo sapiens; identical to SEQ ID NO: 30227

SEQ ID NO: 77120 - DNA, 201 bp, Homo sapiens; identical to SEQ ID NO: 30228

SEQ ID NO: 77121 - DNA, 201 bp, Homo sapiens
aacaggggaaaagagccttgagttttttcctggggtctattctgccctggactttggttggaggacctcacccacatctgtggatgtctcctctgtgcctscttctttgtgggtgtctgagcacctcagctgtttgttgcaaagcagacttcattgctgggcatctctttatagactggcataggctggggactcaggagg

SEQ ID NO: 77122 - DNA, 201 bp, Homo sapiens; identical to SEQ ID NO: 30231

SEQ ID NO: 77123 - DNA, 201 bp, Homo sapiens
gccacgtgttcctggcattcaaagggaaagggaagacagtaagtaacatggctgtcattatgtaatgaaaggagactggtttatctacactaaaatatcaygagttcatggtgatattgatgtaagacattgcccaacataacgagctgtattttcattagtaggtttttaaaatgagtattatttatcacgtgggcattt

SEQ ID NO: 77124 - DNA, 201 bp, Homo sapiens
actttaaaaaatgctatttgaaaaccatgaaatttatatcataactaattaataggttaaacctgttatcctaaaagtagtgacttagtcatagggaacastcaatggctagtagtctatttggagcagtgacactgagtctctttttccttctctgtgtaagaaagggatacgcggcactccatcaggaagttcttagga

SEQ ID NO: 77125 - DNA, 201 bp, Homo sapiens
atggctagtagtctatttggagcagtgacactgagtctctttttccttctctgtgtaagaaagggatacgcggcactccatcaggaagttcttaggaagarttcttaatcgcatttccatttgttatcctttcccttcagcctgcagaacatcctgtagcattgttagaggtgcagttctgctggtgacattctctcaact

SEQ ID NO: 77126 - DNA, 201 bp, Homo sapiens
cattctctcaacttgtgtttttatgaaaaatgtctttatttcatccttatttttgaaggatacttcattggatatagatgaatggtttgatagcttttttyccacccccagccccagccctctgggtatcactcttttggtctccattgttttgacgagaagctagcctaaattcatatttaaatattcttcattatctta

SEQ ID NO: 77127 - DNA, 201 bp, Homo sapiens
tctgtgttctttcacttagcataatgctttcaaggttaatgtgtattgttacacatatcggtacttcattcttttttatagctgaaatctatttccttggrtggataggctacattttgtttatccatttgccagttcatgggcatttgtgtgtcctagtttttgttactataaatgatactgctatgaactttcaagtac

SEQ ID NO: 77128 - DNA, 201 bp, Homo sapiens
tttcaaggttaatgtgtattgttacacatatcggtacttcattcttttttatagctgaaatctatttccttgggtggataggctacattttgtttatccakttgccagttcatgggcatttgtgtgtcctagtttttgttactataaatgatactgctatgaactttcaagtacaagtctttgtgtgtacatgttttttag

SEQ ID NO: 77129 - DNA, 201 bp, Homo sapiens
gtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtga

SEQ ID NO: 77130 - DNA, 201 bp, Homo sapiens
aatctatttccttgggtggataggctacattttgtttatccatttgccagttcatgggcatttgtgtgtcctagtttttgttactataaatgatactgctrtgaactttcaagtacaagtctttgtgtgtacatgttttttagttctcttggtcatatacctaggagaagaattgctgggtcatatgtttaactttgattg

SEQ ID NO: 77131 - DNA, 201 bp, Homo sapiens
ggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtg

SEQ ID NO: 77132 - DNA, 201 bp, Homo sapiens
tggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgt

SEQ ID NO: 77133 - DNA, 201 bp, Homo sapiens
acagtgctagtgaagatatgcatcgaataaagacatctagaaggcacaaatggttcagctggtattgatgatgttatcaccattaacatctcagctctacmgtataccctccagaccttggatcaatcacattgttgcctcttgggcttcagtttccttatgtatgagactaaagactgtacatagatgattcctaaatgc

SEQ ID NO: 77134 - DNA, 201 bp, Homo sapiens
gtggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactg

SEQ ID NO: 77135 - DNA, 201 bp, Homo sapiens
gttggtatggaatgacgttctcatcagtgttaggcaaaaaatccccaggatgatgcacatctgggttgacagccacacagtttagatgatgtttgaggtaktttttttttttttaatccaggatagtctatacataatttaaaaatctacccagaggccaggcacggtggctcacacctgtaatcccagcactttgttggg

SEQ ID NO: 77136 - DNA, 201 bp, Homo sapiens
tttacaaagagtggttgggaagattgcatgggatagggtgtgcacaaagtcagtactgtggatagcagtgataaaagagtggtaccatgcatcagaagtargtcctagaatgtgacaggtgaggtatggggacatatgttcgccaacagtgctcattattgatgcgtggtctgaggaaggactgattggtttggagataga

SEQ ID NO: 77137 - DNA, 201 bp, Homo sapiens
gcctaaatgatttgatccagtttataggtgtactggaggcatgcccaccttccatatcaaacgggaaggcaagcatctttctctaaattgacaacatcgayatgtggcattccaggaggagcctcaagaagcaacagaatctgttggccaactactgtcacacaagctcaccatccatccatctatccatccatccatcca

SEQ ID NO: 77138 - DNA, 201 bp, Homo sapiens
gtggattcatcagtgagcaaaatagtcaaaaagcctgccctcatatcttaaaaattcaattatgaattctttattctatgggttattttattaattaattwatttatttattagagatggagtcttgctctgtcacccaggctgaagtgcaatggtgagatctcggctcaacaaaacctccgcctcccaggttcaagcgat

SEQ ID NO: 77139 - DNA, 201 bp, Homo sapiens
aaagaatgctgaccaatgatcttaagattcttttcaacttggtgagtcagtcgttccatatcaatgtcaaataaccctgcctgatctggcatgttgttcaragtcgtagttaaaagggcctaattcctgttgaggccaattcggtattgagtcaggagtggtgcttggagtgctctctactctaacacaaaaatttaatga

SEQ ID NO: 77140 - DNA, 201 bp, Homo sapiens
acgaggtttcaccacgttggtcaggctggtctcaagctcctgacctcgtgatctgcctgcctcagcctcccaaagtgctgggattacaggcgtgagccacygcacctggccttatttgcttatttctttgccggccgtctctccattttaatatgtaagctcctgtgagatgggggctctgttggacttgtcattgtcata

SEQ ID NO: 77141 - DNA, 201 bp, Homo sapiens
agccacgtgccagccactttctgtatgtgagaccgtgctgcttgccaaaagctgttagttccttccattctggctggctgggagagatttctcatggttgygcgtggggagagttgacatgtttatgtggaggtaatgactgtgttggctccttaaggaagaattaggatgagagcccagttccctgtttggggacttgaa

SEQ ID NO: 77142 - DNA, 201 bp, Homo sapiens
aactttttcccaaagtttcttggtcccagactcgactcagggggactgttttggcttccttttaccacatggccccagatcttccttttctttctttcttyttttttttttttttgagatggagtgtccctctgtcacccaggctggagtgcagtggtgcaatctcggctcactgcaacctctgcctcctgggctgaagcg

SEQ ID NO: 77143 - DNA, 201 bp, Homo sapiens
aatgtaggaagttaccatcccatgacaattttattttactcttctttcctttgcccattagctactgcaaacttaaaattacctatagtggagagtggtartagtctacttcaaaaacagcaaattcccagggatttgccctcacttttggaatcttagctaaatatttttttctctatgggatcaccctcttttgcatgt

SEQ ID NO: 77144 - DNA, 201 bp, Homo sapiens
acagggagccatacttagcctggcgttttggcacgatgcttctaaaaccaaacagaggggcatctttttgttgttcatcccctgcctgttcaagtgactgyccagcatgtttgccttttatctaagccatggctgagtgttcttttcatttctctccatatgtccatgagatcttgtttctgtggcttgacgcctttctaa

SEQ ID NO: 77145 - DNA, 201 bp, Homo sapiens
catgggcatttgtgtgtcctagtttttgttactataaatgatactgctatgaactttcaagtacaagtctttgtgtgtacatgttttttagttctcttggkcatatacctaggagaagaattgctgggtcatatgtttaactttgattgtcagactattttccaaagtggctgtaccattttacattcccaccagcaattt

SEQ ID NO: 77146 - DNA, 201 bp, Homo sapiens
ctgtccaggatgccttcagcctagcaggacagggcaggctcctggacacggagagcactgggcccagagaagaggcaggcatgtgtggggcatggtctctsctcgcctgcaggccacgcaggaaggaggaatccttcttaacgggtcatttcacttactcatttcagaactggttactgagcagtatgtgttatagtggct

SEQ ID NO: 77147 - DNA, 201 bp, Homo sapiens
ctgaagtcacaagccaggagatcacagcataactcctctcagtgtatggcttgcatttattttgtgaaagcagtcagagtcccctctctgcccttgaacakgccattctgtgagaggctaaatttatagcattggctgccagattattaatctccacctgaaattgcactggggaatcccccacactcagggcaactgatg

SEQ ID NO: 77148 - DNA, 201 bp, Homo sapiens
cctgcaaatccccaagcatgcttaggcttcctggtcttagaagtgtgtgcctcaatgatggggaggaccctccacttggacggcttctgtgtggctcttcsacttctaaaacatacgttagagaactgatgataataccagtttaagaatcagagggtgcaggaatgggttctatacaatctatctaaattcaaatgctaa

SEQ ID NO: 77149 - DNA, 201 bp, Homo sapiens
tgaaaatggtttcttctgccatcctagttaaaaaacaaacactattttagatgtatgttgtctgcatcctggcataagagcgatgactgtccataggtggrggctagaactgattgatgttgctaacaaaacaatgaacaatgtttctttacttttctgaccagagcacatggctgttggcaagactcattattgtgcatg

SEQ ID NO: 77150 - DNA, 201 bp, Homo sapiens
atggtcttgatctcttgacctcatcatccgcctgcctcggcctctcaaagtgctaggattacaggcctgagccaccttgcctggccacaaaattattttawaaaaaaaatattggccttggttacaggtgctcctgtggcctacctcaggacaagaaaaaaggttgggatcttagcttatcttgtttttttctttttgaga

SEQ ID NO: 77151 - DNA, 201 bp, Homo sapiens
gtaggaaaactaatggtaggaactaggagtattgagcctgaagaaaataagaataagaggagatttcatcaagaactttaaacaaatgctctaaggttccrttctccagtctgtgggctagaacataaagaaaaggacccaaattaagctgcaggcctggagttcagactaagaaattctatgtgacccaaagggacagga

SEQ ID NO: 77152 - DNA, 201 bp, Homo sapiens
tggtcttgatctcttgacctcatcatccgcctgcctcggcctctcaaagtgctaggattacaggcctgagccaccttgcctggccacaaaattattttaawaaaaaaatattggccttggttacaggtgctcctgtggcctacctcaggacaagaaaaaaggttgggatcttagcttatcttgtttttttctttttgagac

SEQ ID NO: 77153 - DNA, 201 bp, Homo sapiens
tggtaatgtcaccgggctttctctgggtttacccatgctggactgctcttctccaaaccacacctctctgtgtagcctagatggagctccctgatttagaytctcgtccaagcagagtactttactctttcctccatgggctggagcctttccaaatgctttaagtatttgtccttagtcctagaatattctgcccattcc

SEQ ID NO: 77154 - DNA, 201 bp, Homo sapiens
gccacaaaattattttaaaaaaaaaatattggccttggttacaggtgctcctgtggcctacctcaggacaagaaaaaaggttgggatcttagcttatcttktttttttctttttgagacagagttttgctcttgtcgcccaggctgaagtgcaatggtgcaatcttggctcactgcaacctctgcctcccgggttcaagca

SEQ ID NO: 77155 - DNA, 201 bp, Homo sapiens
caagttatccacccacctctgcctcccaaagtgctgggattacagctgtgaggtgccatgcccagcctagtctttggttttactaaaaaaaaaaaaaaaaatttcatggttgaacaaattcagaaaacactaatgattacaatttaccaggacagtcaaagttttgagaagccttgtagtaaaaacaaacaaacaaacaaa

SEQ ID NO: 77156 - DNA, 201 bp, Homo sapiens
caggataccatggagtaacaccagaggaggggacaggaggatcttgtcacttcaggtccagcattgctgagcccagtctcttgaggccatccagtgctgarcatagagacttacatggcgaggggaaggaggagggacattttgttatgggactggggtgattaacaggagctattagagagcatcaagccagcactggaa

SEQ ID NO: 77157 - DNA, 201 bp, Homo sapiens
gatcttagcttatcttgtttttttctttttgagacagagttttgctcttgtcgcccaggctgaagtgcaatggtgcaatcttggctcactgcaacctctgyctcccgggttcaagcaattctcctgcctcagcctcctgagtagctgggattacaggtgcctgccaccacacccagctaatttttgtattttttttcagta

SEQ ID NO: 77158 - DNA, 201 bp, Homo sapiens
ttttgaaaatcttgtagataattttaaaagtgcaaggcaataaaggaaccaggattactcactcacaattttaatctaacgggaactggttttccccagcraggacctgctgtgtgtgcagtctcgtgctaggtgcttgaagaatacagaagaagtttcagatactgtcccgcagtcaagaagcagtcattttacctgggt

SEQ ID NO: 77159 - DNA, 201 bp, Homo sapiens
agagagactgaacaagagcagcaaaggaaataactaaataactccttcccaagggcctctaatgagatgcaaggccaagtgcaggatcttccaaagggtcmcatgaactgccacctctacttctggaaggtgccccagacaggaccactgtggaagccccactctctgtccaggcatcttccatcaggcagcagccgcccc

SEQ ID NO: 77160 - DNA, 201 bp, Homo sapiens
ccccaagtggtctatgcaatgccctctggccccagtttgatcaagatctctgccttttttcctggggctttagtctgctgctgtgtcctttgcatcaggamaacaaaggcagctctgtttggggatgtgggcgacttggctgtgtcctgttctccattccttttgctccctcctaattgctctttcagaccaccccagctg

SEQ ID NO: 77161 - DNA, 201 bp, Homo sapiens
tctcttgatgaatatggtggcattaaaatcatatgtaaggtgtcttcaagctctaacaccctatgaatttctctcgaatgagcaaagctggtcactgctgmttccaaatacaagccacccctctttcaaaagatgtttcctttcaatttctactctgccagaggatgtgtacaacataattatgtagttaaattcaaggat

SEQ ID NO: 77162 - DNA, 201 bp, Homo sapiens
tcatatctccccattcagttcttaacctcatcctcataatttcccctctgtttcttcctctgccctcctgtccagcatatctcccctttgtggctctgagkacccccaagtggtctatgcaatgccctctggccccagtttgatcaagatctctgccttttttcctggggctttagtctgctgctgtgtcctttgcatcag

SEQ ID NO: 77163 - DNA, 201 bp, Homo sapiens
ctgtgtatcagataagaagttaatattcacaatatataaggaactcacacaatccaatagcaaaaatacaaataacctaattaaaaaataggcaaatgacytggatagacatttctccaaagaagacataaaagtggccaacaggtatatgaaaaagtcctcgacgtcaccagtcattagggaaatgcaaatcaaaactac

SEQ ID NO: 77164 - DNA, 201 bp, Homo sapiens
cctctcaaagcttgaagaaagtcatgcagaacgtccagagaccctggcagctgggcagacaccacacacacacacacacacacacacacacacacacacaccaccctaatgtcaaacacgcacacatgcacagaccaccctaggatttgtgctatttccaatcagtggcataaatgactgagcaagagaagtttactcagg

SEQ ID NO: 77165 - DNA, 201 bp, Homo sapiens
tcacacaatccaatagcaaaaatacaaataacctaattaaaaaataggcaaatgacctggatagacatttctccaaagaagacataaaagtggccaacagktatatgaaaaagtcctcgacgtcaccagtcattagggaaatgcaaatcaaaactacagtgagatatcatcgcatacctgttaggatagctaatataaaaa

SEQ ID NO: 77166 - DNA, 201 bp, Homo sapiens
acctctcaaagcttgaagaaagtcatgcagaacgtccagagaccctggcagctgggcagacaccacacacacacacacacacacacacacacacacacacaccaccctaatgtcaaacacgcacacatgcacagaccaccctaggatttgtgctatttccaatcagtggcataaatgactgagcaagagaagtttactcag

SEQ ID NO: 77167 - DNA, 201 bp, Homo sapiens
aaatggctgagtatatctctaggctttcgagtattgtcatttgcactgtgttatttttccctccaaggggttatttggggaaaattgtatacatcccaggrttgaacttccaaacaaatgcaagctgcagccagccccagagctgcagatgggcatgtccctagggtggctttagaaaaatgtagttctctctgtgctcag

SEQ ID NO: 77168 - DNA, 201 bp, Homo sapiens
ttgccctgggccagtaaacatttgagactcagagccaggagataggatgagaagattgcagtgatgagacccacagagggcagcagccatctcttaagggrtcaacttggagaccaaatccatcacttcttggaggtccagtagcccctgcaccctctgcgctttgcagagacatcctgcagttcagggaagaaacggagc

SEQ ID NO: 77169 - DNA, 201 bp, Homo sapiens
atgcctggatggatggttagatgggtgggtggatagatggaaagatgggtagatagatgggtagaatgatggatgcctggatggataggtagatgggtggrtggatgggtggaaggatgggtagatagatggatggaatgattaatcttggcccactaccttagctagatagggtcattgttctagcacatacccagacca

SEQ ID NO: 77170 - DNA, 201 bp, Homo sapiens
gctgatgatgatttaatgatgataatgatgttgatgatgatgatgatgatattgatgacaatgataatattgatgttgatgatgatttaatgatgataatratgatgatgatgatattgatgacaatgataatattgatgttggtgattatattgattttgatacgatgatattgatgttgatgattatattgattttgat

SEQ ID NO: 77171 - DNA, 201 bp, Homo sapiens
tttttcacaagtttcatcctcatattgactggtttgtgcctggacaacaacacactcacaatttgtctgtctgcttccacttctgtctctgtgccgcactsccccccacaccattcactttctgtgattttttaaaaatttaattttgtcacatccttcccctgttcagaaatctacaacagcttcccgttgtacttcctg

SEQ ID NO: 77172 - DNA, 201 bp, Homo sapiens
cccctaatatatcatttctttgtgttgtaaatattcacaatcctctcttctaactttttggaaacatacaataaattatattaatcctattcaccctgcartgctgcagaacactggaaggtattcctcctatctagcttaactttggatccattaaccaacctctccccatcctcccctctccacattttgcccagcctc

SEQ ID NO: 77173 - DNA, 201 bp, Homo sapiens
ggcaggcttactcttcgtcttcttacacaactcacttgattatcttcttaattcacagctctggttttgtcactgttcacactgttcagtgtcttccactkccttgtgtagcagatctccatgcactcatctcagtttgccccaactgagtttcatggagatctgctgcacaaggcaacagaagattgttgcacatgaaga

SEQ ID NO: 77174 - DNA, 201 bp, Homo sapiens
tgattttattattgatcattgagtttgatctgatgcatttcacagagacttggctctgtggctgtgcccttggctccaggggcagcagctatactgatgaygagtttttccattcccccagccagaaggcaagaggtggtagggtagatgcacatgtactcctccctttcttctggaaagtctgatttggatgcatgcata

SEQ ID NO: 77175 - DNA, 201 bp, Homo sapiens
tgctcgctagaggcaggagggtagatcagatcatagctgggtgtcacttaacactccttgctgcaatgcatatgagaaaagctgctcttcaggtctgtggrccacgcaattgactatttttctcaaactgttgagaggttgctatgaaccttttgcatttttccttcggttttcctcagatccatgagagattggcactgg

SEQ ID NO: 77176 - DNA, 201 bp, Homo sapiens
catgctcctctccactctgctcctcagagtggagaacagcatagagaagtttcccaactcatcagaggcacttacccagaggtctcagcggaatcagaacrtctgttgctcccctttctgcaagtttgtttcttcctaagatgggagaagaatagggatagagaggggatttgggtgctgtgaactttctttttccttgaa

SEQ ID NO: 77177 - DNA, 201 bp, Homo sapiens
attccatgcattacctcatttcatctccatagcagcaatctcataccgttggcactattttcaatctctttgttatgggtgaggaagtggaggtatagagmagttggtaacatgcctgaagtcacacgttcaattagcgtgcaagctgggaattgaacccaggcagccacctccaggctagaccatactgcagtattccca

SEQ ID NO: 77178 - DNA, 201 bp, Homo sapiens
catactgcagtattcccaggacatggtgagatgccctccagcaaggaagaagaaaagggggatgaggagagggagagaaagacaaatgagcaaataatatwttttctcaaatgtaactttatggtcccatttcacagattgctggccttgaacctcactatctctttctcctttgtttcagtccacatatatgtggagggc

SEQ ID NO: 77179 - DNA, 201 bp, Homo sapiens
agatgccctccagcaaggaagaagaaaagggggatgaggagagggagagaaagacaaatgagcaaataatattttttctcaaatgtaactttatggtcccrtttcacagattgctggccttgaacctcactatctctttctcctttgtttcagtccacatatatgtggagggctaaggtggcctgaagtcacaagccagga

SEQ ID NO: 77180 - DNA, 201 bp, Homo sapiens
agaagaaaagggggatgaggagagggagagaaagacaaatgagcaaataatattttttctcaaatgtaactttatggtcccatttcacagattgctggccytgaacctcactatctctttctcctttgtttcagtccacatatatgtggagggctaaggtggcctgaagtcacaagccaggagatcacagcataactcctc

SEQ ID NO: 77181 - DNA, 201 bp, Homo sapiens
gtaactcataaagccatgggcaagctgcttctcagagtctaactgtcctcatctcttgatgaatatggtggcattaaaatcatatgtaaggtgtcttcaarctctaacaccctatgaatttctctcgaatgagcaaagctggtcactgctgattccaaatacaagccacccctctttcaaaagatgtttcctttcaatttc

SEQ ID NO: 77182 - DNA, 201 bp, Homo sapiens
aaatgagcaaataatattttttctcaaatgtaactttatggtcccatttcacagattgctggccttgaacctcactatctctttctcctttgtttcagtcyacatatatgtggagggctaaggtggcctgaagtcacaagccaggagatcacagcataactcctctcagtgtatggcttgcatttattttgtgaaagcagt

SEQ ID NO: 77183 - DNA, 201 bp, Homo sapiens
cactggttcctgtgtctctagtcttctgaaggcacctctgaggtttctgctcagtgtctctgagtccttctgggaatgccagctgactcctctgcttggayctgatagaacacccagggcccgtgacctatgagtcaaaccttaggctcaagctgtttgtttcactcatcttgtctatgacaagcctttatcatttgagtg

SEQ ID NO: 77184 - DNA, 201 bp, Homo sapiens
ggttttactcccactattcccttgaaatttcctcacaaaggttgcagatgatcttaatggcaaattctaatggacgccttgctgctcttaacttacttgawctctctgtcaagaagagctgtgcctctatgtcccttcctgagttttggtcacactattctcttcttactccttccaatattttggctacttcatggtcca

SEQ ID NO: 77185 - DNA, 201 bp, Homo sapiens
cttagtccactttcaggctgtgcttcttggtccatatgatgtagtattagtgcttttcttctacctctgaagactgtggccctgtgctataagcctaatayttgtgttccccaaaattcctatgttgaaattctaactgccaaggtgatggtattaggaggtgtggtgtatgggaggtgatgaggccatgagggcagagca

SEQ ID NO: 77186 - DNA, 201 bp, Homo sapiens
aatagcaaaaatacaaataacctaattaaaaaataggcaaatgacctggatagacatttctccaaagaagacataaaagtggccaacaggtatatgaaaargtcctcgacgtcaccagtcattagggaaatgcaaatcaaaactacagtgagatatcatcgcatacctgttaggatagctaatataaaaaagtcaggagat

SEQ ID NO: 77187 - DNA, 201 bp, Homo sapiens
gatgacagagcattgcacgacatgagaggctgtggagtacaaggaaggcactggactcacacacattggattccagagctgccacttattcacttgtgaaygagttccataaccttctggaaccttcaggtcctacggctatagaatgggaataataatcacacctcacgagttattgcagtaattaaatgggatatgtct

SEQ ID NO: 77188 - DNA, 201 bp, Homo sapiens
acctctccaagtcacagggttgggttcattgtagttgcttgaaaaaagagtattagtcaagtcaaggtttttaggaaaatggctgtgcttgggaggtgctyagacattactgacagcccactcctgagtgtcactgccccagatgctcctgaagcggggccagggatgagagtgaaaggagtgatggggaaaggccgtgag

SEQ ID NO: 77189 - DNA, 201 bp, Homo sapiens
gccaacaggtatatgaaaaagtcctcgacgtcaccagtcattagggaaatgcaaatcaaaactacagtgagatatcatcgcatacctgttaggatagctawtataaaaaagtcaggagataactcttttggaaggaatgtggagaaaaaggagcccttatacactgttggtggaatgcagtttcatgcagtcattgtggaa

SEQ ID NO: 77190 - DNA, 201 bp, Homo sapiens
ctacggctatagaatgggaataataatcacacctcacgagttattgcagtaattaaatgggatatgtctaaggcacatagccaattgtcagtcacattgcmaacaatttaaaaatggtggctcttattttttggtgcgtctgcaggctgggtggccacacccagcagaaggaaatggtttaagagagttaatacagttccc

SEQ ID NO: 77191 - DNA, 201 bp, Homo sapiens
ttcaaagggcttctcctttgtaaatcctcttctggcctctcggctgtcagtggtcatcctcccacttccagactcccctggcacacaccctctgtttctgrgttcatccatcagctgttgatggagtgcttgctccgtgccaggcacagttctggaaacacagcaaagacaagcgacaaggtccctgctctcattttgctt

SEQ ID NO: 77192 - DNA, 201 bp, Homo sapiens
ttgaagttgctaaagaaataaaaaaatggaaccaccatatgacccagaaattcctattctgggtatatactgaaagaagtaaaatcactacctggtaaagrtatctgcactgccatgttcattgaaacattattcacagtggtcaagatatggaaacaacctaagtgcctgtcactttatggtatagaattttggagcttt

SEQ ID NO: 77193 - DNA, 201 bp, Homo sapiens
ctgctggccaaagtgaagtagggttgacattaggacattgaagagcaagtcagtttctggatctcagttgcttgtgatgatggcaggattggggaagatartgatgcagatgataatcacaaagtacaagtccttatggctgaatggtgtgccccccaaaggagaggctctcatagacagaagagtaaaggcttggaagtg

SEQ ID NO: 77194 - DNA, 201 bp, Homo sapiens
cttgatggatgcacttgaggcttaagtgacaaggtgggctcatagtgtttccattgtctgtgtgaggaaggaactaagggcattgatggaactggtgttgygagtcctcaggacagcacggctcccaccactgctgtgatccagcctgtgaacgtcagcgcagctggtgtccttgggtgggcgcttgctgcctgctttggt

SEQ ID NO: 77195 - DNA, 201 bp, Homo sapiens
atatgacccagaaattcctattctgggtatatactgaaagaagtaaaatcactacctggtaaaggtatctgcactgccatgttcattgaaacattattcayagtggtcaagatatggaaacaacctaagtgcctgtcactttatggtatagaattttggagctttgatgatgttgcatccaagtaaatattctataaaaat

SEQ ID NO: 77196 - DNA, 201 bp, Homo sapiens
actagagagtcatgtacaaagaatgaagttggaccctttcctcactcatacataaaaattaactcaaagtgaatcgtagatgtaaatgtagtagttaaatygataaaactagaagacaacatagaagtaaatcttcgcaaccttggtttaggtgatgttttcttaatgttacaccaaaaccataagcattctgtctcagtt

SEQ ID NO: 77197 - DNA, 201 bp, Homo sapiens
aaagaatgaagttggaccctttcctcactcatacataaaaattaactcaaagtgaatcgtagatgtaaatgtagtagttaaattgataaaactagaagacracatagaagtaaatcttcgcaaccttggtttaggtgatgttttcttaatgttacaccaaaaccataagcattctgtctcagtttgctcactctaacaaaa

SEQ ID NO: 77198 - DNA, 201 bp, Homo sapiens
aaaggcagagcccttatgacttaatccttcccagagggacccacttcttaattctgctgcattgagggttaagtttcaatatgaattttggaagagacacmgatagtcaaaccgtgacacatcagataaaaaatagacaaaatggacttcataaaaattaaaaatgctccaaaagagcatttttggttgcaggtgcttctc

SEQ ID NO: 77199 - DNA, 201 bp, Homo sapiens
cttatgacttaatccttcccagagggacccacttcttaattctgctgcattgagggttaagtttcaatatgaattttggaagagacaccgatagtcaaacygtgacacatcagataaaaaatagacaaaatggacttcataaaaattaaaaatgctccaaaagagcatttttggttgcaggtgcttctcttgactccatca

SEQ ID NO: 77200 - DNA, 201 bp, Homo sapiens
acaaaggacttatatctggaatatagaaataactcttataactcaacaataaaaagatgaacctgattttaaaatgagcaaaagctctgaatagacatttytccaaagaagatatgcaaattgctagtaagcacgtaaaaagatgttcaacattattggtcattagggaaatgtaaatccacccaaatagtggtgcttctt

SEQ ID NO: 77201 - DNA, 201 bp, Homo sapiens
gaagatatgcaaattgctagtaagcacgtaaaaagatgttcaacattattggtcattagggaaatgtaaatccacccaaatagtggtgcttctttcttctratatttcaagatctgtgactagatctgtgctccctgttttgactctgttagtgattctctagactaatggtctcaaccctggttgtaccatagaatcacc

SEQ ID NO: 77202 - DNA, 201 bp, Homo sapiens
cattcagtggatgtcaggctagctggggttccagccctctagtgttaatcccttcaattacccatctcccagggaaaaccatggtgtggtcttctggtacrggctgcatgctgaccatagtcgaccttggcttatgatggggccatctttatgaacatccctctttgtgcctagcaggagtaaaatatcactctcagggcc

SEQ ID NO: 77203 - DNA, 201 bp, Homo sapiens
caaagtgaagtagggttgacattaggacattgaagagcaagtcagtttctggatctcagttgcttgtgatgatggcaggattggggaagatagtgatgcaratgataatcacaaagtacaagtccttatggctgaatggtgtgccccccaaaggagaggctctcatagacagaagagtaaaggcttggaagtgataggcag

SEQ ID NO: 77204 - DNA, 201 bp, Homo sapiens
agtagggttgacattaggacattgaagagcaagtcagtttctggatctcagttgcttgtgatgatggcaggattggggaagatagtgatgcagatgataawcacaaagtacaagtccttatggctgaatggtgtgccccccaaaggagaggctctcatagacagaagagtaaaggcttggaagtgataggcagacagcacc

SEQ ID NO: 77205 - DNA, 201 bp, Homo sapiens
tagatgtttcaggatttttcgcatctgggcctataaagagtctgactctcatactaaaatcacattgcaggcagatttgctgccaggctatgcactgcctgggggcccctctgcatggctgacatgctagactgtctgtccatggtgctggacttgggtctgcagaccccagcgacatagttccacagcacagagggtctg

SEQ ID NO: 77206 - DNA, 201 bp, Homo sapiens
tgctactacctagggccaagaatttgagctgttctcctatgtatgcctagtgcctggtgctagcatgatgcttggtacatatttgatgttcaatgtatgcytcctgtatagaaacaagagtaatacaactcacaattatacagaacttataattttccaagtactgtcacatatgtggtatactcattgagtgctcagtaa

SEQ ID NO: 77207 - DNA, 201 bp, Homo sapiens
aggggatgagggtccctcttgcctcttactctgggcccagggagacatggtccaggctttccacgcaggcttcgggtggtttatcagttctttgagtagakgaagttccctcgtgccctcttttgaggcactaaatgaccgaataaccacttgagggtcaaaaacataaagaatcaaaataattatcgcagcctcttctta

SEQ ID NO: 77208 - DNA, 201 bp, Homo sapiens
ttttccaagtactgtcacatatgtggtatactcattgagtgctcagtaaggaaagttaccagttgtcccattagaccccattagagatgctgatttgaggrcacagataatttgaacaatatgccctaggttgctcagcttataaagaggtggagacggaatgaagcccacatcctgtatttccaaatccattgtatttct

SEQ ID NO: 77209 - DNA, 201 bp, Homo sapiens
gataatgaagtggccagtgacgatggcaaggtttggcttcctgtcctttgtgggcttcccaaagaatgaggaccacagcctgcttcttttgaagcccaaayccagttccactccagtcctggccacttggcatttatcgtcttcattctctttttagggttgggagtaacctgcactggtttcacattggtatgactgagt

SEQ ID NO: 77210 - DNA, 201 bp, Homo sapiens
acagtcctgctttaagcaaattcaaaatataaaaatctggattaaaaacctaggagaatctgtagatactgccccttcagagaggtggagtgtaattcccmcaccttaaatgtgggcactttgtgactttcttctgaagagtaaagtatggaaaggagaaaaaaagaaactttgcaatagaaaaatctgacagatatgatc

SEQ ID NO: 77211 - DNA, 201 bp, Homo sapiens
ctatcgtctccaatggggagacaggcaaggagcctcatgctgggggcccaggtgacattgagctgggaccgctcgatgccctggaggaggagaggaaggarcagcgggaggaatttgagcacaatctgatggaggctggactggagcttgagaaggacttggaggtgagtcaggcgggtggccagggacttggagatggaa

SEQ ID NO: 77212 - DNA, 201 bp, Homo sapiens
ctcaaccctggttgtaccatagaatcaccccagataaattaagtccaaatctgtggaggtgaaacccagacatcaatattttaaccttcttgggtgattckaatgaatatccaaggttgagaacccctctgtgttcccatttgtctttttccagttgcggaatcctaatattttaagtctggcttcccatgacaggctcct

SEQ ID NO: 77213 - DNA, 201 bp, Homo sapiens
gctcttagaaaagggctttccacccagatctactccgttcttccccatgtagaacttctccttctggaggtgagagcatgcacaggtctagccacacactmgtgtttgtttctacttgggaccagtatcacctgtttgtgagacagccagtaggctttacaaaaacagcctagactgaagaatggatgatgaaatccagct

SEQ ID NO: 77214 - DNA, 201 bp, Homo sapiens
acctggcccaaggcttccctggccactcgctggctatcgtctccaatggggagacaggcaaggagcctcatgctgggggcccaggtgacattgagctgggrccgctcgatgccctggaggaggagaggaaggagcagcgggaggaatttgagcacaatctgatggaggctggactggagcttgagaaggacttggaggtga

SEQ ID NO: 77215 - DNA, 201 bp, Homo sapiens
tgtggaggtgaaacccagacatcaatattttaaccttcttgggtgattctaatgaatatccaaggttgagaacccctctgtgttcccatttgtctttttcyagttgcggaatcctaatattttaagtctggcttcccatgacaggctccttctccacacagaataggtcttgtatgcttctgtgccccttctccagaactt

SEQ ID NO: 77216 - DNA, 201 bp, Homo sapiens
gccaaaagggcacttatgtggttttattactgtgctacttgctgtctggaggctcagaatgggagccatcatcaagggacatagacacaaagagctgagamaaagaagctagcacagaggacagctaggctcctgtcttaacaacgattgcattagctaagtgctttatagtcacctgcttttgatataatcatgaagctg

SEQ ID NO: 77217 - DNA, 201 bp, Homo sapiens
gccaggtcatcaacaactatctggatgccaatgagcctgtgtccttggaggcccgtcttagccgcatgcacttccatgacagtcagaggaaggtcgactaygtacttgcctaccactaccggaaacgcggggtgcacctggcccaaggcttccctggccactcgctggctatcgtctccaatggggagacaggcaaggagc

SEQ ID NO: 77218 - DNA, 201 bp, Homo sapiens
tgattggaagagctgttttaggctttaacctcagtcccagtccattttgggtaggagaaacctattcctactttggagagatgagaataagaatgatatcwttaatcttggttacacccaggaggaagagatgggagatgtttatgggtggtggagaatgatgagggacacggagggagcccattgaatatacccaggatg

SEQ ID NO: 77219 - DNA, 201 bp, Homo sapiens
tctctttgtactgtcttatatgctggctataggatttttaagcagagtatatttaaattaaggatattttgctgcaagtcttcgtattgttaatgtatccrtgaatggagagttttaattggcttccattattagagccagattattataagtaaagactactttactcactgtcatctttactagtgactttggcagctt

SEQ ID NO: 77220 - DNA, 201 bp, Homo sapiens
ctcagggttatcgtgaagattacataaattgatacatgtaaagtgtttaaaacagtgtctgacacatgtaaagtgttagcgattagtgttgtagttgttaytagtagggcagttctatgttcagttcagcacaggggaatccatcctgtttcaaaattcactcacaagaaaggattcctcagttccctacatcgttacctc

SEQ ID NO: 77221 - DNA, 201 bp, Homo sapiens
ttaactcagttggttaaaatgattttctatatttcctagatggcatccctctttctctttcatccagggggtgtctgtcaccctttccctccatccagatwagggcatgtgcatgcacacccatatgtcctctgctagggctgagatctttcacctttgctgtcaagtctgttttgcaaaacctacccaggtttccagaag

SEQ ID NO: 77222 - DNA, 201 bp, Homo sapiens
ggtctgactagtttaaaatggcttcagggctctagaaactcaatcttctggctggaatgttgggcggcagcactgtgtgacagcactgggctgagagtctrgagacgtgagttctggtctgggcctggccactaagtgctaccatttctttgggcaagccccaattcctctttgatcttcagggtcctggttgtcctaact

SEQ ID NO: 77223 - DNA, 201 bp, Homo sapiens
gtctactttccttcctctctagtctaccttccttccttactcgtctaccttctttccttattagtcactttcttaccagtcttccttccttactagtctaycttctttcctcactcgtctaccttctttccttattagtcactttcttaccagtcttccttccttactagtctaccttctttcctcactcgtctaccttct

SEQ ID NO: 77224 - DNA, 201 bp, Homo sapiens
agtctaccttccttccttactcgtctaccttctttccttattagtcactttcttaccagtcttccttccttactagtctatcttctttcctcactcgtctrccttctttccttattagtcactttcttaccagtcttccttccttactagtctaccttctttcctcactcgtctaccttctttccttattagtcactttct

SEQ ID NO: 77225 - DNA, 201 bp, Homo sapiens
tttcttaccagtcttccttccttactagtctatcttctttcctcactcgtctaccttctttccttattagtcactttcttaccagtcttccttccttactrgtctaccttctttcctcactcgtctaccttctttccttattagtcactttcttaccagtcttccttccttactagtctaccttctttcctcactcgtcta

SEQ ID NO: 77226 - DNA, 201 bp, Homo sapiens
agtctatcttctttcctcactcgtctaccttctttccttattagtcactttcttaccagtcttccttccttactagtctaccttctttcctcactcgtctrccttctttccttattagtcactttcttaccagtcttccttccttactagtctaccttctttcctcactcgtctaccttctttccttattagtcactttct

SEQ ID NO: 77227 - DNA, 201 bp, Homo sapiens
accagtcttccttccttactagtctaccttctttcctcactcgtctaccttctttccttattagtcactttcttaccagtcttccttccttactagtctaycttctttcctcactcgtctaccttctttccttattagtcactttcttaccagtcttccttccttactagtctaccttctttcctcactcgtctaccttct

SEQ ID NO: 77228 - DNA, 201 bp, Homo sapiens
gcacatgcatgcgtgcgcacatatgtgcataagtatatgtaagcactcatgtatgaattttcctgaatcttttccaaagacagaaaatttagaagctcttmcaccatgcttccataatatcctggccatggctatatcacaactactccactgcactgtaactgtttcatagcccatctatctctgttagaacactaagca

SEQ ID NO: 77229 - DNA, 201 bp, Homo sapiens
accatgcttccataatatcctggccatggctatatcacaactactccactgcactgtaactgtttcatagcccatctatctctgttagaacactaagcatmctggaccacaaaggtcatagcccagtccccacaacaccatgaatgcttataaaatcattgtaaaatgattcttctcaattgtctaggcaagtagggccac

SEQ ID NO: 77230 - DNA, 201 bp, Homo sapiens
tcaggatgataagagatgtttcagctcacagctgtacactggccctatgaaattcggcaacaggaattgccccgcgttccctcctcaccctgaccaactcsttcctttatcggaactgtttttgatagttcagtacatccagaaagaaaaatcaggagaaattctctgagtttgttgttgtttatttattttattttattt

SEQ ID NO: 77231 - DNA, 201 bp, Homo sapiens
ctcaggatgataagagatgtttcagctcacagctgtacactggccctatgaaattcggcaacaggaattgccccgcgttccctcctcaccctgaccaactmcttcctttatcggaactgtttttgatagttcagtacatccagaaagaaaaatcaggagaaattctctgagtttgttgttgtttatttattttattttatt

SEQ ID NO: 77232 - DNA, 201 bp, Homo sapiens
acttgggcttctgtggaaggatggaatgaagtgaggcttcctccctccttcctaactggctagacctcccccgttccagaagggcccatgtcttggacttygaacaaaaatgagagcaatgaaaccaaagctgccccccgcctctggtgtgcttgacatggaaggatggaatgaagtgaggcttcctccttccttcccgac

SEQ ID NO: 77233 - DNA, 201 bp, Homo sapiens
gctcaggatgataagagatgtttcagctcacagctgtacactggccctatgaaattcggcaacaggaattgccccgcgttccctcctcaccctgaccaactccttcctttatcggaactgtttttgatagttcagtacatccagaaagaaaaatcaggagaaattctctgagtttgttgttgtttatttattttattttat

SEQ ID NO: 77234 - DNA, 201 bp, Homo sapiens
aatggtggagtgactgccgtggtcacagagttagctcatgggaaaggtgggctgagatttggtctcctgactcctgttcagtgcgattgttagggcatcaygagtgtagactgtactgtccctgcactgtttaatttaatatttaatgccagggtaatgctttcagtattcccaccaaagggattagtggaggaaaaaata

SEQ ID NO: 77235 - DNA, 201 bp, Homo sapiens
ttcacaacaacgacatgaggtagatatgaccgttagcttcattttatagatgagaaaattgaaactcagagaggttaataaacttatccaagggcacacascttgaaggagatagtcagggactcaaaatcatgtctgtctgactccaaagccacgctcctgctctctcactttactgaaaaatccataactggacttgag

SEQ ID NO: 77236 - DNA, 201 bp, Homo sapiens
gttaggttaaagaatattgccacggtcatataacaggccaggcagttgcaaagccagcgtacaatgcactttctctgaccctcggccacccttctttccayggcatcccgaatctcccccagaagggcaccgtgtcaacctagaaagagcttgaacccttaagcaaggtcaaagactcttcctcattcccaagccacaggg

SEQ ID NO: 77237 - DNA, 201 bp, Homo sapiens
ttgtactgtcttatatgctggctataggatttttaagcagagtatatttaaattaaggatattttgctgcaagtcttcgtattgttaatgtatccgtgaayggagagttttaattggcttccattattagagccagattattataagtaaagactactttactcactgtcatctttactagtgactttggcagcttggaag

SEQ ID NO: 77238 - DNA, 201 bp, Homo sapiens
ggaggtgctaactctggaggcaagaggattgggtgctttcatgggaagggtaagctcaggatgttaagttacttacgtatcttacagagccttcaagtttrgggaactggatcagggtgttgcagggagggaggtgatctgtaatttaactaggcttctacatctctaatctctttagaacaaacctctgagacaagatgt

SEQ ID NO: 77239 - DNA, 201 bp, Homo sapiens
aatgagcattttttctttaagttgctttgagaggacatttaatttggttgctttttagttatgtctcatttttatgcaaaatagtaatgccaccttcctamtctggtttagcttagaagtgcttttccttgtttccttggtggtctctgagctcctcctgggcagagctgaaccttctcctcagcgtgtcctcagtatcta

SEQ ID NO: 77240 - DNA, 201 bp, Homo sapiens
ccttcctaatctggtttagcttagaagtgcttttccttgtttccttggtggtctctgagctcctcctgggcagagctgaaccttctcctcagcgtgtcctyagtatctagcacagagcctggcccattggcactgttcagactgtgtctgttgagtgggactgaaccaagactccagggggactcaggaaaagtccctccc

SEQ ID NO: 77241 - DNA, 201 bp, Homo sapiens
aaaactttagtgtgtgagtgaaactaagaattaatactgaaggaaaatgaaagaagctctactccctcttgatgtttggccttatctggaagaatatgaaygagtcttgttctaatcccatcagaaataggttcatatgttcttatttcttcaggatggccacaagatgtagttaccttgttctcattgtgtgatggaaag

SEQ ID NO: 77242 - DNA, 201 bp, Homo sapiens
gaaaatgaaagaagctctactccctcttgatgtttggccttatctggaagaatatgaatgagtcttgttctaatcccatcagaaataggttcatatgttcytatttcttcaggatggccacaagatgtagttaccttgttctcattgtgtgatggaaagcctgttgggctaagagtctagcaaccggattctatcactaag

SEQ ID NO: 77243 - DNA, 201 bp, Homo sapiens
catagagagagacttgggctgctggtggcagcggaaggggcggtgtggagtcaggaggtcttgggggatactagtcagcaggacccaagtctgttggctcmcctgtaggtcggacttcaaactccagggtatgttgggaaagagagtgaagtcctactgaaaagggaaggaaagagacagggtttcagaactcttttccga

SEQ ID NO: 77244 - DNA, 201 bp, Homo sapiens
atgctgccctgtggttgggtcgtatctgtcatttgtccactgctttactatattcacatggttctcactcaaacaaaacaaagaaaactgtcctgtgtagyaggcagggcaggtatcactaccgtgcccaatttacagatgaaaaaataaatgtcagaaatgttaataagagacatatctaggatcacacagctgataagt

SEQ ID NO: 77245 - DNA, 201 bp, Homo sapiens
ctttaggccagattgtctacaaattacaattaaaaataatagtaatgcctctcattaccatgattattatgattagtggtgctgtgctgggtgggcctggktcagggcccaggtctgctgggaataaggctgggaagaaatggctgtacatagagagagacttgggctgctggtggcagcggaaggggcggtgtggagtca

SEQ ID NO: 77246 - DNA, 201 bp, Homo sapiens
tagaagggcagttgttgatatggagagtaaggcatcagtgactagaaatatatctatatagagtgataatgatcaatcgcatgcaaatatatgcaaatgaragcaaattaatatctgttatttgtgcctcctgattgtctctactctcccgtttctccccaggatgatgaagataaactgacctggaaggatcgtttccca

SEQ ID NO: 77247 - DNA, 201 bp, Homo sapiens
ccttctttccttataggccttccttccttgtgattacccagggcttgatggaaggagccagattctgtttagctttaattcccaatgttttatacaatacstgggaagttaaatgggtctgcaatgaatgaacagagatgtgaaatactgcacgtatatcatccccaccccaacctcccaaagaatggtcatttgctgtgc

SEQ ID NO: 77248 - DNA, 201 bp, Homo sapiens
atatctatatagagtgataatgatcaatcgcatgcaaatatatgcaaatgagagcaaattaatatctgttatttgtgcctcctgattgtctctactctccygtttctccccaggatgatgaagataaactgacctggaaggatcgtttcccaggttacctgatgaactttgcctccatcttattcatggtaatttccttga

SEQ ID NO: 77249 - DNA, 201 bp, Homo sapiens
tgtgattacccagggcttgatggaaggagccagattctgtttagctttaattcccaatgttttatacaatacctgggaagttaaatgggtctgcaatgaaygaacagagatgtgaaatactgcacgtatatcatccccaccccaacctcccaaagaatggtcatttgctgtgcttggagcctggcatgatggtgtgggtaa

SEQ ID NO: 77250 - DNA, 201 bp, Homo sapiens
gggttgcgagatggtgcttctgcatggagacagaccaaaaacttggagaaggaatcaggtaagatggctgcaattgcagcagcctgtttgggctgtggggyggccctctctgacgtttgtggatagaccagggtctggaagccacaggagatagccagcttgggctcggtaagtgtgatccttccgctttcctgtagttgc

SEQ ID NO: 77251 - DNA, 201 bp, Homo sapiens
cagggcatgccttcagcaggaccatggttgcctactcttcttaggatgaagaccaaattgtcatatatgacatacagggtctttcctgatcgagtccgcayctacccgtctggaccacttcatctcccaacactcatccactgctggccttccccctatacccccattacccacaccatcatgccaggctccaagcacagc

SEQ ID NO: 77252 - DNA, 201 bp, Homo sapiens
agaccaaaaacttggagaaggaatcaggtaagatggctgcaattgcagcagcctgtttgggctgtggggtggccctctctgacgtttgtggatagaccagrgtctggaagccacaggagatagccagcttgggctcggtaagtgtgatccttccgctttcctgtagttgctgggtttatttccttgcgctttaccttagag

SEQ ID NO: 77253 - DNA, 201 bp, Homo sapiens
agaaagtgactaataaggaaagaaggcagacgagtgaggaaagaaggtagactagtaaggaaggaagactggtaagaaagtgactaataaggaaagaaggyagacgagtgaggaaagaaggtagactagtaaggaaggaagactggtaagaaagtgactaataaggaaagaaggcagacgagagaggaaagaaggtagact

SEQ ID NO: 77254 - DNA, 201 bp, Homo sapiens
tggaaaacccaaacaccgcatgttctcacttataagtgggagctgaacaaatgagaacacatggacacagggaggggagcaacacacactggggcctgttrggagatggaagggggtagggagagcattaggcaaaatatctaatggatgctgggcttaatacctaggtgatgggttgataggtgcagcaaaataccatgg

SEQ ID NO: 77255 - DNA, 201 bp, Homo sapiens
agaaagtgactaataaggaaagaaggtagacgagtaaggaaggaaggtagactcgtaaggaaggaagactggtaagaaagtgactaataaggaaagaaggyagacgagtaaggaaagaagatagactagtaaggaaggaagactggtaagaaagtgactaataaggaaagaaggtagactagtaaggaaggaaggtagact

SEQ ID NO: 77256 - DNA, 201 bp, Homo sapiens
agaaggcagacgagtaaggaaagaagatagactagtaaggaaggaagactggtaagaaagtgactaataaggaaagaaggtagactagtaaggaaggaagrtagactagtaaggaaggaagactggtaagaaagtgactaataaggaaagaaggcagacgagtaaggaaagaagatagactagtaaggaaggaagactggt

SEQ ID NO: 77257 - DNA, 201 bp, Homo sapiens
agaaagtgactaataaggaaagaaggtagactagtaaggaaggaaggtagactagtaaggaaggaagactggtaagaaagtgactaataaggaaagaaggyagacgagtaaggaaagaagatagactagtaaggaaggaagactggtaagaaagtgactaataaggaaagaaggtagacgagtgaggaaagaagatagact

SEQ ID NO: 77258 - DNA, 201 bp, Homo sapiens
ctaataaggaaagaaggtagactagtaaggaaggaaggtagactagtaaggaaggaagactggtaagaaagtgactaataaggaaagaaggcagacgagtraggaaagaagatagactagtaaggaaggaagactggtaagaaagtgactaataaggaaagaaggtagacgagtgaggaaagaagatagactagtaaggaa

SEQ ID NO: 77259 - DNA, 201 bp, Homo sapiens
agaaggtagactagtaaggaaggaaggtagactagtaaggaaggaagactggtaagaaagtgactaataaggaaagaaggcagacgagtaaggaaagaagrtagactagtaaggaaggaagactggtaagaaagtgactaataaggaaagaaggtagacgagtgaggaaagaagatagactagtaaggaaggaagactggt

SEQ ID NO: 77260 - DNA, 201 bp, Homo sapiens
agatataataatgacaccttctcccaaatcaccgaagtaaaaactaagctcagagaaagggtttgtcttggggcagggtgctggtggtgaggccttcctcyggcaacatcacatgggtcctcgtggcctgcacctcctcccaatcctgcacaacccaacttgtggaaccttactcatgtctaggttggaaggaaattagct

SEQ ID NO: 77261 - DNA, 201 bp, Homo sapiens
gagggtgagaacatagtataaagcagccatctctgggtttctctccccactttgcattttggtagacacagcactagtcgagtcctcagaagaagagacttctaaccttggttctgcagttattcgttgtgtggtttggggacgtcatcccatctctcagagcctcagttgcctcatctatgatatgggcatactcatacc

SEQ ID NO: 77262 - DNA, 201 bp, Homo sapiens
gctcttgagggtgtcctggccagatggatgtttgtaaggacccctggctgccttgtggggaacagggacagggagcagggagatctgttaggagggcatcrccgtcctccaggggaaggaggctgacagctggcactagggtgggactcatggaagggtgaagaacagaggggtttggcagacatttcaggggtaaagttt

SEQ ID NO: 77263 - DNA, 201 bp, Homo sapiens
ggagaagatcgtatgtttggatttgggcatgttgactttgaggggctgggaaacatccaagtgtagatgctgagcaggcaggggaatgtgtggacctggtscctgcaggagagcaagagttagagtgaaacttaagtgtcgtcagcaataggtgacaatgaaggtctctggagtggatgagagtgcccagggagagagctg

SEQ ID NO: 77264 - DNA, 201 bp, Homo sapiens
ggaatgtgtggacctggtgcctgcaggagagcaagagttagagtgaaacttaagtgtcgtcagcaataggtgacaatgaaggtctctggagtggatgagartgcccagggagagagctggaacgtggagaaaggcccaggccccagccttacgacatccatctcctcaacccagacgtgggtaagccatgcccccaccctc

SEQ ID NO: 77265 - DNA, 201 bp, Homo sapiens
cgagattgggcacaagggaggaagccccttttttagagccctgagcctgagccccatcacatgtaaaccaaaaaatatctgagacaggcctcaatcaattycgtttattttgccaacgttaagaatgtggttggaagagaggtctgtgtctttctccaaagatcattttgagggcttcaatatttaacggggaaaagcagg

SEQ ID NO: 77266 - DNA, 201 bp, Homo sapiens
ttattttgccaacgttaagaatgtggttggaagagaggtctgtgtctttctccaaagatcattttgagggcttcaatatttaacggggaaaagcaggctgygggggaaagagggaggctgtgggaatctgcatgttgcaggagaaaaggagcagttagggaattatcaatgatgtattcatcttgcgctttggacaaggtg

SEQ ID NO: 77267 - DNA, 201 bp, Homo sapiens
tgctggtcacagttgtgtttcctgcatgtcagctctgtcttcataaagagattatgtttctcaagtgcagggaccgaatgttctaggacccctgaaactgygctggagggctgagcacctaaggggctgctccacaagttggcaaagggccgggagttctgtttcaacagactggaagagttgcttttgttcattcattca

SEQ ID NO: 77268 - DNA, 201 bp, Homo sapiens
gagtagttactgttcccgggtacctgggtttcagctttccaatcgagagatgctatgtacagttggttatgcctggtcggcttcaatcattttgttatctkcctggctcctgtgggcattggaatttttaaccttgctactgtttctcttaaatggtataattctttttctttctttgtttcttgcattcttactttaatg

SEQ ID NO: 77269 - DNA, 201 bp, Homo sapiens
gctgcgtcagggaaagctcagggaaaaccctgtgattcgtatttgacttagatcaataaagtggtagcagttcattcttcgttgccagcatgggcaagacmgcagtatctgaagctagaggaccttggggaaggcaaaaatcagaggactaagttagggttactaataccccatatctctttatggaaatcttccttacag

SEQ ID NO: 77270 - DNA, 201 bp, Homo sapiens
tgagagattatgacagccatgatccgaaggagctcctgctggtggctccacgctgtgtgtgtgcgtgtgtgtgtgtgtgtgtgtgtatgtgtgtgtatgcrtgtgtgtatgtgtgcatgtgtgtgtgtatgtgggtgtgtgcgtgcgtgtgtgtgtatgtgtgtgtgcgtgtgtgtgtgtgtgtatgcgtgtgtgtatgtg

SEQ ID NO: 77271 - DNA, 201 bp, Homo sapiens
cagccttgcttttcaaggcttactgccttgttttttggaagccttgtcttttgttagcttggcctcctgtgcttccttcagatgagaactcacctcgcagsttagtctccgactgagccagagtgttacatatgcttgacctgaactgaatgtagtctggcctgagagcagagggacaaacaagatgacctgcagggaatc

SEQ ID NO: 77272 - DNA, 201 bp, Homo sapiens
tatgacagccatgatccgaaggagctcctgctggtggctccacgctgtgtgtgtgcgtgtgtgtgtgtgtgtgtgtgtatgtgtgtgtatgcgtgtgtgtrtgtgtgcatgtgtgtgtgtatgtgggtgtgtgcgtgcgtgtgtgtgtatgtgtgtgtgcgtgtgtgtgtgtgtgtatgcgtgtgtgtatgtgtggatgtg

SEQ ID NO: 77273 - DNA, 201 bp, Homo sapiens
ataatgaaaagccagtcggatgtaattgatgtaataactcccttcccttttaacattgggttttcataatggaattctttctctgtcatgtgatacttttsatcagttgtatgcagtttatggatctgtgtgaacatcatctagaggaaaaatttattgatttctttcatgtcatttttttttgctctgcattaatatgat

SEQ ID NO: 77274 - DNA, 201 bp, Homo sapiens
gctgtgtgtgtgcgtgtgtgtgtgtgtgtgtgtgtatgtgtgtgtatgcgtgtgtgtatgtgtgcatgtgtgtgtgtatgtgggtgtgtgcgtgcgtgtgygtgtatgtgtgtgtgcgtgtgtgtgtgtgtgtatgcgtgtgtgtatgtgtggatgtgtgtgtatgtgggtgtgtgtgcgtgcatgtgtgtgtatgtgtgt

SEQ ID NO: 77275 - DNA, 201 bp, Homo sapiens
gtgtgtgcgtgtgtgtgtgtgtgtgtgtgtatgtgtgtgtatgcgtgtgtgtatgtgtgcatgtgtgtgtgtatgtgggtgtgtgcgtgcgtgtgtgtgtrtgtgtgtgtgcgtgtgtgtgtgtgtgtatgcgtgtgtgtatgtgtggatgtgtgtgtatgtgggtgtgtgtgcgtgcatgtgtgtgtatgtgtgtgtgcg

SEQ ID NO: 77276 - DNA, 201 bp, Homo sapiens
acaatttctaactaagaattctatgcccaagaaaaatatcatgtagtgataaggataaaataaagatatttatagacaaatagaaactgagagtttgctaycaaccgaatctctcattaaaagaaattctaagaatgtaccttggatgtgatcccatatggaagaccatggttttagaaaggaatgaagaacttttaaagt

SEQ ID NO: 77277 - DNA, 201 bp, Homo sapiens
tggtaaatatgtgagaaaacctatatgaaccttgactgtgaaaataataatgccaattctcatgaggttaaaaaagatagaactaaaatatatgcaacaayactatgtaagttgggtggacaataaatagaacaataatgttctaaggtctttagattgtccagtcgataaactgattttaagatttatgtggaagcacaa

SEQ ID NO: 77278 - DNA, 201 bp, Homo sapiens
aggcatattcatacaattaaatactacacagtcatgaaaatgagcaaactaatagctatgtataacatcaagggtgaaaaaaacaagatgaaagaatatayacagtttgattctactcatagagagttcagagacaatactcaactatattgtttaaggatgcatacctctgtgttaaaactatcaaatgagcaagagaat

SEQ ID NO: 77279 - DNA, 201 bp, Homo sapiens
gagagatgtaatgatatagcctttctccacctcccatgggttctcacttaattgcatccccatcccactccaccccactgcattaccatatattgggtacmcactctactctagtcctaggtatttcgcatataccctgaggctaatactatcatgaactctgtggtgaaagagagaatatacatatgcattctgccttca

SEQ ID NO: 77280 - DNA, 201 bp, Homo sapiens
gaggctttgagactatgcgcttctgacaatcattgcccagctagaggttgcaaaaacctccttctccatccaccaccacagcctgctcagccatgctctakctggtgagaaggggcttactgtccaaatcattgcagtcctgtcactgaatggaccccacattatttccaagcattactttaactttcataaagaataaag

SEQ ID NO: 77281 - DNA, 201 bp, Homo sapiens
ggaattcagagctgctggcagtgctggtctgggctatattggtgtttgttttattcattgtgtgtgtgtgtgtgtgtgtgtgtaaaatggatttttctgcrtgttcacaataaaatttaaaaagacacaaaatacatatattaaataggttggtcaggtaagttctcattaagatgacattttatcaaggatctggaggag

SEQ ID NO: 77282 - DNA, 201 bp, Homo sapiens
acaactataactctcaaagaatttttcttaacatatataaagaattaaaaaacatggaaaacagtaattcagtacaaaataggaaaaagatgaatatgtasttcacaaaagagggaatccaaatggccaatgagcctataaaatggtacccaatctcattagtaatcctggaaattctaatttaaaccacaatgagatacc

SEQ ID NO: 77283 - DNA, 201 bp, Homo sapiens
gcgccgaagtaactgagcagaagcggctagtgagataagaagaaaaccaacaaaaagtggagtcccagggggtcatgcgaggaacatgtctcaggatgaarggagttattaacgtctcccattattgttaataaacaaggatttttacaacaaggtgattggccctcggaaacaatacttttcaatcttctttgttctcag

SEQ ID NO: 77284 - DNA, 201 bp, Homo sapiens
tgttccctcaaaccccatagttaatccactggtaagtgcctttgactctactactaaaatctatccttgctctgaacatctttcactctgttcatactgcraacctagtccagatccccagcagttcttgccaggggtattgcatcatccgcctgcctgctgtatctggagcctcattcccttagagtctagtctccatac

SEQ ID NO: 77285 - DNA, 201 bp, Homo sapiens
aatgccagaattataggtgtgagccactgtgcctggcctgcattcactcttctttctgttcctcccacacaccagtgcatatccaccccagggtctttgastggctcttccttcttctggaaggctcttactcaatgatggctttggctacctgctcctcactctgccctctcctcatcaccatctcagccctggctgcag

SEQ ID NO: 77286 - DNA, 201 bp, Homo sapiens
aaagaggaatataggaattttatacactgaggttcatctaaggggagctctggaaattcctgtccatggtatctagttagcaccacagaaaataggggttwaagaaagatgctgatgatgtgggtagtggtcctgcagggttgacaggtttggctgacagcctgtaagagcacaagtatgcttttcatgttgtgggggtgc

SEQ ID NO: 77287 - DNA, 201 bp, Homo sapiens
gggcctcactgacttgcgctgtaaactgcatgttcatctctaccttgaggatggggactgcatctttttcaatctctaagttcctaacacagggcttggcmagaaattattaggctgaattctttctatctcacaatttaatgtgtgcctttaggaaaatcctagaagacagagttgcctaagaatatttaacttcagatt

SEQ ID NO: 77288 - DNA, 201 bp, Homo sapiens
atgcctttatgatgggcctcactgacttgcgctgtaaactgcatgttcatctctaccttgaggatggggactgcatctttttcaatctctaagttcctaayacagggcttggcaagaaattattaggctgaattctttctatctcacaatttaatgtgtgcctttaggaaaatcctagaagacagagttgcctaagaatat

SEQ ID NO: 77289 - DNA, 201 bp, Homo sapiens
ccttcagcctgctgctgcactgtgggagcccctacctgggctggccgaggccggagtcggctccctcagcttgcagggaggtgtagagggagaggcatggkcgggaaccagggctgcgcgtggcgcttgggggccagcgcgagttctgggtgggcgtgggcttggcaggccccgcacttggagcaaccagccggcctgccg

SEQ ID NO: 77290 - DNA, 201 bp, Homo sapiens
ctctaaggacagtggccaggaagggcctcctgtcccacctcccaggaacatatcagccagctcagtgcacacaaagaaagccacagcccttttcccttggraggcaaacagtgatttgactctgacctgatttcctacccagatcacataaaatggctggaaggtgtgaggtgaggcagagcaaatcagcccactgcattt

SEQ ID NO: 77291 - DNA, 201 bp, Homo sapiens
ctttttacataaaaactgtggccccaaatgtgtccatctttcctctggcaaagagaaggccgaaaatttggcttcctaacccagagcctggagataccccygccacccagttggcgccctgaggatctcggctcaagtgtgggcaggcttggagccagtgtccaggcacttgtccagatctctggttggacagcccttcag

SEQ ID NO: 77292 - DNA, 201 bp, Homo sapiens
gtgtgtgtgtgtatgtgtgtgtatgcgtgtgtgtatgtgtgcatgtgtgtgtgtatgtgggtgtgtgcgtgcgtgtgtgtgtatgtgtgtgtgcgtgtgtrtgtgtgtgtatgcgtgtgtgtatgtgtggatgtgtgtgtatgtgggtgtgtgtgcgtgcatgtgtgtgtatgtgtgtgtgcgtgtgtgtgtgtatgcgtg

SEQ ID NO: 77293 - DNA, 201 bp, Homo sapiens
gtgtgtgtgtatgtgggtgtgtgcgtgcgtgtgtgtgtatgtgtgtgtgcgtgtgtgtgtgtgtgtatgcgtgtgtgtatgtgtggatgtgtgtgtatgtrggtgtgtgtgcgtgcatgtgtgtgtatgtgtgtgtgcgtgtgtgtgtgtatgcgtgtgtgtatgtgtgcatgtgtgtgtgtatgtgggtgtgtgtgcgtg

SEQ ID NO: 77294 - DNA, 201 bp, Homo sapiens
gtatgtgggtgtgtgcgtgcgtgtgtgtgtatgtgtgtgtgcgtgtgtgtgtgtgtgtatgcgtgtgtgtatgtgtggatgtgtgtgtatgtgggtgtgtrtgcgtgcatgtgtgtgtatgtgtgtgtgcgtgtgtgtgtgtatgcgtgtgtgtatgtgtgcatgtgtgtgtgtatgtgggtgtgtgtgcgtgcatgtgtg

SEQ ID NO: 77295 - DNA, 201 bp, Homo sapiens
gtgtgcgtgtgtgtgtgtgtgtatgcgtgtgtgtatgtgtggatgtgtgtgtatgtgggtgtgtgtgcgtgcatgtgtgtgtatgtgtgtgtgcgtgtgtrtgtgtatgcgtgtgtgtatgtgtgcatgtgtgtgtgtatgtgggtgtgtgtgcgtgcatgtgtgtgtatgtgtgtgtgcgtgtgtgtatgcagtcggggg

SEQ ID NO: 77296 - DNA, 201 bp, Homo sapiens
tgcgtgtgtgtgtgtgtgtatgcgtgtgtgtatgtgtggatgtgtgtgtatgtgggtgtgtgtgcgtgcatgtgtgtgtatgtgtgtgtgcgtgtgtgtgygtatgcgtgtgtgtatgtgtgcatgtgtgtgtgtatgtgggtgtgtgtgcgtgcatgtgtgtgtatgtgtgtgtgcgtgtgtgtatgcagtcggggggcc

SEQ ID NO: 77297 - DNA, 201 bp, Homo sapiens
tgtgtgtgtgtatgtgggtgtgtgtgcgtgcatgtgtgtgtatgtgtgtgtgcgtgtgtgtatgcagtcggggggccgcacttccttttccatgctccctyccttgtggccagtgtgaacctgggctttagggactaaccaaggaggcagctgtgaagcaaaatgggccattttctcagggctagtgtctgagtacactca

SEQ ID NO: 77298 - DNA, 201 bp, Homo sapiens
gtatgtgggtgtgtgtgcgtgcatgtgtgtgtatgtgtgtgtgcgtgtgtgtatgcagtcggggggccgcacttccttttccatgctccctcccttgtggycagtgtgaacctgggctttagggactaaccaaggaggcagctgtgaagcaaaatgggccattttctcagggctagtgtctgagtacactcagtacctcag

SEQ ID NO: 77299 - DNA, 201 bp, Homo sapiens
tgctcagaactctctgatggcttcccatctcctgaggtgtggaagcccacatcctcacactacagggccccctcctggctgcctgcccatctcccactccwcctgtccccttgctcactcagtgtcagccactgcctgcctgaaacacccttcccttaaatccttcctttaggtatttggtaaaaggtcactttctcagct

SEQ ID NO: 77300 - DNA, 201 bp, Homo sapiens
cctagtgagcagtgccacctgacagagagcctaggctttattctggcaggtggacttttttttctgctggagaaaccagattttgtttctttctttttttwaaaaaaattttttttgagacggagtcttgctctgtcaccaaggctggagtgcagtggtgtgatcttggctcacttcaagctctgcctcctgggttcctgc

SEQ ID NO: 77301 - DNA, 201 bp, Homo sapiens
gtgtgccaggggtggggctagggaggaaaggagggtgggaaagaaggcttttctagataaggagaacagtgctccttgaatttgaaaaagaattctgttamaatgcaggttccaggtcagtaggtctggagttgtgcttgagattccgcatttcaatcaagcttccagctgatgcagctggtccttggaccacatttttga

SEQ ID NO: 77302 - DNA, 201 bp, Homo sapiens
aaaccagattttgtttctttctttttttaaaaaaaattttttttgagacggagtcttgctctgtcaccaaggctggagtgcagtggtgtgatcttggctcrcttcaagctctgcctcctgggttcctgccattctcctacctcagtctcccgagtagctgggactataggcgcccgccaccagacccagctaattttttgt

SEQ ID NO: 77303 - DNA, 201 bp, Homo sapiens
gtggtgtgatcttggctcacttcaagctctgcctcctgggttcctgccattctcctacctcagtctcccgagtagctgggactataggcgcccgccaccasacccagctaattttttgtatttttttagtagagacggggtttcaccgtgttagccaggatggtctcgatctcccgaccttctgatctggcatcctcggcc

SEQ ID NO: 77304 - DNA, 201 bp, Homo sapiens
agtgcttgtcaaccagtggtgatggtgagccctgactcgggcagtcctgggatacctgcccaaatgaataaggggtgaaagaagaggacacaagggtggcyccctttgggaagagcagaagttgaggctctcgttccttcccttctgtcttcactccttccctaccatcaatgtttctctactgcatgatgaacaaagatg

SEQ ID NO: 77305 - DNA, 201 bp, Homo sapiens
aagttgaaaaaacaaaaacactttggatatagtttggcattatctagtgaaactgaaagtacatatatcctggggcccagaaattctactcctggatatcygtcttagaaaaacttgtgtacatgagcagcaaaatacgtgtacaagaacgtctatggaagccctgcttataataactcaacctggaaacagtccaaatgc

SEQ ID NO: 77306 - DNA, 201 bp, Homo sapiens
cctggcccaaggcttccctggccactcgctggctatcgtctccaatggggagacaggcaaggagcctcatgctgggggcccaggtgacattgagctgggaycgctcgatgccctggaggaggagaggaaggagcagcgggaggaatttgagcacaatctgatggaggctggactggagcttgagaaggacttggaggtgag

SEQ ID NO: 77307 - DNA, 201 bp, Homo sapiens
agttgtctctccttcttctatcccctctaagaggctttactcagggcacttgcttctcatagcatccttgtgcttcctggaaatgatccttccttggttgsgatggggacaggaggggacgtggggacagaagaaggaagaggggctgttgggcagatctaggtctaagagagtcccttcttattcttaggttctagagag

SEQ ID NO: 77308 - DNA, 201 bp, Homo sapiens
gagcctgtgtccttggaggcccgtcttagccgcatgcacttccatgacagtcagaggaaggtcgactatgtacttgcctaccactaccggaaacgcggggygcacctggcccaaggcttccctggccactcgctggctatcgtctccaatggggagacaggcaaggagcctcatgctgggggcccaggtgacattgagctg

SEQ ID NO: 77309 - DNA, 201 bp, Homo sapiens
accagcccaggagtggacaggactcgtgcctcatacctgagccaaggtgggcataggatgttgctgggtcacatgagtctctgctgtgtctggaacaaaargaactctgacttcttgagaacctactatgtgcctaggaactagaccatttacctacattaggtcattacagtaggttaatgacatacattgcatagagga

SEQ ID NO: 77310 - DNA, 201 bp, Homo sapiens
cactttctcagctgtctctttcccaaccaccctattttaaattgcaaccgatccctataccctgtttgccttctttgtctccacggtatttctcgtgctgraggtactacttattttacctatttattagtttattgtctatgttttcccactagaagatccactctgtgagggtagtgctttctgtttcctttttccact

SEQ ID NO: 77311 - DNA, 201 bp, Homo sapiens
ctctttccaggcatgtgcatatttgtgaacgttatctgtgtttcttcataagcatcttgagaaaaataagcagagaattttaattcagcatatttaatgayagacaggattctatggaagcacttcggaagaacatccaacactcctggggactcaggaggctttggagggagaggcgtttgactggagagcccagagata

SEQ ID NO: 77312 - DNA, 201 bp, Homo sapiens
aaaacagcagctcaccaaaacaggtcatgtgcttgagtctcccaggctaataagcagtagagccagaatttgcacccaggacccctgactccaacacctgygctgtgaaccactgttttagcaccagcttctctctgggatctctatagggaagatgaaaacaagtaaacaatgtgggctgcattctcaagggagtcgtga

SEQ ID NO: 77313 - DNA, 201 bp, Homo sapiens
atgtttttgagcaagactttgaaggctcgctcaaagacaagtagagttgctgagaagaagttgtactctgtggaggactgacatttctagatggacagccrctcactttcagccaagaccacttgtcctcccactgcccccagagaagggcagctccccacagagtgtccgaggtccatgcactgacttcttgtactcatc

SEQ ID NO: 77314 - DNA, 201 bp, Homo sapiens
ccgctcactttcagccaagaccacttgtcctcccactgcccccagagaagggcagctccccacagagtgtccgaggtccatgcactgacttcttgtactcrtctgtttcccccactgcatgatcgacttctccatggcagagaccttctcctgctcattagtagattgcctgtgtcaagcccatggcagggactcaatgaa

SEQ ID NO: 77315 - DNA, 201 bp, Homo sapiens
tggtcaccaccactcctctgtgctttctcttgagtgtggaaaagaacaactcagcatcatcttgtccttccgtctgcttccaaataagatcaagctttacmcattccacccagatgagcatctgttttgaatgctcatagatatctgctagatggttagctccttaaaggttcagatccacagtttatcccttcatttctc

SEQ ID NO: 77316 - DNA, 201 bp, Homo sapiens
ctgttaaaatgcaggttccaggtcagtaggtctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctc

SEQ ID NO: 77317 - DNA, 201 bp, Homo sapiens
tgagttaatttttgtacaaagtgtaaggaaggactcttacttaatttgctccaaatgttacacatatgtcaatgctgtctgagttttagaggtcgtgtcayacttttggcttatgccgagttcagattcaactggctccctgaatgcttgtccacctgagctggcattgatgtgagctatacccactcgcgtgcttttctg

SEQ ID NO: 77318 - DNA, 201 bp, Homo sapiens
tctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctcccacaagaccctaaacaaaggatgtttttg

SEQ ID NO: 77319 - DNA, 201 bp, Homo sapiens
tgcagaaaattgaaactggacccctttcttacaccttataccaaaagtaattcaagatggatcaaatagttaaatgtaaaacccaaaactataaaaccatwgaagaaaatctaggcaataccgttcaggacataggcacgggcaaagatttcatgacaaaattgctaacagcaatttcaacaaaagcgaaaattgacaaac

SEQ ID NO: 77320 - DNA, 201 bp, Homo sapiens
  misc_feature (1)...(201): n = A,T,C or G, or insertion/deletion polymorphism (see Tables 1-2)
ggtcgtgtcacacttttggcttatgccgagttcagattcaactggctccctgaatgcttgtccacctgagctggcattgatgtgagctatacccactcgcntgcttttctgaacctaaatgtagagccttacagttgacccgttcaaatgtcccttgttaagttcagccaaccttgctaggcacctgagatcttcacggat

SEQ ID NO: 77321 - DNA, 201 bp, Homo sapiens
gcttaaacaagtttataagaaaaaaaaaacattaaaaagtggggaaaggacaggaatggacacttctcaaaagaagacattcgtgcagccaacaaacataygaataaaagctcaacatcactgatcattagagaaatgcaaatcaaaaaccacaatgagatgctatcttacaccagtcagaatagctactattaaaaagtc

SEQ ID NO: 77322 - DNA, 201 bp, Homo sapiens
actggctccctgaatgcttgtccacctgagctggcattgatgtgagctatacccactcgcgtgcttttctgaacctaaatgtagagccttacagttgaccmgttcaaatgtcccttgttaagttcagccaaccttgctaggcacctgagatcttcacggatatacctgctgccaagcagtgttttatctgctttccaacct

SEQ ID NO: 77323 - DNA, 201 bp, Homo sapiens
ttccttaaagatctagaaccagaaataccatttgacccagcaatcacattactgagtatatacccgaaggaatataaatcattctattacaaagatacatkcacatgtatgttcattgtagcactattcacaatagcaaacacatggaatcaacccaaatgtccatcaatgatagagtggataaagataatgtggtacata

SEQ ID NO: 77324 - DNA, 201 bp, Homo sapiens
ggaatataaatcattctattacaaagatacatgcacatgtatgttcattgtagcactattcacaatagcaaacacatggaatcaacccaaatgtccatcartgatagagtggataaagataatgtggtacatatataccatggaatactatgcagccatagaaaggaatgttattatgttctttgcagggacatggatgga

SEQ ID NO: 77325 - DNA, 201 bp, Homo sapiens
gtgggagctgaacaaatgagaacacatggacacagggaggggagcaacacacactggggcctgttgggagatggaagggggtagggagagcattaggcaamatatctaatggatgctgggcttaatacctaggtgatgggttgataggtgcagcaaaataccatggcacacgtttacctatgtaacaaacctgcacgtcct

SEQ ID NO: 77326 - DNA, 201 bp, Homo sapiens
caaaataccatggcacacgtttacctatgtaacaaacctgcacgtcctccacatgtaccctggaacttgaaataaaaataaacattttttaaaaagagctrtcaatacttccaaaagttgtgaccctggaaccatggcaatttgtactcacacttatacaatcctagaagctgactactaggtttaatcttttcatgaact

SEQ ID NO: 77327 - DNA, 201 bp, Homo sapiens
catgtaccctggaacttgaaataaaaataaacattttttaaaaagagctatcaatacttccaaaagttgtgaccctggaaccatggcaatttgtactcacrcttatacaatcctagaagctgactactaggtttaatcttttcatgaactaggagtcttcattaggtcaatgtaccagattaggaatgaccacaccaggag

SEQ ID NO: 77328 - DNA, 201 bp, Homo sapiens
atggcaatttgtactcacacttatacaatcctagaagctgactactaggtttaatcttttcatgaactaggagtcttcattaggtcaatgtaccagattargaatgaccacaccaggagaggtgccatctacttatctattaatcaatattaacactgaagttttaggccaactgtaaagagctaaccaactgtgaagtgt

SEQ ID NO: 77329 - DNA, 201 bp, Homo sapiens
gatgagaccaaggagagggcaagctcttacattaagctgtgcattttgttcactaagtaaagagttgccttgtgcgtgttctggaggccaactccagccayttctgtgcgttaatcatttgttatgatttgagctcattggaaaaaaatcccccagccagtggcacaggggggtggctctgtaccctgtggtacagagtag

SEQ ID NO: 77330 - DNA, 201 bp, Homo sapiens
ggtacagagtaggaagcctggctggatcagctgaggctgtggattccctggccgtcactccccaaccatgcagtgagtcagggcctggagtgcaaagagaygatgtgttgactccctgggtgggggtgggggtggggggtggtgggaccagagtgggaccagggactggaatgtggggcaggctgcagagtggagaggctc

SEQ ID NO: 77331 - DNA, 201 bp, Homo sapiens
cattctcctacctcagtctcccgagtagctgggactataggcgcccgccaccagacccagctaattttttgtatttttttagtagagacggggtttcaccrtgttagccaggatggtctcgatctcccgaccttctgatctggcatcctcggcctcccaaagtgctgggattacaggcgtgagccaccgtgcctggcctgg

SEQ ID NO: 77332 - DNA, 201 bp, Homo sapiens
tttagtagagacggggtttcaccgtgttagccaggatggtctcgatctcccgaccttctgatctggcatcctcggcctcccaaagtgctgggattacaggygtgagccaccgtgcctggcctggagaaaccagattttcttgcccaagggcttgagaaagagtcttgtgttgctagtggtcctgattaggggattccaggt

SEQ ID NO: 77333 - DNA, 201 bp, Homo sapiens
caggagaatggcatgaacctgggaggcagagcttgcagtgagccgagatcgcgccactgcactccagcctgcgtgacagagcgagactccgtctcaaaaargaaaaaaaaaatgaccttcccttgccatctcccccaaactcattcctacccttcccaccctccctaccttcctgcaggtcacgggcctcatcttgggtgt

SEQ ID NO: 77334 - DNA, 201 bp, Homo sapiens
aggagaatggcatgaacctgggaggcagagcttgcagtgagccgagatcgcgccactgcactccagcctgcgtgacagagcgagactccgtctcaaaaaaraaaaaaaaaatgaccttcccttgccatctcccccaaactcattcctacccttcccaccctccctaccttcctgcaggtcacgggcctcatcttgggtgtg

SEQ ID NO: 77335 - DNA, 201 bp, Homo sapiens
acccttcccaccctccctaccttcctgcaggtcacgggcctcatcttgggtgtgggctgatcaccttgacctcaggtctttgtgctattgccctctctgcyttgggcaccttgacctcaggtctttgtgctattgccctctctgctttgggcaccttgacctcaggtctttgtgctgttgccctctctgctttgggcacct

SEQ ID NO: 77336 - DNA, 201 bp, Homo sapiens
gtctttgtgctgttgccctctctgctttgggcaccttgacctcaggtctttgtgctgttgccctctctgctttgggcaccttgacctcaggtctttgtgcyattgccctttctgctttgggcaccttgacctcaggtctttgtgccgttgccctctctgctttgggcaccttgacctcaggtctttgtgctgttgccctct

SEQ ID NO: 77337 - DNA, 201 bp, Homo sapiens
attgtgccactgcactccagcctgggcgacagagggagactctgtctcaaaaaaaaaaaaaaaaaaagattcaagttaatgctttcctcaaactggaaggkatccccagaggtcattcatcctttcctttcccctgtccctaggcagaatggcatgtggcctggctcatgcctcgtggtgctggcctgtgctgctttgcca

SEQ ID NO: 77338 - DNA, 201 bp, Homo sapiens
gtgatcagatccctggggtcaggaaaggcatgcaggaaagtggcaaatgagccacttgggtggttgggagagtcttggtcaagctaaacaccagtggaacrggagctgagctcagcgtacgggagaaagaaagcatgaagtgtacgcaggatgccaggggagcccggtgccggggctctacgtccagggcacatccagggc

SEQ ID NO: 77339 - DNA, 201 bp, Homo sapiens
gttaatgctttcctcaaactggaaggtatccccagaggtcattcatcctttcctttcccctgtccctaggcagaatggcatgtggcctggctcatgcctcrtggtgctggcctgtgctgctttgccagacccttaaggcagaagacattcttcctgggttagtctttccacccatgtaggaagagggagctctcttaggga

SEQ ID NO: 77340 - DNA, 201 bp, Homo sapiens
caaatgagccacttgggtggttgggagagtcttggtcaagctaaacaccagtggaacaggagctgagctcagcgtacgggagaaagaaagcatgaagtgtrcgcaggatgccaggggagcccggtgccggggctctacgtccagggcacatccagggcacgatggagtgggaaactgtgctgacggagttgaccagaacgt

SEQ ID NO: 77341 - DNA, 201 bp, Homo sapiens
tcacattccaggcctgacttactagctcatgaccttgcttagcttacctcatccttttggtaaagcttcctggtctataaaaaggaaataacaggtctggktgcagtggctcacatctgtaatctcagcactttgggacggtgaggtggatggattgcttgaggtcaggagtttgagaccagcctggccaacacggtgaaa

SEQ ID NO: 77342 - DNA, 201 bp, Homo sapiens
gggagaaagaaagcatgaagtgtacgcaggatgccaggggagcccggtgccggggctctacgtccagggcacatccagggcacgatggagtgggaaactgkgctgacggagttgaccagaacgtgtttttttttttgttttgttttgctttttgatggaaaatctaaaatgccaggctgaggactccgatttttttcatag

SEQ ID NO: 77343 - DNA, 201 bp, Homo sapiens
acctcatccttttggtaaagcttcctggtctataaaaaggaaataacaggtctgggtgcagtggctcacatctgtaatctcagcactttgggacggtgagktggatggattgcttgaggtcaggagtttgagaccagcctggccaacacggtgaaaacctgtctctactaaaaatacaaaaaattagctgggtgtggtggt

SEQ ID NO: 77344 - DNA, 201 bp, Homo sapiens
aaagtgtttgctggagttcccaggggcattcagccataaacagtaccatcttcctggcctgattactgaaccagctgagaaattagatcaaggcaagagtrgacaaagccaaaatatcagctgtaaaactgagagcggctacatgggaggtagtagcttaggaagagagccaaacagacattctctctccatggcaggcag

SEQ ID NO: 77345 - DNA, 201 bp, Homo sapiens
tttgttctctctgagagtgatactcataaagtatttttaaacttaaaataaaatttgtaactccatttcatcttcacaaaaactgcatggccagcaagggmagtgttatacgctcactttactaaggttcagactcagattctacctctaaaatgtgaatctcttttgtgtgactttgatgtcagtttctcaccatctgta

SEQ ID NO: 77346 - DNA, 201 bp, Homo sapiens
gttggcttgctgcctccttttccttcttgtcttttctttcaaaactctttgcagaatgctggctggtgtacggggtggtgcacttcatccctccctcgccrtccaacctctccaagtcacagggttgggttcattgtagttgcttgaaaaaagagtattagtcaagtcaaggtttttaggaaaatggctgtgcttgggagg

SEQ ID NO: 77347 - DNA, 201 bp, Homo sapiens
gctgtgcttgggaggtgcttagacattactgacagcccactcctgagtgtcactgccccagatgctcctgaagcggggccagggatgagagtgaaaggagkgatggggaaaggccgtgagttccattgagggcccacctcataccaacactggtttgcatactttgccccacattatgacagtaacactgggaatgggtca

SEQ ID NO: 77348 - DNA, 201 bp, Homo sapiens
tgtgcattgatgcacaccctgcttaccctatatctcacacacatgcacacacttgtacacatgcatgcatgcacatgtgcacgcacgcgtgcgcgcgcgcrcacacacacacacacacactctctgcttaccctgtaccaaacactgttctaagcactttacatatatcagtatgtttaatccttaaaacagccccaggag

SEQ ID NO: 77349 - DNA, 201 bp, Homo sapiens
actgcaggaaaaaaaaatggaaactcacataagttctttagaaaaaaagcaaagaacaattattctgaatttgaccaccgttaacattttggtatagtttmtcctaatccttgcatgcatgtgtgtgcttgtgggtgtaaataaaacgagatgtactgtacattttgtgacctgagttttctactcaataattattgtgaa

SEQ ID NO: 77350 - DNA, 201 bp, Homo sapiens
tgaaaaaactgaatcccagaaggagaacattcctatagcaagtaatgacagagctgggtcttggaagcacatctcctgtctgtcaggacagagttatcctrtatcccaaccttagggcagatctgagaactgacgacagcaaggcaagggaatgggttacgaggccaaggacaagtgtggctcctcagcgaaaaatgtcaa

SEQ ID NO: 77351 - DNA, 201 bp, Homo sapiens
ctttcttatttgtgaaaatatgtgtgcatacacacagagacatacacacatgtgcacacacacatgcatgtgcacacacacacacacacacgagctgactsccttaaaccaggtagctgacctccatgggtccacactctgggtccaaactcaactgaaggaaagtgaactgaaggagacatttgtgaatttgattctcca

SEQ ID NO: 77352 - DNA, 201 bp, Homo sapiens
agtctcaggtcaagtgacttgcctaagatcatgcagccacataggaatatggtgctatcctagaaccatggtttccaaatcccacacgtgtgctcttggcrgtatgctctgctgcctctgtgttgatttttccttttgaatatcttcttagagaggaacaggagacttgtaaagttttatgtgggctcacagtttaaagag

SEQ ID NO: 77353 - DNA, 201 bp, Homo sapiens
cttaaggtcaaatcactatttgctgcctgaagaaaaaaaaaagaccttgcttagggacagaagtccttgtcctggtcttaggtcagatgagggggtaaagraactcttccaactgtcaaggaattgggtattttgccaccaaaaagtttcatgatcaaataatgatgatcataatcagtgaaagctggattaaactgaaaa

SEQ ID NO: 77354 - DNA, 201 bp, Homo sapiens
catgatcaaataatgatgatcataatcagtgaaagctggattaaactgaaaatagtacaggacttctccaagcctttcctatgaatttgcccattaaattycctaaaagagagagagaggctatgcgtattgaatatctgttagtacctggaaaatccagttttctgtttttcagtatgggggagaacagaaccctgcttg

SEQ ID NO: 77355 - DNA, 201 bp, Homo sapiens
attgcagtgatgagacccacagagggcagcagccatctcttaaggggtcaacttggagaccaaatccatcacttcttggaggtccagtagcccctgcaccytctgcgctttgcagagacatcctgcagttcagggaagaaacggagctgaagggcatgtggaagaagaatgtcacggagatgcaaggggttgggttattgg

SEQ ID NO: 77356 - DNA, 201 bp, Homo sapiens
catgcccagctgaagcccctcgtgccaaggacacagacttgcttctgccactgagctgtgactctgtccaggatgccttcagcctagcaggacagggcagrctcctggacacggagagcactgggcccagagaagaggcaggcatgtgtggggcatggtctctcctcgcctgcaggccacgcaggaaggaggaatccttct

SEQ ID NO: 77357 - DNA, 201 bp, Homo sapiens
gatgagacccacagagggcagcagccatctcttaaggggtcaacttggagaccaaatccatcacttcttggaggtccagtagcccctgcaccctctgcgcyttgcagagacatcctgcagttcagggaagaaacggagctgaagggcatgtggaagaagaatgtcacggagatgcaaggggttgggttattggttggctta

SEQ ID NO: 77358 - DNA, 201 bp, Homo sapiens
gcccagctgaagcccctcgtgccaaggacacagacttgcttctgccactgagctgtgactctgtccaggatgccttcagcctagcaggacagggcaggctsctggacacggagagcactgggcccagagaagaggcaggcatgtgtggggcatggtctctcctcgcctgcaggccacgcaggaaggaggaatccttcttaa

SEQ ID NO: 77359 - DNA, 201 bp, Homo sapiens
gattcttctcaattgtctaggcaagtagggccactgcaccagtgacatcttagaggcctgacccgaccagcctatcagtgtatcttaacccctcttgaggstcagaacaaattcctctgaactcagcactcactagggagttggagggggctgatgacagggctggtgtctagagtaggatgagatgagttctgggagcca

SEQ ID NO: 77360 - DNA, 201 bp, Homo sapiens
attgcagcgtctttttttggccagtttattattgttgcaagttcctgaaaatggtttcttctgccatcctagttaaaaaacaaacactattttagatgtaygttgtctgcatcctggcataagagcgatgactgtccataggtggaggctagaactgattgatgttgctaacaaaacaatgaacaatgtttctttactttt

SEQ ID NO: 77361 - DNA, 201 bp, Homo sapiens
atgagttaagactctgttgggaaggcatgattggttttgaaatgtgaggacatgagatttggaagagccagaggtggaatgatatggtttggctgtgtccmcctgcaaatctcaacttgaattgtatctcccagaattcccatgtgttgtgggagggacacagggtgggtaattgaatcatggggcctgttctttcccatg

SEQ ID NO: 77362 - DNA, 201 bp, Homo sapiens
tacaggccctggagcaaaaacagcgagggaggggtagttaaaaaacagcatttcccagcattgcccgtgaagcattttcaaaaacagattcctggccctcycccaggttctgagttggcagatctagggaagggccaggaatcggggtatttttaaaagccccccatgtgattccatggattagctaaagtgggacccagt

SEQ ID NO: 77363 - DNA, 201 bp, Homo sapiens
ggtatttttaaaagccccccatgtgattccatggattagctaaagtgggacccagtggcatcgccctcatgtcccatcccagcctctgcctgtcacagtgktggcctgtcttccccatggcctgagcgtcactgagtgccaagccccagctctcctcttcccatcctcctgggctgaaggcctgtgtttcaagtccccacc

SEQ ID NO: 77364 - DNA, 201 bp, Homo sapiens
taggaactaggagtattgagcctgaagaaaataagaataagaggagatttcatcaagaactttaaacaaatgctctaaggttccgttctccagtctgtggkctagaacataaagaaaaggacccaaattaagctgcaggcctggagttcagactaagaaattctatgtgacccaaagggacaggaagcactaggcagagga

SEQ ID NO: 77365 - DNA, 201 bp, Homo sapiens
ctcatggcctgctcgctagaggcaggagggtagatcagatcatagctgggtgtcacttaacactccttgctgcaatgcatatgagaaaagctgctcttcakgtctgtggaccacgcaattgactatttttctcaaactgttgagaggttgctatgaaccttttgcatttttccttcggttttcctcagatccatgagagat

SEQ ID NO: 77366 - DNA, 201 bp, Homo sapiens
gtgggagtgatgctggaatcgagaattgaaggctgagctgagggaggagctgggtggagagtgaggagaggagtcatgctaaggttttgctatggaagccrgcttggcgtgttctaagaacaggaaggaagccagtgtggctgagatggagtatacaaaagattgcatggcaagagataaagttggagaggagtcaaagcc

SEQ ID NO: 77367 - DNA, 201 bp, Homo sapiens
ctcagggcaactgatgcacacagtgggctggctcataaaaatgcataaagctcattaaccagagaccttcagccatgtgagaccagatggccacttgtacmtcctccctgagcccaggagcacctgggttttccttgattctcatctctgacaatgtcccaagggccctcaaatggaaaagcatactgcactccaacctgg

SEQ ID NO: 77368 - DNA, 201 bp, Homo sapiens
ctcacatctgtaatctcagcactttgggacggtgaggtggatggattgcttgaggtcaggagtttgagaccagcctggccaacacggtgaaaacctgtctytactaaaaatacaaaaaattagctgggtgtggtggtgcgcatctgtagtcgcagctactctggaggctgaggcaggaggattgcctgaactctggaggtg

SEQ ID NO: 77369 - DNA, 201 bp, Homo sapiens
tggttggtaccaagcccaggggcaaatggaacctgagtccagtccaggatttgatttctttctgattgtagtagagatgaggtttaagtacttagaaggarttgagctagaaatattttgggaaaaaatacactgaggagaagggagatcattgaaggggagggcacactccttcctctcaaaggcatgatctggaatttg

SEQ ID NO: 77370 - DNA, 201 bp, Homo sapiens
aaattcacactttattcagatttccttactgctgcctttttttttttttttttttttaacctgctgcgatttttctattcagagttgtcaggtctcctaaracttctcttggtggtgacagtttctcagaactgtatgcattcttaatttacatagaaggtactgttttatagcccattctgttttttacttttttctcta

SEQ ID NO: 77371 - DNA, 201 bp, Homo sapiens
tttgacaggatgataattggcacataccttccatttggcatttcactttttcattttttgtgcatatttccatgtattgatattgtccatgttcatatttyaaagacaattcagcattttatcaaatgtctttatatgtcatttgataaaatactaaattttctttcaagtatgaacatttgctttcttagtttgaccgtt

SEQ ID NO: 77372 - DNA, 201 bp, Homo sapiens
aagacgtcgttggagatgcttatgggtgacagagacgtctgcaccctaccaattcatataaatgagggccacctgttggtgctgtgcattgtgtcagagtkgggggctaatttaagcagttcaggagactgccccagccttgagcgtccagagagtttcctgtagtcctggcgggactgcgagtgggtgagctgaacaggc

SEQ ID NO: 77373 - DNA, 201 bp, Homo sapiens
agggggatatcttgggtgtgtgacatcgtgccctcccagggaggcccatttagcagagaggactgagaaaatcagaatgtcgcctcactttcttttttctytttttttcttttttgagatggagtctcactctgtcacctaggctggagtgcagtagcgcaatcttggctcactgcaacctccgcctcccgggttcaagtg

SEQ ID NO: 77374 - DNA, 201 bp, Homo sapiens
ttcctccaattctaagctactctagcaaaaggcaatatattattactgaggagagaagagcaggaggaaaggaaaaggatgggggaaaaatcagtgtcacmggtacaaatggctgccggggcaccaaacattctttaaagaagaatattttgagcatatatgaatctaatcttctaaatgtggacagtgtttgtttttgga

SEQ ID NO: 77375 - DNA, 201 bp, Homo sapiens
tatcttgggtgtgtgacatcgtgccctcccagggaggcccatttagcagagaggactgagaaaatcagaatgtcgcctcactttcttttttcttttttttycttttttgagatggagtctcactctgtcacctaggctggagtgcagtagcgcaatcttggctcactgcaacctccgcctcccgggttcaagtgattctcc

SEQ ID NO: 77376 - DNA, 201 bp, Homo sapiens
ttggagcatggggtgaaagtgttggctttattggatgcagtgctctgggatggggggtctgctctctgcagcggagcctgatcagggacagagtccagcayaggacatgggtgggcctggccggcgtgggctgcagaggggaatggggcctatgcctctctgcggggacgccacagtgctggtcatttgcaatctggcctg

SEQ ID NO: 77377 - DNA, 201 bp, Homo sapiens
atactgtgtcaagtagtaactcattagcccagcaccaattctgtttgtcaatgtggtgggttagggagtagggagaggcaaagcatgtgattgccccccarggctgcagataaaacagaaagaactttttcccaaagtttcttggtcccagactcgactcagggggactgttttggcttccttttaccacatggccccaga

SEQ ID NO: 77378 - DNA, 201 bp, Homo sapiens
tcttgggtgtgtgacatcgtgccctcccagggaggcccatttagcagagaggactgagaaaatcagaatgtcgcctcactttcttttttctttttttttcytttttgagatggagtctcactctgtcacctaggctggagtgcagtagcgcaatcttggctcactgcaacctccgcctcccgggttcaagtgattctcctg

SEQ ID NO: 77379 - DNA, 201 bp, Homo sapiens
ctctgcagcggagcctgatcagggacagagtccagcacaggacatgggtgggcctggccggcgtgggctgcagaggggaatggggcctatgcctctctgcrgggacgccacagtgctggtcatttgcaatctggcctgaaagttgggtctgctggcttgtattctcttcctgctttgcaccaggatcctggctctctgggg

SEQ ID NO: 77380 - DNA, 201 bp, Homo sapiens
gcaggtggatcgcttgagttcaagagtttgagaccaggctggggaaaatggcaaaactccatctttaaaaaagtatttaaaaattagctgggtatggtggygcacacctgtagtccgagcttcttgggaggctgaggtgggaggattgcttgaacctgggaggtggttgcagtgagccaagatggtgccactgcactccag

SEQ ID NO: 77381 - DNA, 201 bp, Homo sapiens
ctatggtcagtaattctactgtttagaacacagtgtaactggtaagaattccttcccagacatgagctgtgaccatgaacacatctctcatttccctgcaragtccttgcagcactcatctcttctgttagcaagaagtccaatatcttcctgtctttctctttggattttctaggagcccagggactaaagcatccagaa

SEQ ID NO: 77382 - DNA, 201 bp, Homo sapiens
cacatgagggtgcagagtgatgagatctcgaaaccgaaagtgacctttcaatggcagacacttccactgggcctcagaattgtctcctgtagttaaggggwatgagaatcaggccaaagatggggatgtggcacgttcaggctggtgaggacctgatatgcacaaatcaggcagggaggacctggcctcttggtggcagag

SEQ ID NO: 77383 - DNA, 201 bp, Homo sapiens
cagtgttatctggagagtgcggtacgacgtaatctggagaaggtggcacactgtgatctggagagtttggtatgctgtgaattggagagtgtggtacatcrtgatcttgagggtgtggtacagtgtggtctggagagtgtgacacactgtgatccagaaggtgtggtacggtgtgatcttgaggttgtgatacagtgttat

SEQ ID NO: 77384 - DNA, 201 bp, Homo sapiens
aaccttaggctcaagctgtttgtttcactcatcttgtctatgacaagcctttatcatttgagtgtatgactgggaagtgtcttaggttccccacaggacaygcagatgaatgctttcctgcattcatccaaattaatgctcaaattcattcagcattttttctgctaaaaatgaaggagagaaagaggaatcaagtcatgg

SEQ ID NO: 77385 - DNA, 201 bp, Homo sapiens
caagaggaggaaggtggacggagaaagacagtgatcctatattttttatccttctgtaacttcgtattacctggcagaccacctggggcctcccagatgasttcagttctaatgtgccagagagatgggtctcgtgatttttgctgtgaaggagtcagctgagagatagtagctcatgtctaggtcaaaactctggagagg

SEQ ID NO: 77386 - DNA, 201 bp, Homo sapiens
aacatggttgatctttctggcatggcctgcccccatcctgagtaatctcattagcctaaatttaggtatagtcctaggggtctgccaggaataacaaagayactcctatggagggaaattccaaggatttagatgttcatgcaggaatcggggacaaaggccagtgaaattctttattttacagtcagtctggatgtaaaa

SEQ ID NO: 77387 - DNA, 201 bp, Homo sapiens
atgattctgttcccctgaaacataatggacaacttgtctctcagggtgttcccaggtttggagaaggtctaggaagtgcttccccatgtcctacccaactwgccttttttggggtcctatcccatttattctggccccttgattttaataaagaagaagaactaaccaccattctctgttagttaacaaaatttgaaacca

SEQ ID NO: 77388 - DNA, 201 bp, Homo sapiens
tataaataaagtgttgggggaacagttatgaacggagacaacaagaagacttcagcaaaggaaaggcttacacagccttaaatggatgagtaggatttcarcaggtgaacacagggatgaccctgcaagtaagtaggattattctgattgtctgtctggttccatggtgggcttttactgttttgcttccccgacctgcac

SEQ ID NO: 77389 - DNA, 201 bp, Homo sapiens
tcctgtgttgacaccatgcatgagggaattgtctccaagcttgtttccaccctgtgagctcctctcagagaatctgttcacagaggaacaagccacaggartacaggccctggagcaaaaacagcgagggaggggtagttaaaaaacagcatttcccagcattgcccgtgaagcattttcaaaaacagattcctggccctc

SEQ ID NO: 77390 - DNA, 201 bp, Homo sapiens
tgagggaattgtctccaagcttgtttccaccctgtgagctcctctcagagaatctgttcacagaggaacaagccacaggagtacaggccctggagcaaaamcagcgagggaggggtagttaaaaaacagcatttcccagcattgcccgtgaagcattttcaaaaacagattcctggccctcccccaggttctgagttggca

SEQ ID NO: 77391 - DNA, 201 bp, Homo sapiens
cataagtatatgtaagcactcatgtatgaattttcctgaatcttttccaaagacagaaaatttagaagctcttccaccatgcttccataatatcctggccmtggctatatcacaactactccactgcactgtaactgtttcatagcccatctatctctgttagaacactaagcatcctggaccacaaaggtcatagcccag

SEQ ID NO: 77392 - DNA, 201 bp, Homo sapiens
ctattgtttccaaactgatatccactctctgagtcatccatgcaaatgaattctgtgatcagcgtgacccaagtgctggatccatgttgaatgagatttgragttccttgcttttatggagctgatgttttccttaaaaagccagttaggagatgaataaataaacaagatcactttggatagcaataagtgctgtggtag

SEQ ID NO: 77393 - DNA, 201 bp, Homo sapiens
ttatcaaagcattattaggattgtttgccccacactgctctgatttcttgaattcttgactctggtaacctccctccccgagttttgctatctcagtttcrctttgcagtgtgggagatggaaaaacaagctcattagaattttgggtaaagagagtgtaaaatgcatggcaggaggtctgaaggattctgctgtggaaaa

SEQ ID NO: 77394 - DNA, 201 bp, Homo sapiens
cgtgtagggataagggtcaggagaaagaatagagcaaataaaggagatgaaaatgaagtgggagtgggaaggtattttaaatagagtagtcggagaaggtsttcctgatgtaatatttgaggaaaacagggagcaagccacatggctgtgagaagacagatacatgcaaggaaagcaaataacacagaagacatggtggtg

SEQ ID NO: 77395 - DNA, 201 bp, Homo sapiens
gagcccaggagcacctgggttttccttgattctcatctctgacaatgtcccaagggccctcaaatggaaaagcatactgcactccaacctgggtgacagarcaagatcctatttcaaaaaagcataacaaaaaaaaaaaaatggaaaagtatattgcacttcttcacatttttcctctctttctggagtttcgctgtttct

SEQ ID NO: 77396 - DNA, 201 bp, Homo sapiens
agtgggaccaggtggtggaatgagttcacacaaggcagttgtgagattttgggataagaagagcagcccctgggtttgtgctgtagaaaacattgcccatmattaactgggtttccttatcagttggggccacagggtccctggtggataaagcaatgatgatgatgatgctgctgttgctgatgatgattttaatgatga

SEQ ID NO: 77397 - DNA, 201 bp, Homo sapiens
ctgcctgcccagggaatctgctgtagtattgcgatgtcttaacctcatctgttttctatccgatgctaatagtctcggtgtttaatttcctgaaaagtccygcatcagatttaaaggaaaaggaggaagcatgtctcaccacatctcacctctctcgcccaaccattttctgtcctcccactctctaatttttccttcctt

SEQ ID NO: 77398 - DNA, 201 bp, Homo sapiens
gtttcgctgtttctcagccttccctcccctaagcgctccacatattcatgtctcctcaagccagccatatcaaatcacaatgtgtcatggaggcacccagyacgggaatctcataagtggtgcttgatcaactttaggagcttgtgttcttgatgaggactttggaacaaactactgctatttgactctttctcagacata

SEQ ID NO: 77399 - DNA, 201 bp, Homo sapiens
gaaagcaaactatagctgctctcccctcaccttccatccacttccttatcatctgcagtgttggttttactcccactattcccttgaaatttcctcacaarggttgcagatgatcttaatggcaaattctaatggacgccttgctgctcttaacttacttgaactctctgtcaagaagagctgtgcctctatgtcccttcc

SEQ ID NO: 77400 - DNA, 201 bp, Homo sapiens
gaagacagggatgagaaactgtccattttatttctacctgccactggcctcagtgaattctaatagtgtctaggccatgccctgcatgcctccttacataragagggatctaagtgaggctggttaaatgctgccaagattgttttcagaactgaggtcctgatagcacctgataggagacacactggttgaacaaacaat

SEQ ID NO: 77401 - DNA, 201 bp, Homo sapiens
gaaaagtatggccaggcagcaacgggggcacacctgatgttgccagttgtgactgcatagtgacatcaatccatgcagttgtgtaattttttaagtggcaytcaggatcccttatcttattgagaagtgggatggctgctctgattcaatatgaggcactgttatgtggctctgttggaagaactcaggcacagaagcatg

SEQ ID NO: 77402 - DNA, 201 bp, Homo sapiens
aggagtgtcaaatgcatttattttgcataactctctaaacagttcatgccaaggactatcagtgttctccatattattagaagtagagtccttagcatttyggggtctaatcatattaagcagccaactccagaaaccccaaaaccaatgaaagaactccatccttaatattctgttcctctagaaccactcctggtagaa

SEQ ID NO: 77403 - DNA, 201 bp, Homo sapiens
tcctctagaaccactcctggtagaaaatctgtattagtgttctctagagggacagaactaataggatatatatatatatcctattacatatccatatatayatatatatatatatatatatatatatatatatatatataatatgagtttattaagtattaactcacatgatcacaagctcccatgagctgaggagcaagg

SEQ ID NO: 77404 - DNA, 201 bp, Homo sapiens
cactgagctgatagaattccagttaaaaagcaaagaaacttggcattttagttagcttcagtggccctttaggagggaaaggtaattccatttagctttgraaatgattggaaattgttctcaggtacttgttattgtctctgtagagactctgatttggtagccctggcttttgcaaaagcttcacaggaggacttcttc

SEQ ID NO: 77405 - DNA, 201 bp, Homo sapiens
cacacacacacacacacacacatgcacacatgcacaaacttagctgggggcatcgtggcatgtgcctgtagtcccagctagtcgggaggctgagacaggaraatcactcgaacctgggaggtggaggttgcagtgagccaagatcataccactgcactctagcctgggcaacagagtgagactccatccccaccccccaaa

SEQ ID NO: 77406 - DNA, 201 bp, Homo sapiens
tcaaaaaatcacccaaaagaatttttcaagggcaataaagagaacacagtcaaaaacaactaattactcaagaagttgaagcaccatatgaaagaaccagkgggaacagacagcaaagaccagagatattgaaaatatcagtcacaggttaaaacagcaaccttaaaaatatacacaaagaataagaaactattttgaaaa

SEQ ID NO: 77407 - DNA, 201 bp, Homo sapiens
ggacaaagacgaatttcctctccgccaatcctgtgtgttcagctaaagtttcctttttgaatggtccctcctgttttcttcttgtaaggggggaattgtcrgaggcgatgtccctcctctagagctaggtgcctgagctttcctcctgtgccccagatactcattttcttacacttggatattgggagtccaccatcagaa

SEQ ID NO: 77408 - DNA, 201 bp, Homo sapiens
gggtaaataaactaggtggaggtcataggcagcgtactatgtcgatgatgaagttgctagtgtgtgcgcgtgcctgtatttttatacttgagctactatcrtgtgccatgctggggatcagcagaggttacttgtgccttgtgcattgctacttgcccctcttcccttttctggaaagttcttccttcttattctttcctc

SEQ ID NO: 77409 - DNA, 201 bp, Homo sapiens
ttgggtgtgaaatcagggattctccagctatgtatctgacagtactgtcttcccatgacttggagtaaggtagtctataccaaaataaaaaaattgataawgtttttgcaatttactaaaaagtaacatgaataaagatagttttctcaatttacagttgttctaacatatctttttgttaaacctttggaagctgttacc

SEQ ID NO: 77410 - DNA, 201 bp, Homo sapiens
tggaagccccagggtcctcggagctggtgtgggtttgctgctggctccctgcacacgctgcccgtgcgtggttacgagtttgtgtgtgttgctatgtactsctctcacggtgcattgtggagttggggaggttgcattcagaccaactcaggccacgcctgtgagcagggtctggcatcccagctctgcctgctgaaggct

SEQ ID NO: 77411 - DNA, 201 bp, Homo sapiens
tcatgaattgtaatgtgtcataaaataagccaaagttggctctcccaccctgtctacctttgtgcttcaattttcctttttttttccccctctttatgggstgagttgaattcccttcctattttctgaatgaatgaaactgcttgatgagtggattaggcatccccaaagggagaaggtgcagggagtttactgtcttgt

SEQ ID NO: 77412 - DNA, 201 bp, Homo sapiens
gaacagaggggtttggcagacatttcaggggtaaagtttataggatcggtaccaaattggacatggggcatgaggaagaacagctatcaaggctgcttctrgatttccagctcgttgactgtttggtggagcatttgcaggagcaggaaatgctgaaaaagaatcctgttttggagaagatcgtatgtttggatttgggca

SEQ ID NO: 77413 - DNA, 201 bp, Homo sapiens
ttgaccaggctgctcttgaactcctggcctcaagtgatcctaccatctcccaaagtactgggattacaggtgtgagtcaccatggatggcctctttttttytttttcttttttttttttttttaacaatgtgtgacatattgataatataatagcctttagtgctgtttgttgaatgattcaaagcataatgcctagcaaa

SEQ ID NO: 77414 - DNA, 201 bp, Homo sapiens
aaactgaggatgtaatgttaaagtgtagttgagggagggttgaatacagagtaatgtgtgaaaatttctgaggggctaactgggttcaaagataacggttygagcagaaatgccactgacactttaattcttttcggttgaacccatgttttgaaatgtttatgtctactaaactgcatttattaaagaataagttatctt

SEQ ID NO: 77415 - DNA, 201 bp, Homo sapiens
ggctgctcttgaactcctggcctcaagtgatcctaccatctcccaaagtactgggattacaggtgtgagtcaccatggatggcctctttttttctttttcytttttttttttttttaacaatgtgtgacatattgataatataatagcctttagtgctgtttgttgaatgattcaaagcataatgcctagcaaagataata

SEQ ID NO: 77416 - DNA, 201 bp, Homo sapiens
gcaaatttttcctgttgtaaatgacatgaacaatacaagggactatgttttcaataataagttcacacaagcttctgcaatgttcttcatgtgaccattgyttgcactgattctggataaaactgaggatgtaatgttaaagtgtagttgagggagggttgaatacagagtaatgtgtgaaaatttctgaggggctaactg

SEQ ID NO: 77417 - DNA, 201 bp, Homo sapiens
gagaattgaaggctgagctgagggaggagctgggtggagagtgaggagaggagtcatgctaaggttttgctatggaagccggcttggcgtgttctaagaamaggaaggaagccagtgtggctgagatggagtatacaaaagattgcatggcaagagataaagttggagaggagtcaaagcccggatcatggtaagcattgg

SEQ ID NO: 77418 - DNA, 201 bp, Homo sapiens
tcgtacgtctgtcacctcttcaagctttgctctaaatacagtagtacactttgcctgtggtgcctattctgaaactgccctgtgtccccaagcctggtaakgtcaccgggctttctctgggtttacccatgctggactgctcttctccaaaccacacctctctgtgtagcctagatggagctccctgatttagactctcgt

SEQ ID NO: 77419 - DNA, 201 bp, Homo sapiens
gtggagagtgaggagaggagtcatgctaaggttttgctatggaagccggcttggcgtgttctaagaacaggaaggaagccagtgtggctgagatggagtayacaaaagattgcatggcaagagataaagttggagaggagtcaaagcccggatcatggtaagcattggaggccacagcacagggtttagatgtattcaaag

SEQ ID NO: 77420 - DNA, 201 bp, Homo sapiens
gaggagaagaacacctctgaacttgagagtatcctcttcttatcattttgttccctgttccctttgttctgctgatcctgtcttccctcctgtcagcctargtgggagcttgtgggttgggaaagagctggatccctgcagataccttttaattacccttgggctgtgtttgtggtgagaatcagtctgctcaggactgcc

SEQ ID NO: 77421 - DNA, 201 bp, Homo sapiens
cacactgaaaatgcagacagtcagagcctgtgagttgaagattttctatatagtcttcaacactaaaccaagatcagagggcggaatgaaggattgtgctwtcagctcgttccttctctctgaacacagtgaaggagtttaaacacaatgcttgtgcttaattttgcaggtagttttagaaacttctcaccaataatgaga

SEQ ID NO: 77422 - DNA, 201 bp, Homo sapiens
gagtcatgctaaggttttgctatggaagccggcttggcgtgttctaagaacaggaaggaagccagtgtggctgagatggagtatacaaaagattgcatggyaagagataaagttggagaggagtcaaagcccggatcatggtaagcattggaggccacagcacagggtttagatgtattcaaagttcatagtcatttggct

SEQ ID NO: 77423 - DNA, 201 bp, Homo sapiens
gagtatcctcttcttatcattttgttccctgttccctttgttctgctgatcctgtcttccctcctgtcagcctaggtgggagcttgtgggttgggaaagarctggatccctgcagataccttttaattacccttgggctgtgtttgtggtgagaatcagtctgctcaggactgcccctgagacaggtgtatgggtctggag

SEQ ID NO: 77424 - DNA, 201 bp, Homo sapiens
ttgggtgtgtttcttaattatcctgagtgaccatgtcatgtctgaacactatctttattgcactatctgtgtaactttgggcaaatcatttacattttccstgccttgctttcctcagctgtggaatagagattgtggtagtactggccttacagcatagttgcaaatattgtgtgagctaatgcacgtgaccacctaact

SEQ ID NO: 77425 - DNA, 201 bp, Homo sapiens
gggcacatttggggaggtcagtgtttaatgaagaaagcagaaggcaggaaattgcccagggtcatgcaggatgacccatgtacatgtgtgggtttcctccrtgtgggggctactcacggagggtgagtgcttaatctgctcaccacctcttgcattctgggtcaccccttcctgctgctaggatgctcagaagtgggagct

SEQ ID NO: 77426 - DNA, 201 bp, Homo sapiens
ggcacagatatgcagttgcctactggacatctctacttagttgtctcgtgggtttccccacttagacatggcaagaacaactcctcctcctcctcctcctyatcctcatcaaaactgcctcttacgttgtattctctatcgtagccatcggcaccaccaaccacacacatgccctaagaccatgagaatcatcgctgattc

SEQ ID NO: 77427 - DNA, 201 bp, Homo sapiens
tgactgtagccactatgttgtacagcagaactctagaacttactcatctaacataacctaaactttatgcccattcaacaactctccatttcccctcagcmccaggcaaacactattatattttctgcttctatgagtctgactacttatttcacatagcataatgtcctccaggctcatcgatgtcacaaatggcaggat

SEQ ID NO: 77428 - DNA, 201 bp, Homo sapiens
acggaatctcgctctttcacccaggacggactgcagtggcgctatctcagctcactgcaacctccgcctcccgggttcatgccattctcctgcctcagcckcccgagtagctgggactacaggcgcccaccaccgtgccctgctaattttttgtatttttagtagaggcggggtttcaccgtgttagccaggatggtcttg

SEQ ID NO: 77429 - DNA, 201 bp, Homo sapiens
tttcacatttgccttaggctgttgcataaataactctccctgcctagaataacctctttgcccctcacactctctccacctttctctttcttcttctaccrtctttcattatttagtcttaaatagtaagagtaaattatttatttagtaaattaagttagtttacacatctcttcctcaaagagaacttcgctgccttag

SEQ ID NO: 77430 - DNA, 201 bp, Homo sapiens
ttaaatagtaagagtaaattatttatttagtaaattaagttagtttacacatctcttcctcaaagagaacttcgctgccttaggccaggttaggacttttrtgttctcataatcactaaacttctccctttataacactcttatattggtcactcttgttttattggtcgttattggtcacttttgtttaaatgtccccat

SEQ ID NO: 77431 - DNA, 201 bp, Homo sapiens
ttgttttccaaaaacaacaacagaagagccagcattttgtgagggacactcaagatccatgcacagaagggtgtgggaaggcctggcctttggccccgagyagcctgagaaggtttgaaatggcggtatggaagcaggtgctttcttacgtctgctcattaccaagatggctcttctagagatcgtggtcaacatttctgt

SEQ ID NO: 77432 - DNA, 201 bp, Homo sapiens
agagaacttcgctgccttaggccaggttaggacttttatgttctcataatcactaaacttctccctttataacactcttatattggtcactcttgttttaytggtcgttattggtcacttttgtttaaatgtccccattgccagtgagattatttcatcaaacacatcacatgtcttattagtcacatttttttttcctgg

SEQ ID NO: 77433 - DNA, 201 bp, Homo sapiens
atgcttactgtgtccagatattgtgctaaggactgtataaacattgtttcacttaattcttatttcaaccctgagaaattgggccattattatcattctasaccaaaaaagtcctgaatgtagttgtcttagtctgctcaggctgctgtaacaaaatgccataggcttaattgacagaaatttattttctcatagttctag

SEQ ID NO: 77434 - DNA, 201 bp, Homo sapiens
atggcaaattctaatggacgccttgctgctcttaacttacttgaactctctgtcaagaagagctgtgcctctatgtcccttcctgagttttggtcacactrttctcttcttactccttccaatattttggctacttcatggtccatgtattttttagatgacagagcattgcacgacatgagaggctgtggagtacaagga

SEQ ID NO: 77435 - DNA, 201 bp, Homo sapiens
ctgagaaattgggccattattatcattctagaccaaaaaagtcctgaatgtagttgtcttagtctgctcaggctgctgtaacaaaatgccataggcttaaytgacagaaatttattttctcatagttctagaggctgaaaggttcaagatcaaagtcgaaaagggttgaatttctgatgagggctcttcttacaggtagct

SEQ ID NO: 77436 - DNA, 201 bp, Homo sapiens
cccaataaaaaagtgaggttatgtaatgagtgggagaaaagggatagaagaataggggacttgcgtagagagaggggcaatttggacacaaccgatgggtrtataggagaatgagaaaagtatggccaggcagcaacgggggcacacctgatgttgccagttgtgactgcatagtgacatcaatccatgcagttgtgtaat

SEQ ID NO: 77437 - DNA, 201 bp, Homo sapiens
gcttgggctgtctgaacacctggccttgagccttctcgattgctacctgagccatatcttcagttcagtaagacaaaactctcacactttctatgatgaartagttgaaagaaaattttacacattgtaacattttcctagatggctttcttatcttttaaagatgtctagggaaggacgcccgttggcttctccttgtaa

SEQ ID NO: 77438 - DNA, 201 bp, Homo sapiens
ggtgctttctctggaataccctcatcccccttttcatcccgggaaactctaatcattctttaatcacagttgaaatgtctcctagtcattgaagtctctcyttaatcctctgggctggaagtcactccctcctctatgtttccatgacactttgtatgtcacatcatgtcataatttgcgttcatctttctcagtttctgc

SEQ ID NO: 77439 - DNA, 201 bp, Homo sapiens
actcacggggaaatgtcaagtagactggtgggttcatgagattggaaaccaatgagctggaagaatatgattcactttgcttttctgtggttcccatcccrtgaactggggcaaatcatataactggcaaatggggtttcttggctattttagggtcattgggaatctatttccagtgctatgaactcctgtaaggcattt

SEQ ID NO: 77440 - DNA, 201 bp, Homo sapiens
ctatgtttccatgacactttgtatgtcacatcatgtcataatttgcgttcatctttctcagtttctgctactacctagggccaagaatttgagctgttctyctatgtatgcctagtgcctggtgctagcatgatgcttggtacatatttgatgttcaatgtatgcctcctgtatagaaacaagagtaatacaactcacaat

SEQ ID NO: 77441 - DNA, 201 bp, Homo sapiens
tttgccagaacatagggtcaatgtatgaacattttgatagaagccagtctgacctattcctggccctcttgttattatctggagggttgaggcagatgatrataatgaagtggccagtgacgatggcaaggtttggcttcctgtcctttgtgggcttcccaaagaatgaggaccacagcctgcttcttttgaagcccaaat

SEQ ID NO: 77442 - DNA, 201 bp, Homo sapiens
tgccagaacatagggtcaatgtatgaacattttgatagaagccagtctgacctattcctggccctcttgttattatctggagggttgaggcagatgatgawaatgaagtggccagtgacgatggcaaggtttggcttcctgtcctttgtgggcttcccaaagaatgaggaccacagcctgcttcttttgaagcccaaatcc

SEQ ID NO: 77443 - DNA, 201 bp, Homo sapiens
aaaacagtgcacagccacttttacaatggctttattcataattgccaaaaactggaaacaattcaaacatccctcagatagtgaaaggataaatgaactgyggtacatccacacagtggaatattattcagcaataaaaacgaacaaactaccaagacatgcaaccacatggacaacatgaatttcaaatgcactatgcta

SEQ ID NO: 77444 - DNA, 201 bp, Homo sapiens
aagggagtctgtctcctctctgctcctccatcatcgacaggctcatccccccacccttccttacagcgccattcccgggcgccgatgtgctgcagctgackttcttgcctcacagcagggcccgggaccagagtacactcaggccccttgggtcagcatggaggtggcttggcagggctgtggggaaggaggcctgaggag

SEQ ID NO: 77445 - DNA, 201 bp, Homo sapiens
attgccaaaaactggaaacaattcaaacatccctcagatagtgaaaggataaatgaactgtggtacatccacacagtggaatattattcagcaataaaaaygaacaaactaccaagacatgcaaccacatggacaacatgaatttcaaatgcactatgctaagtcagagaagccagactcaacagcctgcatactctatga

SEQ ID NO: 77446 - DNA, 201 bp, Homo sapiens
gtgaccttggcatgtctatgatgactttttcatgttccattcctgtttgatgaaatagaagtagaggctcaccttgttatgaatggtggaaggagacccartgtggctcatgtcaagaagagcttactccactcaagaattattttcctatttatacttctatatccaaatacagtaattggcttaagtaacagcttctgc

SEQ ID NO: 77447 - DNA, 201 bp, Homo sapiens
aatggttgaactaatttacactcccaccaacagtgtaaaagcattcatatttctccacatctgttggaattatgtcctagaatatgatgcggttctaagascactattttaattacttcatctgcctttttggaataagacagatgtggagaaatacggtcttataagaagatgtggagaaatactgtcttattccaaaaa

SEQ ID NO: 77448 - DNA, 201 bp, Homo sapiens
gtgcctgtatttttatacttgagctactatcgtgtgccatgctggggatcagcagaggttacttgtgccttgtgcattgctacttgcccctcttccctttyctggaaagttcttccttcttattctttcctctaagtctttcccataggaaactgtcccaaaacttttttctgtggagttttctctgactaatccccctgc

SEQ ID NO: 77449 - DNA, 201 bp, Homo sapiens
gttctcatacctctgtgtgcctgcactctcttgacctgcttcataggttgggtaattttaaatgcatggcaatttggtgtgatagatctaactatattttrcagatagggcacataaattattttacagataaggaagctgatgatctgggaatttcccaaggtcactcacctaagaagtaccagagccaagagttcagaa

SEQ ID NO: 77450 - DNA, 201 bp, Homo sapiens
tgggcttgagttctttagctttctcatctctcttctctgaatgagctctgattttcctgacctcttgaaatgaaccagtcatagaggggctgttcctctcygtcattctagatgtagcctaggacttatcatctttttctagtggccacgttgtgctgctcactgcagtgattttgaacaattcatagcctctctgagctc

SEQ ID NO: 77451 - DNA, 201 bp, Homo sapiens
ttgctacttgcccctcttcccttttctggaaagttcttccttcttattctttcctctaagtctttcccataggaaactgtcccaaaacttttttctgtggmgttttctctgactaatccccctgctctctgctaagagcataccagaagctcgtgaacggaggcctgtgactccatccagctgctactaggatcatctttg

SEQ ID NO: 77452 - DNA, 201 bp, Homo sapiens
actagtgactttggcagcttggaagacagtggtgcaatctttgtgtttctcttggcttcttatgttgggagtgtctgaatgcatgagcactgtgtgtgtgytgggagctgtgacttccagaaaaaagagatcaccaatgtaaacatgagaaggggtgatttttcaacatccactagaatgttatatcaaaatgagcatttt

SEQ ID NO: 77453 - DNA, 201 bp, Homo sapiens
gtcatagaggggctgttcctctccgtcattctagatgtagcctaggacttatcatctttttctagtggccacgttgtgctgctcactgcagtgattttgawcaattcatagcctctctgagctcagtctgctcttgtgtatactggagatcattgcacttaatcacaagaatactgagagagccaagcggcctgatgtgtt

SEQ ID NO: 77454 - DNA, 201 bp, Homo sapiens
ttattctttcctctaagtctttcccataggaaactgtcccaaaacttttttctgtggagttttctctgactaatccccctgctctctgctaagagcatacyagaagctcgtgaacggaggcctgtgactccatccagctgctactaggatcatctttgttgtatgtgtgcaatgattttctcaactttgcttcagaatgca

SEQ ID NO: 77455 - DNA, 201 bp, Homo sapiens
ccagcttgcgttcccctgcaatctctggcaggtatcatccaaacttgtgtgggtggatcttcttgctgtgcttcttagtatctcatggtctgtcctagtgrtgatctccttaggttgtgagacgtgaaacaggtactatcagatcagggcattaagaggacaagcatttattggacacctattatatataaggcacagtat

SEQ ID NO: 77456 - DNA, 201 bp, Homo sapiens
ctttgttgtatgtgtgcaatgattttctcaactttgcttcagaatgcaagttccggagggtggcgaagaggtcttctctcttacctgtctctctcttggcrtcaagtaggactctggactctgtagcctggcttatgttgcattttgtttatgtcccagaagtaaagttatgatattaaaacaccaaaagcaacaggaacc

SEQ ID NO: 77457 - DNA, 201 bp, Homo sapiens
tatgagctccttggggccatcccaaggacttctttacctggaaaggatgtgggttgaatgacaggtaagccaggatgaggatgagtttttggtacttgctstctggatgcccaggacatagactggtcaaagtgagaccagagcaggtgcgcgatcctatggagagctctggggaaaagctgggggtcacgagagggaaaa

SEQ ID NO: 77458 - DNA, 201 bp, Homo sapiens
gttgaatgacaggtaagccaggatgaggatgagtttttggtacttgctctctggatgcccaggacatagactggtcaaagtgagaccagagcaggtgcgcratcctatggagagctctggggaaaagctgggggtcacgagagggaaaaaggacaatggaaaatacattttgctcctgtcttgtttacctgtccccattaa

SEQ ID NO: 77459 - DNA, 201 bp, Homo sapiens
gaatgcaagttccggagggtggcgaagaggtcttctctcttacctgtctctctcttggcgtcaagtaggactctggactctgtagcctggcttatgttgcrttttgtttatgtcccagaagtaaagttatgatattaaaacaccaaaagcaacaggaaccataataaaatgaccatgtgccaggcagccagatcccctaga

SEQ ID NO: 77460 - DNA, 201 bp, Homo sapiens
gaatgtcatgtggacacttggacactgtgtgaggtgtccaagtgcttgggacttagtgatgagcaaaataaggacccagtttttaagaaattattcttttmtttgaccttcaaaaaatataaatatccccaggagggattctgcttgggcctatgtgtccgatttacaacctatgtagatgacttttgtagattccatttt

SEQ ID NO: 77461 - DNA, 201 bp, Homo sapiens
tctctcttggcgtcaagtaggactctggactctgtagcctggcttatgttgcattttgtttatgtcccagaagtaaagttatgatattaaaacaccaaaarcaacaggaaccataataaaatgaccatgtgccaggcagccagatcccctagagctgctgaccagcgaatctttaccaaaccagttctacgggaggcgctg

SEQ ID NO: 77462 - DNA, 201 bp, Homo sapiens
gtagcctggcttatgttgcattttgtttatgtcccagaagtaaagttatgatattaaaacaccaaaagcaacaggaaccataataaaatgaccatgtgccrggcagccagatcccctagagctgctgaccagcgaatctttaccaaaccagttctacgggaggcgctgctgtgaagtggcttaaggcacagaatgtggtaa

SEQ ID NO: 77463 - DNA, 201 bp, Homo sapiens
attgaccacaaacatggaatatacccagtgcagtgggtcgcacaataagcggccagaaaatacgtattgaacttaataaagaaaatcaataatgtgggccrgccatggtggctcacgcctgtaatcccagcactttgggaggccgaggtgggcagatcgtgaggtcaggagatcgagaccatcctggctaacatgatgaaa

SEQ ID NO: 77464 - DNA, 201 bp, Homo sapiens
gaacagacaacctacagaatgggagaaaatatttgtgagtcatatatcagacaaaggacttatatctggaatatagaaataactcttataactcaacaatraaaagatgaacctgattttaaaatgagcaaaagctctgaatagacatttctccaaagaagatatgcaaattgctagtaagcacgtaaaaagatgttcaac

SEQ ID NO: 77465 - DNA, 201 bp, Homo sapiens
ggaatatacccagtgcagtgggtcgcacaataagcggccagaaaatacgtattgaacttaataaagaaaatcaataatgtgggccggccatggtggctcaygcctgtaatcccagcactttgggaggccgaggtgggcagatcgtgaggtcaggagatcgagaccatcctggctaacatgatgaaaccctgtctctactaa

SEQ ID NO: 77466 - DNA, 201 bp, Homo sapiens
gtgaacccaggaggcggagcttgcagtgagcccagatcgcaccactgcactccaacctgggtgacggagtgagactccgtctcaaaaaaaaaaaaaaaagraaaagaaacagtgctagtgaagatatgcatcgaataaagacatctagaaggcacaaatggttcagctggtattgatgatgttatcaccattaacatctca

SEQ ID NO: 77467 - DNA, 201 bp, Homo sapiens
cttaatatttgtccaggaaacaaataattaaatgatataatgtatgttaaagagcccagtgcagtgcctggcatatatcagaagctcaggattagctgttyttagagtttcttaatatcaggtccaaagatccctcaaactcttttgtctttttctggcctctgggatgacctacctgtaagttggatgtaatctcccatc

SEQ ID NO: 77468 - DNA, 201 bp, Homo sapiens
atcttctattgggatggatgtttgagaagtctctttccaagacttggggctaatgaattaaaagcataggataccaaagatcaagagcttaggtataagaygagcgcagtggctcatgcctgtcatcccagcactttgggaagcagaggcaggtggatcacctgaggtcaggagtttgagatcagtctggccaacatggtg

SEQ ID NO: 77469 - DNA, 201 bp, Homo sapiens
tcaataagatccatcaaaaaaatcactcaatgtttaattcagtgcttagtatcattgcacctatcactgtgtttgcatatgactcctgctcccttcacctmgtcacttgtagcagagggccgtcagtacctttttgtgcacaggctacctcactcatcatttctaatgggcattcctcctattctgttataggaaattgca

SEQ ID NO: 77470 - DNA, 201 bp, Homo sapiens
tgacgccagtggtcccacttccgtcgccaccaattagctgtgtgggtttcacatgcttgtcaaccttgtctgttcagctatttcaaagcttcctcttttgrgtgattagagcagagaccccaaagttttctagtttatgtatatagacgtgttcataatagcaaagaatacattccacctaaatgctcatcaatgataggc

SEQ ID NO: 77471 - DNA, 201 bp, Homo sapiens
gaccccaaagttttctagtttatgtatatagacgtgttcataatagcaaagaatacattccacctaaatgctcatcaatgataggctgggtaaagaaaacrtagtacactgtggactaccatgcagccgtgaaaaagaatgagttcatgttctttgaaggaacatggatggagatggaggccattatctttagcatactaa

SEQ ID NO: 77472 - DNA, 201 bp, Homo sapiens
acccttgaaccatacttcctgggctcaaatcccagcttttgaccaactagctgggtaaccctgtgtaagttacccacttgcccttatcaagactcctatgygtcttgatttgcttgcctattaaaaaaagataataatataataggattgtcaggagtagtgaatgaattagtatctgtgaatagaagagggtcttagtgc

SEQ ID NO: 77473 - DNA, 201 bp, Homo sapiens
ttgtcaggagtagtgaatgaattagtatctgtgaatagaagagggtcttagtgcttagtgctaatacagtgcttagaagagggcctaacacatacaaaagytgtgtattaagtgtccagtgttattcctcttaatggtcttgaagcctgaggaaggcagagttagggaaatatactctactttgtcagggccatgccactg

SEQ ID NO: 77474 - DNA, 201 bp, Homo sapiens
aatcttttatttatattattatttcacccagatagattcacataggtgtgattaggtatggtcattctatggttcttgattcattttaccaaattgctttytgaaagaataagaacaattcacccaggcatgggcaatatatgagaataccctttcagtgagtataaatcacttaatatcctgaatcctaaagtcatgtga

SEQ ID NO: 77475 - DNA, 201 bp, Homo sapiens
tctacatgtaaagcaaatgacaatttgtgaatgtattttttcctctgttattgatgttggctgaggggccttaggacagttaccttttggggtcagttacwttctgattgttcacagatatctaagagtaaaagtgtcgtacgtctgtcacctcttcaagctttgctctaaatacagtagtacactttgcctgtggtgcct

SEQ ID NO: 77476 - DNA, 201 bp, Homo sapiens
gaatattctagactcatccttagcttagttttacacggtgcttcctctaggaagtcttcccaggtcaagccccagttcctcttgagagaaatcatcacttktttctgtcctagtattgtgtttggtacacacgctgatggcatcttactgaattatggtagtattgcttacacatatgttcttcaacagacccagtcaagg

SEQ ID NO: 77477 - DNA, 201 bp, Homo sapiens
gtttgatgataatagcacctacctcataggactattctgggaatcagttgatgcatgtagagtgcttccacatgtagaccgtcaatgaacattggccaccrttgttattgtccagagttcagtttctctcaaatctagaaagtttttgactcaaaacagtttgaagctcctgaatacggtgatctctggaggttcttcctg

SEQ ID NO: 77478 - DNA, 201 bp, Homo sapiens
tgcttccggttgaccagcagagaggtgtgctcgaagatcgcctgctcttctcattcttttggccttgtctttgggttttagaaaccacctactgaggccargcaaactctgaactggatgcaggaggctcttctcccgcttactgccccaggcttgtctcgagacttcaaacaaggcagggaagggcccagaccagaatcc

SEQ ID NO: 77479 - DNA, 201 bp, Homo sapiens
cttttgtttactaaccactcactgctctttggtttaggaacattccaggcctgagtatgaaaccaaagttcgagagaaaatgctaaaggagagcaaccagkctgctgtccagaaattggaaacaaacacgacggagtgtggcgatgaggtatgaagctggacttgctgctcacggtcctctttacttgttgagatcctgtt

SEQ ID NO: 77480 - DNA, 201 bp, Homo sapiens
cgcccggcccagggatcaatttcaaaatgagatttggaggagacaaacattcatactctatcagcctcagtttattttttttctttaaacagaattgatargaacatgactcccaacttcttgattctctctctctacttgtggttagcattttccctagaagtcagaactcccatgtaccagtcagtctccaaatgattc

SEQ ID NO: 77481 - DNA, 201 bp, Homo sapiens
ctaccatgatccagaagagtagcattgtagtccacaccttgtggacttcagcaaattgcatcacttttccatgcccgtttcttcatctccaaaatggtcaygtgactgggttggtgctctgcaagttcctgcagctcgaaagctctgtgaatcttgagatgctctgggaaacaccaaacgagaggttcagagcttgatttc

SEQ ID NO: 77482 - DNA, 201 bp, Homo sapiens
ataatgtatttaaaaagtgcttattgagcacctactatgtgccagccactgtgctagcagctgtggatgcgaaagtgaataagacagatatgttttcaccktcatgaagcttacagtccatgggaaagactggcattaaacaaggaagtaattatttatatcatcattttattcagtgacacaaatggtgtgggactgtgt

SEQ ID NO: 77483 - DNA, 201 bp, Homo sapiens
tgtgtgtgtgtgtgtgtgtgtagtccagcacagcttattttttcagggagccttccacctgctgttttctctccctacgttttctatttagtccttcatarccagtgcccattctctgtcctgcggaggaaataggacctgaacagcttcctttacagaaagagtcctaagaaggaagtcttctttcttgaagaagtcttg

SEQ ID NO: 77484 - DNA, 201 bp, Homo sapiens
ttagtttagccatgcagacagacgtggaaacagattgtgatgaggcaatgtggtaggtgctataatagagatacatacagagtgcagttgggacacagggkaggaggcaattaatgtccatgtgtatgtctctatatgtctaagtatcaatgtaaatcattgctcccaggaaacttacgtatgtcaggagtgatcatctcc

SEQ ID NO: 77485 - DNA, 201 bp, Homo sapiens
gccaacctttcccgaacagtgggtttggggacattgctcccagtcagcaccctcagacagcttcccttggtcctagagcacctatagttagcatttcaagytctcagctactttcttcccactgtgctcctccaccccaactgacccactcagctcatggtcaccctagcctccctgtgttgtcccaccccggccttgctc

SEQ ID NO: 77486 - DNA, 201 bp, Homo sapiens
ggtcactgggcctctggacatacagcaaatagggctgcagcatggtaggaggataaggcaggaggcaagaagaaagagcaatggagctgactggtgcaagrtgtgcttcctcctcaggtcaggacccagtggggtattgtgcctttgagccatacatctgggagcaggaaaactataggatcttagcataaccaacatagg

SEQ ID NO: 77487 - DNA, 201 bp, Homo sapiens
ggggtattgtgcctttgagccatacatctgggagcaggaaaactataggatcttagcataaccaacataggcaatggtcaggcttggcctggaaaggcggyctgtctctactctagctttggagaattcttcaaataagaggcagtatggaggaggcacagctgatggcaggcttctaggctgaatactcaaaatgctgtt

SEQ ID NO: 77488 - DNA, 201 bp, Homo sapiens
agtgtgcattgatgcacaccctgcttaccctatatctcacacacatgcacacacttgtacacatgcatgcatgcacatgtgcacgcacgcgtgcgcgcgcrcgcacacacacacacacacactctctgcttaccctgtaccaaacactgttctaagcactttacatatatcagtatgtttaatccttaaaacagccccagg

SEQ ID NO: 77489 - DNA, 201 bp, Homo sapiens
aagatactaaagatagtaataacttggaaacactcctgtttatctagtaatgtctcttttttctttgtagacaatacgtttttattgaatgcctacttttmcaaagctttaacctatatacaagtagtatgtagtgatatatttatattcctgccttgttccacaaaatttctggggtagcttacaagaaaaacaataaga

SEQ ID NO: 77490 - DNA, 201 bp, Homo sapiens
agacagtccctccacccaccccccattcccaaatgaagggcagcccagttggttgtgctgtcagcaaacattgctgtttgcaaaggcatgacctgccttarggagaggtaaggggaagagcaggcacttttgcttgggcatcttcttgttcttttttgctgccatcgttatgcatttgccagctgggctgtcgaagacacc

SEQ ID NO: 77491 - DNA, 201 bp, Homo sapiens
gcttgggcatcttcttgttcttttttgctgccatcgttatgcatttgccagctgggctgtcgaagacaccagtcaggaggagctgcttttccaagattcaragcctgcagctggcgtcctctcctggccatgctgtttccataggattaagatggagctctggggactttcagtcctgagctggccccctgggatgaagct

SEQ ID NO: 77492 - DNA, 201 bp, Homo sapiens
aatttttaatattaaaatctgtacgtgtctacctatatttctattaaatcttttacaacatttttaccaaatacggtatttcctaaacaatgcattatgcrgttgaagatgctcggcaaagtaatcctattcactacagttctcaatcccattgagttttctctggcagcttagtccccatacagagacccctacattggt

SEQ ID NO: 77493 - DNA, 201 bp, Homo sapiens
tggttcctctttgcaccaatggcttcctcccactctctgtctatgggcgttctctgattgtgggagcaggttcacctgtgcataggacaggctggaagagscagggagttagccccaaaggtgaccttcaggcagggaggggctcctgtttggtctcccctttcagtgtgcaaatttggaggtgtgcttcacacagtttct

SEQ ID NO: 77494 - DNA, 201 bp, Homo sapiens
aaccagataagaggcctctgataaatgaggtgttactgtcaccaaagtaataaggactccttgcatgcttgcagttgtatgtttttcaaaacaccttaacrctcattatctcatttgatcctttaaactgccagcaaagtagcttcagcagatgttaattaacttcacaacagagagattaactggcatacacacagctag

SEQ ID NO: 77495 - DNA, 201 bp, Homo sapiens
ccctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtga

SEQ ID NO: 77496 - DNA, 201 bp, Homo sapiens
catcccaaatggactaagatcaccctgtcacctcttgtccttgtcatgccatttgtcactgtctgtggagtcccttggaagtgtcctgaaccattgtccaytggttcctgtgtctctagtcttctgaaggcacctctgaggtttctgctcagtgtctctgagtccttctgggaatgccagctgactcctctgcttggatct

SEQ ID NO: 77497 - DNA, 201 bp, Homo sapiens
gagtcccttggaagtgtcctgaaccattgtccactggttcctgtgtctctagtcttctgaaggcacctctgaggtttctgctcagtgtctctgagtccttytgggaatgccagctgactcctctgcttggatctgatagaacacccagggcccgtgacctatgagtcaaaccttaggctcaagctgtttgtttcactcatc

SEQ ID NO: 77498 - DNA, 201 bp, Homo sapiens
agagcgagttcacacttcttaagcatgttgtcccaggctttcacaattagtctcttggctacctctttgcttttacttgaccccaaatgcacaccctaggytggagtcaaaccaaaccacttgtcatgctgcttcttgccttcagcccctgcccctgctcctctctccatctgaaatgctctttcttctcttaatatgttg

SEQ ID NO: 77499 - DNA, 201 bp, Homo sapiens
tccaaattaatgctcaaattcattcagcattttttctgctaaaaatgaaggagagaaagaggaatcaagtcatggtacccttgtaactctagttcagtggytaataagctttttgaccagggaccttggttcaagtaaaatctcatggaagtggaaatgacacaggtgaaaactgaattccccttggtgcagaaaaggggg

SEQ ID NO: 77500 - DNA, 201 bp, Homo sapiens
ggctcctgcctttcttcagaggagcttgatttcacagtggttcaaggcagtagttatgtttcttcctagggccaggtaagccttactcaagtttcctgagracgagttataccttattgtcctgattatttttatcatgattattggttttgaagttatcagctgaaagggggcaggtgtctcagggaagccactctcgtc

SEQ ID NO: 77501 - DNA, 201 bp, Homo sapiens
ataggttaagggcacggcccctcacaagacttccctcatttcagacaccagtggcaagctctgggattctcaggccaccggcagttatgacccactggctrtaattccagagctctcattactccatcagattcaataattcactagaatgactcacagaactcagaaatgtgctatacttacaactgaagttttatagta

SEQ ID NO: 77502 - DNA, 201 bp, Homo sapiens
gagataaggacagagagatctcagacagaattttgacccagcaggggttggagagggaaattcttctctttgtcatgttattggagatgatgcccaccctsatttttattgaagatttaccctgggctttgctttgagttggatgcaggaaggagcacagtgagtcacagggcctggatccttgtccccatggagctcaga

SEQ ID NO: 77503 - DNA, 201 bp, Homo sapiens
accaacatggttgatctttctggcatggcctgcccccatcctgagtaatctcattagcctaaatttaggtatagtcctaggggtctgccaggaataacaargacactcctatggagggaaattccaaggatttagatgttcatgcaggaatcggggacaaaggccagtgaaattctttattttacagtcagtctggatgta

SEQ ID NO: 77504 - DNA, 201 bp, Homo sapiens
taggctggagtcaaaccaaaccacttgtcatgctgcttcttgccttcagcccctgcccctgctcctctctccatctgaaatgctctttcttctcttaataygttggtcttagctcaagcattgtctcttctatgaagtcttctttgaccccttaggtttcctcttccccacttgtattgcaccctgcaaatattgtaataa

SEQ ID NO: 77505 - DNA, 201 bp, Homo sapiens
atcttaatgctatttgtcctctcagtgagtaagtaaaagagatgttcagtatggtggatagatgaatgtgaattattgaaatgtaatggaatcatttaggrcaatctatacgaagaaaatgtggaatacataatcttaggaggggagggtggaatagttggtgaatgagttattatcatgtggattcccccctatgctccc

SEQ ID NO: 77506 - DNA, 201 bp, Homo sapiens
tataaatatatgcatttatatatttatataagtatatatttatataagtatttatataagtatatatttatataagtatttatataagtaatataaatttrtatatataaatatatttatataagtatgtgtaatatatacttaaaaaataaaatataatataaatatatatatttatattatatataacataaatattta

SEQ ID NO: 77507 - DNA, 201 bp, Homo sapiens; identical to SEQ ID NO: 5818

SEQ ID NO: 77508 - DNA, 201 bp, Homo sapiens
gaaattgctctggctaatgtagagaggaaattcttaaaaaatcagggttttgaagactggttggcttttaatgggcagcaaagggaagaaggggtgcccaygagaaagaaacagcagcagccttgacctgggaaagcgaggcaacaacaagatatcttgaaagccaagttggcttcaggggacagggctcagtatgcagtg

SEQ ID NO: 77509 - DNA, 201 bp, Homo sapiens
cacttcctgcccactcccctactgtccttcccaggctctggtaaccacccttttactcttaatggattattttcatagtgctcttgacagctgggttgatytggatatttttggaagctcacgaagtaatcaaatccactggttttttttttttttttttttttcattatagtgctaggtctttttctgtgtccctgatta

SEQ ID NO: 77510 - DNA, 201 bp, Homo sapiens
gtgctctctaagcttctttctgactctaacatttcccagactctgtgattcaaaggagccacatgatctgtacatatgagccaacgaggcccagggagggractggctttcctgaaagttcacagagagcaggtaccaggggtgtggccaggacttggggttgcgtgatgtccgcaggcctcagagaggttgagaggagac

SEQ ID NO: 77511 - DNA, 201 bp, Homo sapiens; identical to SEQ ID NO: 30688

SEQ ID NO: 77512 - DNA, 201 bp, Homo sapiens
gaagtaatcaaatccactggttttttttttttttttttttttcattatagtgctaggtctttttctgtgtccctgattagtttatcaacatcacatccaaratctagattttagctaattcgatagcctttattcataatccaagttctttaagctctaccttaatatctctcaaggctgagtctgctggagccagagcca

SEQ ID NO: 77513 - DNA, 201 bp, Homo sapiens
atcaaatccactggttttttttttttttttttttttcattatagtgctaggtctttttctgtgtccctgattagtttatcaacatcacatccaagatctarattttagctaattcgatagcctttattcataatccaagttctttaagctctaccttaatatctctcaaggctgagtctgctggagccagagccatgggac

SEQ ID NO: 77514 - DNA, 201 bp, Homo sapiens
ccttctgaatgtaaatacatttctgcagagtcttctagtgtcaagggctgatctggagaattgtaacctatttttgattcccaattatttgtagaggatcyatatgtttgtttctctggatctagaagcttttagaatcctttccatcattcctaaagttctgaaatctcatgacgatatgttttgctggaggcttttttt

SEQ ID NO: 77515 - DNA, 201 bp, Homo sapiens; identical to SEQ ID NO: 5832

SEQ ID NO: 77516 - DNA, 201 bp, Homo sapiens
ctgctaaaaacatatggctgagctccagtaggggtgtttctctcagagcaaaacttggcaactattggtgagtgaaaggggagatgacaaacaaatgatcrttcattgtcgtcctgtccctttggacgttaattgccctggtcgtgatctgtcccaggtattagatatcatttatctggtttccaaagagaatgaaaatgg

SEQ ID NO: 77517 - DNA, 201 bp, Homo sapiens
gtattgcaaagtactctgcctcctgcctcctggggatttgaccactggggttctgaccccccaaagataaccaagtctatctgtgaagggcctagtttttrtttttctaatattgtatgaacatttggcattcagtcccttttaatgccctagccaccagctaggtctctggaacttcttttcctttccttccttcctctc

SEQ ID NO: 77518 - DNA, 201 bp, Homo sapiens
gtggcatgatggtatgaatgcatgatggtgtgaattcttgatggtatgaatgcatgatggtgtgaatgtatgatggtgtgatggcatgctggtgtaaatgyatgatggtgtgaatgcatgatggtgtgatgaaatggtagtgtggtggcatgatggtgtgaattcttgatggtatgaattcatgatggtgtgaatgcatgg

SEQ ID NO: 77519 - DNA, 201 bp, Homo sapiens
gccagagattgggacttccatttggggaagggcctacattaggaacccctgagatctgtttgtctgcctccaccctctgacgccagtggtcccacttccgycgccaccaattagctgtgtgggtttcacatgcttgtcaaccttgtctgttcagctatttcaaagcttcctcttttgggtgattagagcagagaccccaaa

SEQ ID NO: 77520 - DNA, 201 bp, Homo sapiens
tccgagctataataacttgtttatttagacttttccttttatcttatcatgtcagaagttcaccaagaaactgaagggcttctgaaattggctttgtttcytgggcttgagttcagtcccttcttatttacctgcctgcggcttcatctgctgattattgatgatttgaagaaaaaattgtttatgtggaatcagcttcac

SEQ ID NO: 77521 - DNA, 201 bp, Homo sapiens
caaagaatacattccacctaaatgctcatcaatgataggctgggtaaagaaaacatagtacactgtggactaccatgcagccgtgaaaaagaatgagttcrtgttctttgaaggaacatggatggagatggaggccattatctttagcatactaatgcaggaacagaaaaccaaatactggatgttttcacttataagtgg

SEQ ID NO: 77522 - DNA, 201 bp, Homo sapiens
acgctgctaaaaaagacataccagagactgggtaatttataaagaaaaagaggtttaatggactcacagttccacgtgggtgggaaggcctcccaatcacrgtggaaggtgaaaggcatgtgtttacatggcagcagacaagagagaattgagaaccaaatgaaaggggtttcccctcaccgtctctactaaaaaaaagaa

SEQ ID NO: 77523 - DNA, 201 bp, Homo sapiens
aatattttaagttatcacataacattcaaaatgaatagctgcgtaataatccctttaataagcatgccatagttcacttgcctatcttccagtgaaggctyatttaacaattctccctattttaatcctctatctttgttgctcaggctgatcttgagctcctggcctcaagcaatcctcctgcctcggcctcccaaagtg

SEQ ID NO: 77524 - DNA, 201 bp, Homo sapiens
cccaaatccctgtgtctcaggaggaccaggcagagcctgctccgaatcagaggctgtacattcttgagagccaaaaggaagttaaggctttgatcttcacratgacacaggtagactatggtgttcctcaaatggagcagatgggaggcctgtctcagatgaattcctgctcttatttcaaaagccctctgtctcaaggct

SEQ ID NO: 77525 - DNA, 201 bp, Homo sapiens
accctgtctctacaaaaaggaaaaagaaaagaaaagaaaagaaaaaaaaacagtagagtgtagtgttgtacacctatagtcctagctacttgggaggctgwggtgggaggattgcttgagcccaggagtctgaggctgcagtgagctatgattgtgccactgcacactccagcctaagtgacagagtgacaccccatctct

SEQ ID NO: 77526 - DNA, 201 bp, Homo sapiens
ttagtgctgcataggtattaatgctttaaaccaggggtctccaacccccaggccgtgggccggtagtggaggtgagctgcatgtgaacaagtgaagcttcrtctgtatttacagccactccccatcactcacattactgcctgagctccacctcctgtcagatcagcggcggcattcgattctcataggagggtgaacctt

SEQ ID NO: 77527 - DNA, 201 bp, Homo sapiens
actctataataataactttacaagacaagtaaaggatttacattttcaaagcagggcttaattgatggtgaactacggatgttctgaagaggtttccagcygtaagtgggaggttgatttagtaatcccaagatctcttctgattctggagatctacatatagatgataagaacagagaagagcactccagggaaaaggac

SEQ ID NO: 77528 - DNA, 201 bp, Homo sapiens
tgtgccatggtggtttgctgcacctatcaacccgtcatctacattaggtatttctcctaatgctatccctcccctaaccccctacccctgacaggtcccaragtgtgatgttcccctccctgtgtctatgtgttctcgttgttcagctcccacttatgagtgagaacatgcagtgtttagttttctgttcctgtgttagtt

SEQ ID NO: 77529 - DNA, 201 bp, Homo sapiens
gtgttgcaggctcagacacatttgcccttggcaccattttctcattctcccatcctcagtttttctcttcccctcttctcctgtacctgcaccctttcaawcatgtgagtgctttggggacagggacaatgtcttattcctctctagtcgcaacactcagcatgggtactagaacctgataacacaatgaaataattatta

SEQ ID NO: 77530 - DNA, 201 bp, Homo sapiens
gtctttgaagtaaaagccccttcacatctgctgcctcttgtatctttagatgaccattgtaggcagagtgagcgtctctccttcccatgttcccagggtgycaggtgagactcgggtgcagatgcagctctgcttctatctagcagtgtggcctagggcatggcgtcgtataatttccctggcttcccttttttcctggaa

SEQ ID NO: 77531 - DNA, 201 bp, Homo sapiens
gctgggaacatgcccaaccctgtgacccctctttgctgtcccccagtatccccctgaagatttatcctcaggctttgtagctgcgtgtttctccctctaarcctctcgctggtcctcttgaactttttccttctccctcctccaataatcctaagtcttcaccccttttccctctcatcccctgtctttaccaatccatcc

SEQ ID NO: 77532 - DNA, 201 bp, Homo sapiens; identical to SEQ ID NO: 30716

SEQ ID NO: 77533 - DNA, 201 bp, Homo sapiens
tccagccccattgtcaccactgacctcccatattccccaccctttgcctagccctccagcctgagagagctggggtggaggagtaggagagagagacagasagagagagagagagagagagagaaagagaaagagagagatagatagatcagagaatatagtttataactcatcaagagtctataattcaatctagtagaa

SEQ ID NO: 77534 - DNA, 201 bp, Homo sapiens
ttctggttctagatccttgaggaattgccacactgtcttccacaatggttgaactaatttacactcccaccaacagtgtaaaagcattcatatttctccayatctgttggaattatgtcctagaatatgatgcggttctaagaccactattttaattacttcatctgcctttttggaataagacagatgtggagaaatacg

SEQ ID NO: 77535 - DNA, 201 bp, Homo sapiens
cagctctttgagttcctccttgttcatactgaggactccacagatgtgtgtaaaagcactgagcattgaggcctctatcctggtctgcccaagtatgcagrtgggaggtctgggcttctctgcgcgtctcttggttgggttggggtacatcagctctggctggtgtccctagagctgagaggctcctctaaaggactgcga

SEQ ID NO: 77536 - DNA, 201 bp, Homo sapiens
ctgatgagaggaaattcttcatttgctttaagagctgcaagcttaagttctctggacacttgcagccatttgacttttcctcctgagcagaaggatgtagrcccaagtttaatcccggaagagtttagtgacaagtcccaaaaaaatctcttggtaaagttttatcaccgtttcattcagataaataaatgatgtgattgt

SEQ ID NO: 77537 - DNA, 201 bp, Homo sapiens
ttcatactgaggactccacagatgtgtgtaaaagcactgagcattgaggcctctatcctggtctgcccaagtatgcagatgggaggtctgggcttctctgygcgtctcttggttgggttggggtacatcagctctggctggtgtccctagagctgagaggctcctctaaaggactgcgaggctgccactagccctggaggg

SEQ ID NO: 77538 - DNA, 201 bp, Homo sapiens
cccctcccctcccttacccttcccttccctttctctcttttggggggtggtgtttaaaattagtataaaatggcaaagcaggaggagttgaccttgaaaargtatggttggactaatgatcaaactttttagaattctttcataacctcaagagaaacaactcaacctttccctcttattttctctcttatttacccctgg

SEQ ID NO: 77539 - DNA, 201 bp, Homo sapiens
atactgaggactccacagatgtgtgtaaaagcactgagcattgaggcctctatcctggtctgcccaagtatgcagatgggaggtctgggcttctctgcgcrtctcttggttgggttggggtacatcagctctggctggtgtccctagagctgagaggctcctctaaaggactgcgaggctgccactagccctggaggggct

SEQ ID NO: 77540 - DNA, 201 bp, Homo sapiens
ttcttaagcccccaatattcaacttctttaagcagactgtgttgcttttattaaacaatagaaagcatttttttttttttttttttttttttttgagacgragtcccgctctttagcccaggccggattgcagtggcacaatcttggctcactgcaagctccgcctcccaggttcacgccattctcctgcctcagcctccc

SEQ ID NO: 77541 - DNA, 201 bp, Homo sapiens
gttttggaaacatctcaagtttaaggtcttcataaaaaaactcagtatcttctctgtaaaacctgcgacttctttattccttgtcttgctggttgtcttarccattctccctgtcaactacaacagaatctggaagcctccttagattctctctcctctcgtgttctggtggacaccaggtcatgtcaattccatttcccg

SEQ ID NO: 77542 - DNA, 201 bp, Homo sapiens
accaactgtttttactacaactttcttcgaagtcttctgtgccgattgcagcaatgagaattgcgatgtagaggtgttcatacttcatgtctacctctctyttcaccatcagcaagtgcagtgctctcaggtcacacattttcatttttgaccttgtatgtgtgtgtgtgtttcacaactggtgaaaataaggtcagattt

SEQ ID NO: 77543 - DNA, 201 bp, Homo sapiens
tgtgggaaggcctgtgaaagattctgagtaggacaagctggactttccagcccaaccacagagggtctctttctgggctatgagtttaggagacatggatrgttgcactccccaccagtaggtttctgacataagcaaaaacagcagagtttgtatccattggttttgcttatcccatcaaaccgtttagagtagtggtcc

SEQ ID NO: 77544 - DNA, 201 bp, Homo sapiens
gcaccgagttccacctgcagtgctggtgggaaatggaggtggaggggagtcttcatacagaaggcgaagtttgagttgagcctgagagatgaatagcatcytactcagccgaccagaagaaaaggaaaattacagacagtagtggcatgtaccaaggctcagaaatgtagaaatcatggtgagtttggggaagtacaaatg

SEQ ID NO: 77545 - DNA, 201 bp, Homo sapiens
tttaggagacatggatggttgcactccccaccagtaggtttctgacataagcaaaaacagcagagtttgtatccattggttttgcttatcccatcaaaccrtttagagtagtggtccccaacctttttggcaccagggactggtttcatggaagacaatttttccatggactggtgggtagggggatggttttgagatgaa

SEQ ID NO: 77546 - DNA, 201 bp, Homo sapiens
ggacaccagagagtccatgtctggagagtttgtgaaggtaaagaagcaaaccagcagggaagccctagaagacagcattcatgtctgcctctggagttcaratgaagagagaagaggaagtggagagtcccatttttcctataaccctggaaggaagttagatttcagagtaccatgtgcacgaatgtggtgagggcatgc

SEQ ID NO: 77547 - DNA, 201 bp, Homo sapiens
ttaccttccccattgccacaatctaattccagcactcactatctcccgttgtgtgattgaacttctttctagatttgcccctccaaaccatcttcatgctstatcagagtgatctttccaaatgcaaatctgattaagccatttcctcattaaaatctttcagtggcttctaagcacctcagagcgagttcacacttctta

SEQ ID NO: 77548 - DNA, 201 bp, Homo sapiens
gtgatcactctaaggtcccaaccttgacaaatctgtgtatttcggtgcaggtgtcttgctaccgaccagcacttgccggcctcctagggcctgcaggaacmtactgggcaccaaggacaatggcagtggacagggttgaatcagcaagaacagtgacccacaactgtgggctgagcaaactgccaaatcaaaagcagttgg

SEQ ID NO: 77549 - DNA, 201 bp, Homo sapiens
ttctttctagatttgcccctccaaaccatcttcatgctgtatcagagtgatctttccaaatgcaaatctgattaagccatttcctcattaaaatctttcartggcttctaagcacctcagagcgagttcacacttcttaagcatgttgtcccaggctttcacaattagtctcttggctacctctttgcttttacttgaccc

SEQ ID NO: 77550 - DNA, 201 bp, Homo sapiens
ggtcccttcaatttatcaatgaggttgctgatgcccattgaaacaaacaggcttggccaaaatcatacctctagttagaagcatatccaggtctagaagtygggtctctctcattcagtgcttaaaccttaagtttgtgtctgtttagcatataagtatacagtatacattgcagtcatctgtacatgttgatatttattc

SEQ ID NO: 77551 - DNA, 201 bp, Homo sapiens
tccatttttgactgtaggttttgctttggggcagtagagagaccattaagtgctcccatctctctatggccgttttcctgtgagtcggcatccaggctaaygactggggccgtggagagcccatgtggtgcctttatgccaattagaaaaaggcctcccttcctcaagttgcttttttaataaaaaaatcagtttttttga

SEQ ID NO: 77552 - DNA, 201 bp, Homo sapiens
ttttgaatgttgtgatgtaggaagtgcacatctcgaggcttagaaataaggtgcaagttggaaaacagatcagtccgctactttgaagttgtgtctgttaraacagaggccctgagtattaatcactttccatctacagtacgaaatgacgtgcagtcttacttccctggcctctttaagacttgtttacttatctgtcaa

SEQ ID NO: 77553 - DNA, 201 bp, Homo sapiens
tggtactactcaggggcagatgtacatgggcattccatttccttgcccattacacttacgtagtaccctcatcactataggtaatttttttcaggaaagcktgcaccctgttttggcttgctcaacagcaatgttagatatctcagaagtggtttaatccttccagcaccaaatggtccaaattgacttagcatgctttgc

SEQ ID NO: 77554 - DNA, 201 bp, Homo sapiens
cctatcagatattttccttaaaaatagagctctgagtctgttaacagcgcaagagtcagtccctgcatcaggatctgctgaatgcagagctttgtactggrtgtggtgttgaagcctcaaagaagggggaaaatgggagcttgaagggtactgatgggacacaaggtcctcacaaaagaaaacttcttgggtcggtcacag

SEQ ID NO: 77555 - DNA, 201 bp, Homo sapiens
gagaagaaatatagttgggggatttacaagattgggatttaagcattcttggtcaggaaatgttgagagaagagacttgagaaggggctaaggcagatgartggcttgagaagaaagcaccggggctgagctagacaagggacatgatggtgggggaaattcaggagaggatctcaggtggtttctctggaatttaggcag

SEQ ID NO: 77556 - DNA, 201 bp, Homo sapiens
caaaccatcttcatgctgtatcagagtgatctttccaaatgcaaatctgattaagccatttcctcattaaaatctttcagtggcttctaagcacctcagarcgagttcacacttcttaagcatgttgtcccaggctttcacaattagtctcttggctacctctttgcttttacttgaccccaaatgcacaccctaggctgg

SEQ ID NO: 77557 - DNA, 201 bp, Homo sapiens
aaattacttaatatactgattctgttagatcaaaacactttgccatcttccagaaaacgatcatagtaaatatgctattgaatataaactatcttctccayggtagtgcccccctgaaatagcacctttgtgcagtgcatgacctgcgccactgcatgtggccaccttgtttaggatagcaagtaccaaacttcaataaat

SEQ ID NO: 77558 - DNA, 201 bp, Homo sapiens
agctccttctgatggggagcctaagagtggacagtcctttttagcatcaatcctggctactcagtgcttatggttctgtccctcaggcttttgtcattgcsatcacctccgactttatcccccgcctggtgtaccagtactcctacagtcacaatgggactctgcacggctttgtcaaccacaccctctcctttttcaacg

SEQ ID NO: 77559 - DNA, 201 bp, Homo sapiens
agaaaactcacagtttgaccaggaggttcagttctgcaggtaaagtaatcttcaggagaagggcagcagaggaccagaagcaatagatccaaataattacrgggacgacctagaattacaaccctgcacaacatgatgatgttttggacaacagcagaccacatatatggcgattgtcccgtaagattataataccatatt

SEQ ID NO: 77560 - DNA, 201 bp, Homo sapiens
atttcacatgaaatattgcagagttggtgacagtagacataggagagtggctgagctaggattatctccaaagcttggactgaagtcagaggactgggatktggttacattgatagggagagggaatatgctgagagagtctaattttatgctacatatgatgaatttgatttcaatcatgttacatttaaaacgatgtta

SEQ ID NO: 77561 - DNA, 201 bp, Homo sapiens
agaggactgggatgtggttacattgatagggagagggaatatgctgagagagtctaattttatgctacatatgatgaatttgatttcaatcatgttacatwtaaaacgatgttaagaaatccaagaggtcattttcacccaactccttgacacactaagctggacttctggagacgtccaacttagagtcctgattgaagg

SEQ ID NO: 77562 - DNA, 201 bp, Homo sapiens
gaggaaagaatatagatgcaatcctgaagaagaaagctttgccattatggccagatggatggcgcatgatggaaccaattagcccattttttgctgaaaaraaagaaaaaaatcagaatttcaattttcaaagcagggactcttttttaaaaacgtttgattattttcttcttgttttaaactgatttccatgcttgtttg

SEQ ID NO: 77563 - DNA, 201 bp, Homo sapiens
gttaagggtcaattccaggaggcagttttaagtagctcagatggtatgaaaatattgtatgtagttgtgttcagcattaacatgacattaatttccactgrggctactaaaatgttttttacatgccactatttggagttgagaaatgcatttactagctgattcattacataacaaaagctcattaaaaagctgttactg

SEQ ID NO: 77564 - DNA, 201 bp, Homo sapiens
gtacagccactggtgtttcatgcctggcaccccaacccagccccattcttatctccagcacagcatggcttcattcgcgcccctgcttctcagagctcccbtttgttctaaccggtcctttccttatcttctccctgcagtgtgctccagggggctgtctcatggagctctgcattcagctcagcatcatcatgttgggga

SEQ ID NO: 77565 - DNA, 201 bp, Homo sapiens
tcatgggtttgttttataatgaaatatattttgagttaatggaaatcttatttaagtcatgtacaaactcaattcaatcaatgtgagttttcacaaagttmgaacaatctagataaaatattaacataattttaaagctaaaacataatgttgatttctgtatcactttcatttattatatgagtctgttcaaattaacat

SEQ ID NO: 77566 - DNA, 201 bp, Homo sapiens
ataattttgctcaggaaagcttactataaaaatgtacttgaatcaactgtgtattgccattaattacattcatcttttaccattttgaactttttaattgwaaaagtaattaatttcatagacacatattgtgtatgtatataagaagaaaagtgtcacttctcagcccccaccccagctgttctatcccagaagaaactg

SEQ ID NO: 77567 - DNA, 201 bp, Homo sapiens
attgtgtatgtatataagaagaaaagtgtcacttctcagcccccaccccagctgttctatcccagaagaaactgttgtgttcattttctgcaaaagctccrgaaatcatattcacctagattgtcttatttaattctcacagtgtctttctttaaaatgcaaggtatacacacaagcagacacacacgcacacacatctat

SEQ ID NO: 77568 - DNA, 201 bp, Homo sapiens
actggaggggtgagggtgagatccaggaacatccctaaaataatatgctggggataaaactctgcttctctttgggggccacggctggcagctgcaggagkctgaccagttgtgggggctcacccagtgctggggaactcagtgggactttgggaggcccgagctccccaagccatgggaacgggtctgttgtggagctgt

SEQ ID NO: 77569 - DNA, 201 bp, Homo sapiens
tcatgctcagataattatttccaactatcactttgtttgcttgtagtctctactgaaatcaaaggaatgactgaatgtgttaagagctaggatgtgctaayggaagtttctctgttttcttctgtgatggcttttggagcctaagaaatcagacgttgctgtttggaggccagggcgcagatcaaatgactactgtaaaaa

SEQ ID NO: 77570 - DNA, 201 bp, Homo sapiens
agggtttctgcaccagtacacagtctcagaggcaaaagaggtctatcatggagaaattagaaggagaaaattgttctgacacacatctaaataaaagattkatgcactttgggaggccgaggcaggtggatcacgaggtcagaagatcgagaccatcctggctaacatggtgaaaccctgtctctattaaaaatacaaaaa

SEQ ID NO: 77571 - DNA, 201 bp, Homo sapiens
tagagttttctgaacagatctctgtgttagtctttctgcagatcctcaattagatggatatgcttgttaaacttaaaacatgttttagacactgagggagracaaagtgacatttccaaaagctggggtgagttaatagcagaggtggaaccagaattagattatttatggattcttttcagactggaaaaaagaggggtg

SEQ ID NO: 77572 - DNA, 201 bp, Homo sapiens
gggagggctgggtcctgacgcagctctcctagaggttccaacaaggcatcaggtgtccttcggaaacattaacaccaacattgcccgtgagcttttagcaraggatgtgctttgtaccaaggcatttcttcatcaaacttttcccataaaatataactctttccttagcacaattgttacacatcctagtgctcttctttc

SEQ ID NO: 77573 - DNA, 201 bp, Homo sapiens
cgtgcacgtctgtgctcactggagagaagggccatgattcctgaattgtgggtcttgagaaaggagactgactagtggcattgtttaatgaatatgaaatrtctctgctcacaaaaattttgaaatcccttttgatatagactctcttctcttccaacaacacttctgctctttttccttttgcccctagggaaaggaaga

SEQ ID NO: 77574 - DNA, 201 bp, Homo sapiens
aaacaaactagcttttgcatggaccttttagagcagctaattcatttatggcaggagaagggaccaaagagcacctacttgtgaatgtcccctaaactgcrgtcactggtaagatgccctgtgataatgggaagaaagcctagattcagccagactcgcattcctaccctgactccacctttactggtcacgagactctgg

SEQ ID NO: 77575 - DNA, 201 bp, Homo sapiens
tctcttccaacaacacttctgctctttttccttttgcccctagggaaaggaagagaagacaaacactccctgggaatggggtggcgggaatatgacctggkgaaattcccaccagccaggaagggagaacaagcctttccaatgagggaagatcctcagaaggagaggaagagaaggggagggttgaggactgattattct

SEQ ID NO: 77576 - DNA, 201 bp, Homo sapiens
aggaacatgcagaattgcactgactgccaaacctcgctcaggaaagcggcttcttcttttgtgggactaataggacatagatacagctcttagtgagagcrgtaggctaacgtgtaccaggccactcctgtacaggaaatcttacaaccagttttaatttcctcagatttttttttttaagacggagtttcactcttcttg

SEQ ID NO: 77577 - DNA, 201 bp, Homo sapiens
attgcactgactgccaaacctcgctcaggaaagcggcttcttcttttgtgggactaataggacatagatacagctcttagtgagagcggtaggctaacgtrtaccaggccactcctgtacaggaaatcttacaaccagttttaatttcctcagatttttttttttaagacggagtttcactcttcttgcccaggctggagc

SEQ ID NO: 77578 - DNA, 201 bp, Homo sapiens
aagtctccggctgcccgtttgagatgcattcccagcattttggagcgatgcttgcctctgtcatctgactgctctggcagggctgctccgtaaacagtccygtgacatcaatctgcaggcatgattagcagcatttgacagggtcgaagggccgccacgtcctggaggacggatgtaggcttgacttcccagctcagctgg

SEQ ID NO: 77579 - DNA, 201 bp, Homo sapiens
agaccacaattatagagcttggttttgactttttttccagggccttaaagttgatatatttttacatttcctggattggagggtagggagcatggctttgrgtttagcttttgctctgctgattatctcttggctctgtgaaaaaccttggcagtgctgtggggaattggtgcggtggggaatggaggcttgaagagtcag

SEQ ID NO: 77580 - DNA, 201 bp, Homo sapiens
aaagctggggtgagttaatagcagaggtggaaccagaattagattatttatggattcttttcagactggaaaaaagaggggtgagcagtggctcgcatacygaggtcagtgagcagctgttcctgcagagatgcagctagagaacaagagaaatggactttcattgtagcagtagggattgggctgaacccagggaaggat

SEQ ID NO: 77581 - DNA, 201 bp, Homo sapiens
tggtctggatcagccttctttttggttcaagaatgcagccatgaagcaaggccagcccctctagtggccgtagtcctgaagcatctggaaggggaagaagyccaagactgcctgctggtgtctgcatcttccccaacccccccggctgcagagcaccattcagggtgtctgggtctcccctacccacacagaggccacagg

SEQ ID NO: 77582 - DNA, 201 bp, Homo sapiens
ggtgtctgcatcttccccaacccccccggctgcagagcaccattcagggtgtctgggtctcccctacccacacagaggccacaggctagtgggaggcccargtggacccactggcctggactaccctcagatgccctgggctcctttgggagttgatgcctgacaccaaagtaagctttgggagctattggagagggtagt

SEQ ID NO: 77583 - DNA, 201 bp, Homo sapiens
gaacaagaggagtactgagataactgcagccgtagggccggtgactgttagggctgccatctcttctgtgtttccagctgtgagctaagtgcggtgagacrcacaggtgagaggagtgctctctgacgcaggtcaggcctctggggaacacaaaacaatgagcaaaccttgtcctggaagtgaagcaagctgcccacttcc

SEQ ID NO: 77584 - DNA, 201 bp, Homo sapiens
ctatattcattcattgagacagtaagtgctctggggaaaaggtagtcctagcctactgtgtgcaccagcaaagggatgtggcttagcagccaggaggaagwccactgcaagtgtgtgccaaagcctagacccaatcggggcaagctggatgcaggggttcccagacaggcagggttagccgaggtggctgcagtgactgag

SEQ ID NO: 77585 - DNA, 201 bp, Homo sapiens
ccttgtctctctctcctttcctttcttttcctctcctctcctctcctctcctctcctctcctctcctctcgtctcctctcctctcgtctcctctcctctcstctcctctcctctcctctcctctcctctcctctcctttcctttcctatttattgagcttctactatgtgccaggcattgttctcagactggagatagagc

SEQ ID NO: 77586 - DNA, 201 bp, Homo sapiens
gacaaaatccctgcctcatgaagcttacatcccggggaaagacagatgataagctaaatgtacagtgttttggatagtaataagtgccgtggagaaatatyaggtaagacaagtagacaggaagtgtgaaggcacaggaggtaaggggtttaccattctaaatacaaattaatgacaaaccccgatggtgaagaggttaca

SEQ ID NO: 77587 - DNA, 201 bp, Homo sapiens
cactcggctaccgtgcaaagtccagctgagaattagcagatgagctaagtcggtgaaaacaactgctggacttttccacagagttttgggactgtcttaakggtatatacagctgccacagcaactgtggggtgtgactgtatggattgggttgggtaggttctggggtgcggtctagctggggccttacccgcctgtgat

SEQ ID NO: 77588 - DNA, 201 bp, Homo sapiens
cctggttccttgcaggtcagcgggactagagtccaacgaaatgtctgagtggaagttgcaggggggatggtactccagaggaaaaatgagagctatggttmtgctgtttgagcacacctggcaatgtgcgggcctgtaggtgctggctggtcaccagtgctgcccaccacctttctgatttcctcctaggaacatgcagaa

SEQ ID NO: 77589 - DNA, 201 bp, Homo sapiens
tttctgaagatgatgttgagggcttcaatatttaaaggtaaaaagtgggctgagggtgggtaagagggagggtgtgatcttgttactgaatccacatgttmcaagagaaaaggagcaggtaggagaacagctgattttgtgtttttctggtgctcagtaaatcagcattttacataagataaggtgaacgtagagtagctt

SEQ ID NO: 77590 - DNA, 201 bp, Homo sapiens
ccagccaggaagggagaacaagcctttccaatgagggaagatcctcagaaggagaggaagagaaggggagggttgaggactgattattcttgcccttgggktgaaaccatgcggctgtgagaatgggtttggaagcaaggggaggtaggaacaaagatattttggggtgaatcctagggcacagtgtttgcaagagaacac

SEQ ID NO: 77591 - DNA, 201 bp, Homo sapiens
tctctaaatccttcctggaattcattataatgtggaggttgaaagctggaatctcattagacttgttggatttgaatctcgtctctgcatcttaccagctrtgcaaccttgggttagtgaatgtttttgtacatcagtttcctcatctgtaatttaaggataatagcatactaccttgtagggctgtgagaactaaaaagt

SEQ ID NO: 77592 - DNA, 201 bp, Homo sapiens
aaagtacaaactttgattactgtttcaaaactttcttgttttttaatactacaaatatctctctacgcatagctttaacagtatcctacaaatcttgataygctgttttgttattttcgctgaattgaaaatatttgctgattttctttgtgatttcttctttgatccataggttatttagaaggatgttgtttaatttcc

SEQ ID NO: 77593 - DNA, 201 bp, Homo sapiens
tgttttttaatactacaaatatctctctacgcatagctttaacagtatcctacaaatcttgatatgctgttttgttattttcgctgaattgaaaatatttkctgattttctttgtgatttcttctttgatccataggttatttagaaggatgttgtttaatttccaaatatttagggattgtttccagactctttctggta

SEQ ID NO: 77594 - DNA, 201 bp, Homo sapiens
ctcatacatttgtagttgagacagatcaggtaacaggagacaaattaagaagagaaaagcaaggcatgattgataagaaaatttgcttatttctatagtayataccattttaatataataaccaaaattatgactaatagcattatgcgaagacatatcatatttttaggaatttcatacaatttctggaacacatgttaa

SEQ ID NO: 77595 - DNA, 201 bp, Homo sapiens
tcttttcatattgaaaagactcagttttcttaattaaagacctaataaaagacaatatgaagcacaataaattattttggtaagacacaagtttttgtttracttaaaaggcgaagaaaaaattttcgctatctcttatcaatactccaagaaagtcttgacagtttaaaggagaagatcaaattctagttttgtttcagt

SEQ ID NO: 77596 - DNA, 201 bp, Homo sapiens
tgaaaagactcagttttcttaattaaagacctaataaaagacaatatgaagcacaataaattattttggtaagacacaagtttttgtttaacttaaaaggygaagaaaaaattttcgctatctcttatcaatactccaagaaagtcttgacagtttaaaggagaagatcaaattctagttttgtttcagtatacttttgat

SEQ ID NO: 77597 - DNA, 201 bp, Homo sapiens
gtaggtgcactttcaatttaaaaataaagcaaacaatgaagactccttccctgagctctttaaggaaataatgaacattttttattccattgtgacatgcmaaaaaaaaaaaattgtgagcaaaaatctgaaacactgaagaaagaaaaagaaattgctcattatccaattcctcctttctagaaataatagtagttaata

SEQ ID NO: 77598 - DNA, 201 bp, Homo sapiens
aaaatctgaaacactgaagaaagaaaaagaaattgctcattatccaattcctcctttctagaaataatagtagttaataattcagtttaattgtgatcctrtggtatatgtacaataacattcattgatttgtaatagcatttatttggtttaattataaaagtgatccatgctcattgaagaagacttagaaaatgcaag

SEQ ID NO: 77599 - DNA, 201 bp, Homo sapiens
attatgtttttgcacatgggataagttaaggttacctgcttagatggccaatttttttttacccatatctgtggagaatacattaaaaattgccatttgcycttgctaagtaatcttatgggggatgtggactaaatttggggtataggactttttatagcagttgatatttaaaataaagagcctttttccccctttctt

SEQ ID NO: 77600 - DNA, 201 bp, Homo sapiens
cttttcacccaataaaccctgccctactcaccctacaatgtgtccatgtgcctaaattatcccgggcatgtgacaagaacccgttgtttttttctacaatkccagcaggctgtggaaagcatttcctggagcaaggaaaagaatgagatgggaaaccaagggacgaatctttgccccatagcttatttgaaatatatagcc

SEQ ID NO: 77601 - DNA, 201 bp, Homo sapiens
gtaggttttctctaagaaggagttttggatgagtatttgcttattagagatctagggtaacttttaaagctttttttctctttaagtgtaggacagtctayggaattttttttttttttttttttgctgtgggggtccaaaatttgggacgtcctggagctgatgaagttttactacagagccccacggaagtaagaggag

SEQ ID NO: 77602 - DNA, 201 bp, Homo sapiens
aaatttattcttgtaactcaaaaatttcactgggatgtgtctccatgtgcgtttcttttatttaatgtggcctaaaatgtaatgatcatatttggtctgcrcagttacttacttttcatctctgaaaagtattcttccagcacaggaacggatctcagcatatctattctgactgtttcggttgctttgggaaaacactcc

SEQ ID NO: 77603 - DNA, 201 bp, Homo sapiens
tggatatgaaattctgggttgaaaattcttttctttaagaatgttaaatattggcccccactctcttctggcttgtagagtttctgctgagagatctgctrttagtctgatgggcttccctttgtgggtaacccaacctttctctctggctgtccttaacattttttccttcacttcaactttggtgaatctgacaattat

SEQ ID NO: 77604 - DNA, 201 bp, Homo sapiens
cacccacttacaggggagaacccaaagtagaactttggatgtgacttcctttagcattctggaaacccttagtcctggattttccagcctttgcaggtggrtgtcttccctagtggatagttagtaagtgacccactgaaaactgtggagagagtcactcctgcattttaagacttgccttcctcacaagaaaggcacttt

SEQ ID NO: 77605 - DNA, 201 bp, Homo sapiens
cccttatgagttttcgaaacagtactggtttattctgtctgcccgtctggcttttgtcataatcttccaggtgagttgctgggatagggaatagcccattygaatccgggctgcaggagtaaggacactgcactcattgcttgcacctacctccaggttccggtggtactctgtgacataagaaagcttcatgtgtggcag

SEQ ID NO: 77606 - DNA, 201 bp, Homo sapiens
tgaagagaggacatggtgaacctgtaagggagaaagtggattcactaagagctgcattagaaggctctagactctgcaagtttaaagggattgttacgtgyctgtgctttactcacaccatgctggtccatatggggcaggactccagagtgtgcctcccttcaccctgagtgctggtcccttctgggaccctgcaagctg

SEQ ID NO: 77607 - DNA, 201 bp, Homo sapiens
tctactgtttagaacacagtgtaactggtaagaattccttcccagacatgagctgtgaccatgaacacatctctcatttccctgcaaagtccttgcagcaytcatctcttctgttagcaagaagtccaatatcttcctgtctttctctttggattttctaggagcccagggactaaagcatccagaagagaaggaagggct

SEQ ID NO: 77608 - DNA, 201 bp, Homo sapiens
tccatgcagatgacacttgttctctaggagcttaccatcttagagagacatcatttgttatggaaaaacaaccagagaatatgcagatggtaccaaagccrcatctggcccctttgaaaccatgaggccagctcctccacaactgctataaagaaaagtcttcatcctaattaaacatctgggaaaaacaccagccttccc

SEQ ID NO: 77609 - DNA, 201 bp, Homo sapiens
ggtttcctggaagacagtttttccgtggaccgggggagtggggtgtgattttgggatgattcaactgcattacatttattgtacactttatttctattatwattaaattgcaatatataatgaaataattttacaacttaccataatgtagaatcagtgggagacctgagcttatttttctgcaactagacagtcccatct

SEQ ID NO: 77610 - DNA, 201 bp, Homo sapiens
caaatttagctccggtccacatcgaagcaaaattggaaatgggctcttctcatatggagaggtgggtttttggtgaaagggtaaatgccacctttttcacrtaccacattgtttcctgggcatgctttgagacagacagagcagatagacagatcaatactgccacggtcaaaatgtctcgccatctctattctaactaaa

SEQ ID NO: 77611 - DNA, 201 bp, Homo sapiens
ccttgacttacagtggggttatggtggataaacctgtcataagtcagaaatattaaaagtagaaaatgcatttaatggcctgataaacctgttgtaaagtsgaaaaattgtaagtcgaaccatcattaagtcagggaccttctgcagtactaatggaggttgctgatagctttaggctggcctctctattttgcagacaag

SEQ ID NO: 77612 - DNA, 201 bp, Homo sapiens
tgagcacaatctgatggaggctggactggagcttgagaaggacttggaggtgagtcaggcgggtggccagggacttggagatggaatggcaccacagaacygggctcctagtgagcagtgccacctgacagagagcctaggctttattctggcaggtggacttttttttctgctggagaaaccagattttgtttctttctt

SEQ ID NO: 77613 - DNA, 201 bp, Homo sapiens
taatctgaaggtttccaaaagcccatctgtatgttatacaacttccaggattcctgttaaattctgctctggagggacttcctttattattattttttttwatggtcactgggatatccaggaggaaatctgggaatgataaattcacaggactatttgtggatattttcccctgcatttgttttgacctacccacactgg

SEQ ID NO: 77614 - DNA, 201 bp, Homo sapiens
gaaaaattgtaagtcgaaccatcattaagtcagggaccttctgcagtactaatggaggttgctgatagctttaggctggcctctctattttgcagacaagraggctcagagagggatgacgacttgcttgccccaggccttcccacctcattaggagcaacccatcaaagactcattgtaccactatcacaaaataaaagg

SEQ ID NO: 77615 - DNA, 201 bp, Homo sapiens
ttctgtatgttttcttccttgctttatatccttggttggtgaaattcatcctccaggagcttcatgagaatggatgcatgcatagaaagttcatttttttkaaaccttgcatacttaaaagtgtctttagtctgtctttgactttcgtctatactttggctgggtataggagtctatgctgaaaattatttgccttctgaa

SEQ ID NO: 77616 - DNA, 201 bp, Homo sapiens
cagaaagagcagagcaagtgagctggaccccaggaggggagaaggggagccagagtgttttctgtgtctgctaggaaaaccaagcagtgggaggaagaaaraatgttttccattttagccacaaattacactgcgttctgtcctgggctttaggcatgcctgcagacttaggtgctgtgccacatgactgccttatgccct

SEQ ID NO: 77617 - DNA, 201 bp, Homo sapiens
cgggaggaatttgagcacaatctgatggaggctggactggagcttgagaaggacttggaggtgagtcaggcgggtggccagggacttggagatggaatggyaccacagaaccgggctcctagtgagcagtgccacctgacagagagcctaggctttattctggcaggtggacttttttttctgctggagaaaccagatttt

SEQ ID NO: 77618 - DNA, 201 bp, Homo sapiens
tctgtatgttttcttccttgctttatatccttggttggtgaaattcatcctccaggagcttcatgagaatggatgcatgcatagaaagttcatttttttgraaccttgcatacttaaaagtgtctttagtctgtctttgactttcgtctatactttggctgggtataggagtctatgctgaaaattatttgccttctgaat

SEQ ID NO: 77619 - DNA, 201 bp, Homo sapiens
gtctgtctttgactttcgtctatactttggctgggtataggagtctatgctgaaaattatttgccttctgaatgtaaatacatttctgcagagtcttctartgtcaagggctgatctggagaattgtaacctatttttgattcccaattatttgtagaggatctatatgtttgtttctctggatctagaagcttttagaat

SEQ ID NO: 77620 - DNA, 201 bp, Homo sapiens
tgcagagtcttctagtgtcaagggctgatctggagaattgtaacctatttttgattcccaattatttgtagaggatctatatgtttgtttctctggatctrgaagcttttagaatcctttccatcattcctaaagttctgaaatctcatgacgatatgttttgctggaggcttttttttcaccattatgctgagtgggtcc

SEQ ID NO: 77621 - DNA, 201 bp, Homo sapiens
ctgatctggagaattgtaacctatttttgattcccaattatttgtagaggatctatatgtttgtttctctggatctagaagcttttagaatcctttccatyattcctaaagttctgaaatctcatgacgatatgttttgctggaggcttttttttcaccattatgctgagtgggtccttccaatcagaaaatgcatgtcct

SEQ ID NO: 77622 - DNA, 201 bp, Homo sapiens
cctctgggacattttcttttatttcttttgcactttcttccccaccattgtctctgtcttctctttctgattaagtgttggagtttcaggccgggtgtggyggttcgtgcttgtaatccttgtactttgggaggcctaagtgggtggatcatctgagcccaggagtttaagaccagcatgggcaatatggtgaaaccctgt

SEQ ID NO: 77623 - DNA, 201 bp, Homo sapiens
aagagacttggtgcatggatcttcctacgtgaccttggcatgtctatgatgactttttcatgttccattcctgtttgatgaaatagaagtagaggctcacsttgttatgaatggtggaaggagacccagtgtggctcatgtcaagaagagcttactccactcaagaattattttcctatttatacttctatatccaaatac

SEQ ID NO: 77624 - DNA, 201 bp, Homo sapiens
agtagtattatgcctacatgcctcttccattccatcaggtcagtagtgaggagagttgagtcaatctagttgagtgaggttttgttgttgcaagagtcacmttcagtgcactgcactacaaacttcagattccttcagtgatagtacgctattaccttatgctttgtgtgagccctggagtgctgaattggtcctcattgt

SEQ ID NO: 77625 - DNA, 201 bp, Homo sapiens
tacagggactatcgcatcctcccattctctgtcaaatgtaaaactattcacatatcccagttttccctggacggacttggcatttaaaaaaaattcagttstcctggttaccttacaacttcagctctctgatgagctcaagcaaagttataatttcacagattatccagatttctcttgttgttaggctgggaactatat

SEQ ID NO: 77626 - DNA, 201 bp, Homo sapiens
tttaagaagaagaaagatctcaaataattaattttacatctcaagtaactacaaaagaagaaaaaactaagcccaaaattagcaggagggaagaaataatmtagattaggggataaataaatataagacaggatatgaaaacagaaaaacaaaaaattgatgaagctaagagtttgttgacgaatccttagttagactaat

SEQ ID NO: 77627 - DNA, 201 bp, Homo sapiens
agcacaagcaacaaaagcaaaaatagacaaatgggaatatatcaaactaaaatgcttctacacagcaaaggaaacaatcaacagagtgaaagtcaatatgsagaatgggagaaaatatttgcaaaccatatatctggtaagggattaatatccaacatgtataaggaacttctacaattcagtggcaaaacaaagaaacac

SEQ ID NO: 77628 - DNA, 201 bp, Homo sapiens
taaactggcttaaaaataaagaaataaaaaccacccataagcccatcatccaaagaaaccattactaatattttattggatttcttctagtcgtttttcartaagtgtgtgtatgttggtttgcatacccaagtatacatgcccaaatatatgatctgtgtgttttgtttaaataagctagttccaaaaaggtgtgttttc

SEQ ID NO: 77629 - DNA, 201 bp, Homo sapiens
tggtctcagggtaacttcacacttttaaaaattattgggaacacccaaagggtgtttgcatgactatgtcgaccaatgtttactgcatgagaagttaaggytgagaaattgtgaaagtgcaagaatacacaaacacacatgccattagccataggggatgatgtcagcatgtgccacaacaccccactatgtacttgtgaa

SEQ ID NO: 77630 - DNA, 201 bp, Homo sapiens
gataaatgtctatcagagcatgtatcttggtacatgctcttaacatgtatcaagccctaaatgaagcatgctgtatagattatgtcttttaactcaccctrtgggcaagttaatatttatttctccattttaaagataagaaaactaaagcttatagagttgtaataacttgcccatggacatatagttggtgatttgtga

SEQ ID NO: 77631 - DNA, 201 bp, Homo sapiens
taacatctccaggtccctcttgcagccaccgctgcagccttgctcggtatggaaatgtgtatttccaggcttcagaaagcaaagcgtgtcgggaatgggasgaggagaatcagtgaccctgctgagagtggccccacctcatctgaagtcaaggccctccccaggagaacgtctgaattgatgaatacaaaaagccatcaa

SEQ ID NO: 77632 - DNA, 201 bp, Homo sapiens
actattaggttgctgcttaaagtaattgcagtttttgccattaaaaagtaattgcaaaaactgcaattccattccctgtacattgtgcatcaatgggaagkatgaaataactccaccctaaggtgtattttagcattcggtattaaaaataataacaggtatcatctattcaatgcttactgtgtccagatattgtgctaa

SEQ ID NO: 77633 - DNA, 201 bp, Homo sapiens
gactactttaaagcattggtcagataagtccaatatctttgtcatcggcatttgtctattgtcatttctcacaaaagatttccttgttctttgtatgttcrgtaattttaaattgtatcctggacactttcaatattatgttatggaaatctgggttttatttaaatcctatttgtgttttatcaggcaattgatctggtt

SEQ ID NO: 77634 - DNA, 201 bp, Homo sapiens
tcctgaatgtagttgtcttagtctgctcaggctgctgtaacaaaatgccataggcttaattgacagaaatttattttctcatagttctagaggctgaaagkttcaagatcaaagtcgaaaagggttgaatttctgatgagggctcttcttacaggtagctgccttttctctgtgtcctcagatggtcttgagatatccctt

SEQ ID NO: 77635 - DNA, 201 bp, Homo sapiens
cagtggcattaatgttagatgtttttggtttgccttataggtctccaatattttgttcattgttttcaacatgtttttttgtctctgttgttcaggttggwtaatttctattgatttcttcaagtatactgactcctctgtcacttcaattctgttattgagttcattcagtgagttttttaattcagttattttattttt

SEQ ID NO: 77636 - DNA, 201 bp, Homo sapiens
ttttctctgtgtcctcagatggtcttgagatatccctttctctcttcctctactcataaagccaccaatcctattgaataggaccccacctttttgacctyatttaatctaaattacctcctaaaagtcatatctcccaatacagtcacattggggattagagcttcaacaaatgaatttcagcagacatcattcagtcca

SEQ ID NO: 77637 - DNA, 201 bp, Homo sapiens
aactataaaaaccctagaagaaaacctaggcaataccattcaggacataggcatgggcaaagacttcatgactaaaacaccaaaagcttttggccacaaawgccagaattgacaaaggggatctaattaaactaaagagcttctgcacagcaaaataaactatcatcagagtgaacaggcaacctacagaatgggagaaaa

SEQ ID NO: 77638 - DNA, 201 bp, Homo sapiens
ccatagtagtggtgggcaatgtttagcttggttttaatggaaagatgatgctattaatgttattgagacctgaaaaatgtttcacctaggaggagaacagmcctgtgttcccccatgaagagggtggatagatcacctgttggacaataggactggtgccgtctcagcattggcaggaagggccaactctcttgttgcttg

SEQ ID NO: 77639 - DNA, 201 bp, Homo sapiens
cccaccagcagtgtaaaagtgttccttttcaccacatccatgctgacatctattgttttatgactttttaattatggccattcttgcaggagtgaggtggkatctcattgtggttttaatttgcatttccctgatgattagtgatgttgaacattttttcatatgtttgttggctatttgtttatcttctcttaagaaatg

SEQ ID NO: 77640 - DNA, 201 bp, Homo sapiens
tggctcatgcctgtcatcccagcactttgggaagcagaggcaggtggatcacctgaggtcaggagtttgagatcagtctggccaacatggtgaaactccayctctactaaaaatacaaaaattagccaggaatggtggcaggcacctgtaatcccagctacttgggaggctgaggcacgagaattgcttgagcctgggaga

SEQ ID NO: 77641 - DNA, 201 bp, Homo sapiens
agctacttgggaggctgaggcacgagaattgcttgagcctgggagacacagcttgcactgagctgagattgtgtcactctactccagcctggccaacagartgagagtctgtctcaaaaataaataaataaagatcttagctataatgtctaaacattctaaacatttactcaatggggaaccatcaataagatccatcaa

SEQ ID NO: 77642 - DNA, 201 bp, Homo sapiens
ctttaaggaatctccatactgtttttcatagtgattgtactaatttacatcccaccagcagtgtaaaagtgttccttttcaccacatccatgctgacatcyattgttttatgactttttaattatggccattcttgcaggagtgaggtggtatctcattgtggttttaatttgcatttccctgatgattagtgatgttgaa

SEQ ID NO: 77643 - DNA, 201 bp, Homo sapiens
atgttattatgtgtttcaacttgggtgcttaccaagaaatgagaagaatgaaaaaaaaagtaaagaactagaagatttacttggtgactttgggaaggaaytcacaccaagattgtagagagtgagattcagaccatagactgaaaaaccagaaagaaaaacaaaccccaaaccccacaccttaaaatgaataaaacaatc

SEQ ID NO: 77644 - DNA, 201 bp, Homo sapiens
ttcaatagttttggtggtacaggtggtttttggctacatggataagttctttagtggttatttctgagattttagtggacctgtcactgagcagtgtacaytgtacccaatatgtagtcttttatacctcaccccccttccagtccccaaagtccattatatgattcctatgtctttgtgtcctcatagcttagctcccac

SEQ ID NO: 77645 - DNA, 201 bp, Homo sapiens
tgactctggttttgaggcttaaagtcagccaggtccaattctcccatctgaaaagtaggtttgatgataatagcacctacctcataggactattctgggartcagttgatgcatgtagagtgcttccacatgtagaccgtcaatgaacattggccaccgttgttattgtccagagttcagtttctctcaaatctagaaagt

SEQ ID NO: 77646 - DNA, 201 bp, Homo sapiens
attgcaagcccttctaattccacgtagcacagaagacagcattcagtccccctcagaaatgcgttccagtaaatcccttggaaaattttgaactcagtccycagtctttgcctttatatatctttttacataaaaactgtggccccaaatgtgtccatctttcctctggcaaagagaaggccgaaaatttggcttcctaac

SEQ ID NO: 77647 - DNA, 201 bp, Homo sapiens
acatcttttgttgagtatatattttgcaaatatcttcttctcactcagtggtttttcttttcactcttttggtggataaatgttctcaattttattttacktcattttattgatcttttcctttatgtcagtgctttttgtattctgtttaagaaattatcacctatccaagctaagaatatattctttgttatcttccat

SEQ ID NO: 77648 - DNA, 201 bp, Homo sapiens
gtgtaggctgtgccctaattattaaagaatgagggtaccagaccccaaggcatacctaagaatcagaagcctgagctctaaacactccaagatgtttgtcytttcagtaaactctaagccctcagggctctattgacaagtctggactctcagatgggctctttttgtcatctgtttatctaaaacccacaagcttttgtt

SEQ ID NO: 77649 - DNA, 201 bp, Homo sapiens
cccactggactctgggctttttgccctccctggaggctgctctgtggcctctgaagcacaggttggccctgggtgaccattttttgggacccagatcagtycatcacctcacagggcgaacactcagacttgccgctgtcttcctcactcttacctatataaaacttgtcttgaagcagttctcctcttataattctcaag

SEQ ID NO: 77650 - DNA, 201 bp, Homo sapiens; identical to SEQ ID NO: 30479

SEQ ID NO: 77651 - DNA, 201 bp, Homo sapiens; identical to SEQ ID NO: 30088

SEQ ID NO: 77652 - DNA, 201 bp, Homo sapiens; identical to SEQ ID NO: 30087

SEQ ID NO: 77653 - DNA, 201 bp, Homo sapiens; identical to SEQ ID NO: 30090

SEQ ID NO: 77654 - DNA, 201 bp, Homo sapiens; identical to SEQ ID NO: 30089

SEQ ID NO: 77655 - DNA, 201 bp, Homo sapiens; identical to SEQ ID NO: 30091

SEQ ID NO: 77656 - DNA, 201 bp, Homo sapiens
tctccctacatatttatttgccttgtagtttattttattctcatgaccgttggggctggctccttgacttgaccatatatatatatatatatatatatatwtttttttttttttttttttttttgacggagtctcggagtctcggctcactgcaagctctgcctcccgagttcacgccagtctcctgcctcagcctcccga

SEQ ID NO: 77657 - DNA, 201 bp, Homo sapiens; identical to SEQ ID NO: 30402

SEQ ID NO: 77658 - DNA, 201 bp, Homo sapiens
cactgcaacctccccctcccaggttcaagcgattctcctgcctcagcctcccgagtagctgggattacaggcgtgcgccaccacaccctgctaattttgtrtttttagtagagacggggtttctccatgttggtcaggctggtctcgaactcccgacctcaggtgatccgcccgcctcggccttggttcctcatctttaaa

SEQ ID NO: 77659 - DNA, 201 bp, Homo sapiens
cgtgttgtccaggctggaaggctggattgcagtggtgcgatctcggctcactgcaacctccccctcccaggttcaagcgattctcctgcctcagcctcccragtagctgggattacaggcgtgcgccaccacaccctgctaattttgtgtttttagtagagacggggtttctccatgttggtcaggctggtctcgaactcc

SEQ ID NO: 77660 - DNA, 201 bp, Homo sapiens; identical to SEQ ID NO: 30058

SEQ ID NO: 77661 - DNA, 201 bp, Homo sapiens; identical to SEQ ID NO: 30115

SEQ ID NO: 77662 - DNA, 201 bp, Homo sapiens; identical to SEQ ID NO: 30116

SEQ ID NO: 77663 - DNA, 201 bp, Homo sapiens; identical to SEQ ID NO: 30120

SEQ ID NO: 77664 - DNA, 201 bp, Homo sapiens; identical to SEQ ID NO: 30122

SEQ ID NO: 77665 - DNA, 201 bp, Homo sapiens
tcttttgaaatggaatctcactcgtgttgtccaggctggaaggctggattgcagtggtgcgatctcggctcactgcaacctccccctcccaggttcaagcrattctcctgcctcagcctcccgagtagctgggattacaggcgtgcgccaccacaccctgctaattttgtgtttttagtagagacggggtttctccatgtt

SEQ ID NO: 77666 - DNA, 201 bp, Homo sapiens
tagcctccaattcctcatcttttgaaatggaatctcactcgtgttgtccaggctggaaggctggattgcagtggtgcgatctcggctcactgcaacctccscctcccaggttcaagcgattctcctgcctcagcctcccgagtagctgggattacaggcgtgcgccaccacaccctgctaattttgtgtttttagtagaga

SEQ ID NO: 77667 - DNA, 201 bp, Homo sapiens
agggcagttgtgctgtcttagcctccaattcctcatcttttgaaatggaatctcactcgtgttgtccaggctggaaggctggattgcagtggtgcgatctyggctcactgcaacctccccctcccaggttcaagcgattctcctgcctcagcctcccgagtagctgggattacaggcgtgcgccaccacaccctgctaatt

SEQ ID NO: 77668 - DNA, 201 bp, Homo sapiens; identical to SEQ ID NO: 30128

SEQ ID NO: 77669 - DNA, 201 bp, Homo sapiens; identical to SEQ ID NO: 30148

SEQ ID NO: 77670 - DNA, 201 bp, Homo sapiens; identical to SEQ ID NO: 30150

SEQ ID NO: 77671 - DNA, 201 bp, Homo sapiens
ttgcttaatctgttcattttgtgaattttgggttttacaagatttctggttcagtgaccctcctttctattagtatagaaaagtcatttccttagtggtgkgtgtgtgtgtgtgtgtgtgtgtgtgtgtgtatgtgtgtacatgtggatcctgaaggattgtgtggcctctgatttttcaggtttttctggaccctgactt

SEQ ID NO: 77672 - DNA, 201 bp, Homo sapiens; identical to SEQ ID NO: 30152

SEQ ID NO: 77673 - DNA, 201 bp, Homo sapiens
gataggatctcactgtgtcgcccaggcctggagtgaagtggcacaatcatggctcactacagccttggcctcctaggctcaggtgattctcccacctcagtctcccacctagctgagactagaggtgtgtgccaccatgtccaactaatttttgtggagatggagttttgctatgttgcccaggctggtcatgaattcctg

SEQ ID NO: 77674 - DNA, 201 bp, Homo sapiens; identical to SEQ ID NO: 30153

SEQ ID NO: 77675 - DNA, 201 bp, Homo sapiens; identical to SEQ ID NO: 30069

SEQ ID NO: 77676 - DNA, 201 bp, Homo sapiens; identical to SEQ ID NO: 30071

SEQ ID NO: 77677 - DNA, 201 bp, Homo sapiens; identical to SEQ ID NO: 30458

SEQ ID NO: 77678 - DNA, 201 bp, Homo sapiens; identical to SEQ ID NO: 30156

SEQ ID NO: 77679 - DNA, 201 bp, Homo sapiens; identical to SEQ ID NO: 30158

SEQ ID NO: 77680 - DNA, 201 bp, Homo sapiens; identical to SEQ ID NO: 30160

SEQ ID NO: 77681 - DNA, 201 bp, Homo sapiens
ctaaaatgtcatgtctgaggccagagtgattcattgtagggccttgagaaccaatgggggctttcatgtatttagagtcctttcctggtaccaggtaatgrgcttggcagggttgatggatgagagacaaaggatcatgctgtaggaaagggaaggatccagatgtccagccttgtgctccataagaacatgtgcttatca

SEQ ID NO: 77682 - DNA, 201 bp, Homo sapiens; identical to SEQ ID NO: 30082

SEQ ID NO: 77683 - DNA, 201 bp, Homo sapiens; identical to SEQ ID NO: 30083

SEQ ID NO: 77684 - DNA, 201 bp, Homo sapiens; identical to SEQ ID NO: 30084

SEQ ID NO: 77685 - DNA, 201 bp, Homo sapiens; identical to SEQ ID NO: 30085

SEQ ID NO: 77686 - DNA, 201 bp, Homo sapiens; identical to SEQ ID NO: 30170

SEQ ID NO: 77687 - DNA, 201 bp, Homo sapiens; identical to SEQ ID NO: 30086

SEQ ID NO: 77688 - DNA, 201 bp, Homo sapiens; identical to SEQ ID NO: 30171

SEQ ID NO: 77689 - DNA, 201 bp, Homo sapiens; identical to SEQ ID NO: 30100

SEQ ID NO: 77690 - DNA, 201 bp, Homo sapiens; identical to SEQ ID NO: 30103

SEQ ID NO: 77691 - DNA, 201 bp, Homo sapiens; identical to SEQ ID NO: 30185

SEQ ID NO: 77692 - DNA, 201 bp, Homo sapiens; identical to SEQ ID NO: 30187

SEQ ID NO: 77693 - DNA, 201 bp, Homo sapiens; identical to SEQ ID NO: 30191

SEQ ID NO: 77694 - DNA, 201 bp, Homo sapiens
tgccctgagatcaccagcccaacctgtggcctctccctccagggaccctttgtgcagaaggaactcgcggcaggtcatccacggcccgatgcagccttttyggaagtgacttcgtcaacacctttgatgggagcatgtacagctttgcgggatactgcagttacctcctggcagggggctgccagaaacgctccttctcga

SEQ ID NO: 77695 - DNA, 201 bp, Homo sapiens
aaggtcctggctccagccacattctatgccatctgccagcaggacagttgccaccaggagcaagtgtgtgaggtgatcgcctcttatgcccacctctgtcrgaccaacggggtctgcgttgactggaggacacctgatttctgtggtgagtctccaagttacctctgaaaatcctggagaccagctaactgggcttgctca

SEQ ID NO: 77696 - DNA, 201 bp, Homo sapiens
tatgtgactccaaagatctggctctttccactatatgaaatggcccttttgctgcatcttttttgggctgatttgcttgggagtcactgagtcatcaaatttttttttttttttttttttttttagctctttgggagttattgagtgtattttgaaagcatatttaccagactcctccgtcttggcctaaaatggctgtca

SEQ ID NO: 77697 - DNA, 201 bp, Homo sapiens; identical to SEQ ID NO: 30229

SEQ ID NO: 77698 - DNA, 201 bp, Homo sapiens; identical to SEQ ID NO: 30230

SEQ ID NO: 77699 - DNA, 201 bp, Homo sapiens; identical to SEQ ID NO: 30236

SEQ ID NO: 77700 - DNA, 201 bp, Homo sapiens; identical to SEQ ID NO: 30241

SEQ ID NO: 77701 - DNA, 201 bp, Homo sapiens; identical to SEQ ID NO: 30244

SEQ ID NO: 77702 - DNA, 201 bp, Homo sapiens; identical to SEQ ID NO: 30247

SEQ ID NO: 77703 - DNA, 201 bp, Homo sapiens; identical to SEQ ID NO: 30092

SEQ ID NO: 77704 - DNA, 201 bp, Homo sapiens
ctaccatgagctctaaatccatttgcatacccttgtgtttgcagaaccaccaatgacctgtgctttttccctccaacagcatttgccgaaacagccagtgkatctgcagcaatgaagaatgtccaggtaggcgacctgccgctcattctcttcctccttccctgaatcggggaggcgtctcctcctctcttaccagacagg

SEQ ID NO: 77705 - DNA, 201 bp, Homo sapiens; identical to SEQ ID NO: 30154

SEQ ID NO: 77706 - DNA, 201 bp, Homo sapiens; identical to SEQ ID NO: 30276

SEQ ID NO: 77707 - DNA, 201 bp, Homo sapiens
ttccaaatcatcagcaagatcgaccgccctgaagccttccgcatcgccctgctcctgatggccagccaggagccccaacggatgtcccggaactttgtccrctacgtccagggcctgaagaagaagaaggtcatcgtgatcccggttggcattgggccccatgccaacctcaagcagatccgcctcattgagaagcaggcc

SEQ ID NO: 77708 - DNA, 201 bp, Homo sapiens; identical to SEQ ID NO: 30295

SEQ ID NO: 77709 - DNA, 201 bp, Homo sapiens; identical to SEQ ID NO: 30117

SEQ ID NO: 77710 - DNA, 201 bp, Homo sapiens; identical to SEQ ID NO: 30172

SEQ ID NO: 77711 - DNA, 201 bp, Homo sapiens
ttcaggcccagtgtgccctgctggtatggagtataggcagtgtgtgtccccttgcgccaggacctgccagagcctgcacatcaatgaaatgtgtcaggagygatgcgtggatggctgcagctgccctggtaatgaacttcccactttatttacagatcagagaccttgccagcacccttggctttgggaagtgagatgaag

SEQ ID NO: 77712 - DNA, 201 bp, Homo sapiens; identical to SEQ ID NO: 30174

SEQ ID NO: 77713 - DNA, 201 bp, Homo sapiens; identical to SEQ ID NO: 30123

SEQ ID NO: 77714 - DNA, 201 bp, Homo sapiens; identical to SEQ ID NO: 30173

SEQ ID NO: 77715 - DNA, 201 bp, Homo sapiens; identical to SEQ ID NO: 30177

SEQ ID NO: 77716 - DNA, 201 bp, Homo sapiens; identical to SEQ ID NO: 30175

SEQ ID NO: 77717 - DNA, 201 bp, Homo sapiens; identical to SEQ ID NO: 30124

SEQ ID NO: 77718 - DNA, 201 bp, Homo sapiens; identical to SEQ ID NO: 30178

SEQ ID NO: 77719 - DNA, 201 bp, Homo sapiens; identical to SEQ ID NO: 30125

SEQ ID NO: 77720 - DNA, 201 bp, Homo sapiens; identical to SEQ ID NO: 30179

SEQ ID NO: 77721 - DNA, 201 bp, Homo sapiens
aggctcaagtctcagacaacacttcctggagcgggctggaggagggctttagatcagtcactgtggccctgaggacttttggattcttttctcttaggtcyggcatgagaacagatgtgtggccctggaaaggtgtccctgcttccatcagggcaaggagtatgcccctggagaaacagtgaagattggctgcaacacttg

SEQ ID NO: 77722 - DNA, 201 bp, Homo sapiens; identical to SEQ ID NO: 30337

SEQ ID NO: 77723 - DNA, 201 bp, Homo sapiens; identical to SEQ ID NO: 30340

SEQ ID NO: 77724 - DNA, 201 bp, Homo sapiens; identical to SEQ ID NO: 30343

SEQ ID NO: 77725 - DNA, 201 bp, Homo sapiens; identical to SEQ ID NO: 30350

SEQ ID NO: 77726 - DNA, 201 bp, Homo sapiens; identical to SEQ ID NO: 30351

SEQ ID NO: 77727 - DNA, 201 bp, Homo sapiens; identical to SEQ ID NO: 30353

SEQ ID NO: 77728 - DNA, 201 bp, Homo sapiens; identical to SEQ ID NO: 30661

SEQ ID NO: 77729 - DNA, 201 bp, Homo sapiens
gaagtatgcgggcagccaggtggcctccaccagcgaggccttgaaatacacactgttccaaatcatcagcaagatcgaccgccctgaagccttccgcatcrccctgctcctgatggccagccaggagccccaacggatgtcccggaactttgtccgctacgtccagggcctgaagaagaagaaggtcatcgtgatcccggt

SEQ ID NO: 77730 - DNA, 201 bp, Homo sapiens; identical to SEQ ID NO: 30208

SEQ ID NO: 77731 - DNA, 201 bp, Homo sapiens; identical to SEQ ID NO: 30209

SEQ ID NO: 77732 - DNA, 201 bp, Homo sapiens; identical to SEQ ID NO: 30516

SEQ ID NO: 77733 - DNA, 201 bp, Homo sapiens; identical to SEQ ID NO: 30210

SEQ ID NO: 77734 - DNA, 201 bp, Homo sapiens; identical to SEQ ID NO: 30212

SEQ ID NO: 77735 - DNA, 201 bp, Homo sapiens; identical to SEQ ID NO: 30381

SEQ ID NO: 77736 - DNA, 201 bp, Homo sapiens; identical to SEQ ID NO: 30392

SEQ ID NO: 77737 - DNA, 201 bp, Homo sapiens; identical to SEQ ID NO: 30263

SEQ ID NO: 77738 - DNA, 201 bp, Homo sapiens; identical to SEQ ID NO: 30264

SEQ ID NO: 77739 - DNA, 201 bp, Homo sapiens; identical to SEQ ID NO: 30267

SEQ ID NO: 77740 - DNA, 201 bp, Homo sapiens; identical to SEQ ID NO: 30269

SEQ ID NO: 77741 - DNA, 201 bp, Homo sapiens; identical to SEQ ID NO: 30366

SEQ ID NO: 77742 - DNA, 201 bp, Homo sapiens; identical to SEQ ID NO: 30275

SEQ ID NO: 77743 - DNA, 201 bp, Homo sapiens; identical to SEQ ID NO: 30304

SEQ ID NO: 77744 - DNA, 201 bp, Homo sapiens; identical to SEQ ID NO: 30303

SEQ ID NO: 77745 - DNA, 201 bp, Homo sapiens; identical to SEQ ID NO: 30308

SEQ ID NO: 77746 - DNA, 201 bp, Homo sapiens; identical to SEQ ID NO: 30307

SEQ ID NO: 77747 - DNA, 201 bp, Homo sapiens; identical to SEQ ID NO: 30312

SEQ ID NO: 77748 - DNA, 201 bp, Homo sapiens; identical to SEQ ID NO: 30311

SEQ ID NO: 77749 - DNA, 201 bp, Homo sapiens; identical to SEQ ID NO: 30021

SEQ ID NO: 77750 - DNA, 201 bp, Homo sapiens; identical to SEQ ID NO: 30316

SEQ ID NO: 77751 - DNA, 201 bp, Homo sapiens; identical to SEQ ID NO: 30432

SEQ ID NO: 77752 - DNA, 201 bp, Homo sapiens; identical to SEQ ID NO: 30380

SEQ ID NO: 77753 - DNA, 201 bp, Homo sapiens; identical to SEQ ID NO: 30319

SEQ ID NO: 77754 - DNA, 201 bp, Homo sapiens; identical to SEQ ID NO: 30322

SEQ ID NO: 77755 - DNA, 201 bp, Homo sapiens; identical to SEQ ID NO: 30326

SEQ ID NO: 77756 - DNA, 201 bp, Homo sapiens; identical to SEQ ID NO: 30438

SEQ ID NO: 77757 - DNA, 201 bp, Homo sapiens; identical to SEQ ID NO: 30330

SEQ ID NO: 77758 - DNA, 201 bp, Homo sapiens; identical to SEQ ID NO: 30334

SEQ ID NO: 77759 - DNA, 201 bp, Homo sapiens; identical to SEQ ID NO: 30386

SEQ ID NO: 77760 - DNA, 201 bp, Homo sapiens; identical to SEQ ID NO: 30355

SEQ ID NO: 77761 - DNA, 201 bp, Homo sapiens; identical to SEQ ID NO: 30384

SEQ ID NO: 77762 - DNA, 201 bp, Homo sapiens; identical to SEQ ID NO: 30356

SEQ ID NO: 77763 - DNA, 201 bp, Homo sapiens; identical to SEQ ID NO: 30357

SEQ ID NO: 77764 - DNA, 201 bp, Homo sapiens; identical to SEQ ID NO: 30358

SEQ ID NO: 77765 - DNA, 201 bp, Homo sapiens; identical to SEQ ID NO: 30361

SEQ ID NO: 77766 - DNA, 201 bp, Homo sapiens; identical to SEQ ID NO: 30363

SEQ ID NO: 77767 - DNA, 201 bp, Homo sapiens
gtgcctggcctgctttgtatatcttgagcctttgttattagtgtttagaaatactgaatctttcggctgggtgcggtggctcaagcctgtcatcccagcaytttgggaggccgaagtgggcggatcatgaggtcaggagatggagactatcctggctaccacggtgaaaccccgtctctactaaaaatacaaaaaatgagc

SEQ ID NO: 77768 - DNA, 201 bp, Homo sapiens; identical to SEQ ID NO: 30365

SEQ ID NO: 77769 - DNA, 201 bp, Homo sapiens; identical to SEQ ID NO: 30369

SEQ ID NO: 77770 - DNA, 201 bp, Homo sapiens; identical to SEQ ID NO: 30505

SEQ ID NO: 77771 - DNA, 201 bp, Homo sapiens
gcactttgggaggccgaagtgggcggatcatgaggtcaggagatggagactatcctggctaccacggtgaaaccccgtctctactaaaaatacaaaaaatkagccaggtgtggtggcaggtgcctgtagtcccagctactcgggaagctgaggcaggagaatggcatgaaccttggaggcggagcttgcagtgagctgaaa

SEQ ID NO: 77772 - DNA, 201 bp, Homo sapiens
gagctgaattgaggaatttcaggatggagattttttctcctttagtatcaagaatccaaagaaagattttcactgggaaaggaagcagttgtggtcttgargaagcagatatgatccagagcacgtcatttaaccatctaaagcctcggtttctcatgtgtaaatgagcatgcacattctctgggctcagccctgtgatat

SEQ ID NO: 77773 - DNA, 201 bp, Homo sapiens; identical to SEQ ID NO: 30507

SEQ ID NO: 77774 - DNA, 201 bp, Homo sapiens; identical to SEQ ID NO: 30511

SEQ ID NO: 77775 - DNA, 201 bp, Homo sapiens
tgaggtcaggagatggagactatcctggctaccacggtgaaaccccgtctctactaaaaatacaaaaaatgagccaggtgtggtggcaggtgcctgtagtyccagctactcgggaagctgaggcaggagaatggcatgaaccttggaggcggagcttgcagtgagctgaaatcgcaccactgcactccagcctgggcgaca

SEQ ID NO: 77776 - DNA, 201 bp, Homo sapiens; identical to SEQ ID NO: 30394

SEQ ID NO: 77777 - DNA, 201 bp, Homo sapiens; identical to SEQ ID NO: 30395

SEQ ID NO: 77778 - DNA, 201 bp, Homo sapiens; identical to SEQ ID NO: 30396

SEQ ID NO: 77779 - DNA, 201 bp, Homo sapiens
ctttccattgggttttaatcttattctttattttaaatattggaactattagctcattatccgtgatataggttgcagtactatttattgacatgtcaatrtttgccccagtgatgtgagataacttaataataatcataaatcaaattttcatgtgtgcatgggcttatttctgaatttttttctgattccacttgttgt

SEQ ID NO: 77780 - DNA, 201 bp, Homo sapiens; identical to SEQ ID NO: 30484

SEQ ID NO: 77781 - DNA, 201 bp, Homo sapiens; identical to SEQ ID NO: 30399

SEQ ID NO: 77782 - DNA, 201 bp, Homo sapiens; identical to SEQ ID NO: 30401

SEQ ID NO: 77783 - DNA, 201 bp, Homo sapiens; identical to SEQ ID NO: 30404

SEQ ID NO: 77784 - DNA, 201 bp, Homo sapiens
tcctggctaccacggtgaaaccccgtctctactaaaaatacaaaaaatgagccaggtgtggtggcaggtgcctgtagtcccagctactcgggaagctgagrcaggagaatggcatgaaccttggaggcggagcttgcagtgagctgaaatcgcaccactgcactccagcctgggcgacagagtgagactccgtctcaaaaa

SEQ ID NO: 77785 - DNA, 201 bp, Homo sapiens
ttctttttaaatagcgattttcttttgtcatttgttaatttatatacatgtctattatcttttttcttgatcaaattaactcatgatttgtctttctggaytttttttaaaaatcaagatttcaatttatttattatgtttactgtttttatattctctactttattgatttctgcttttatccttgctattttatgactt

SEQ ID NO: 77786 - DNA, 201 bp, Homo sapiens; identical to SEQ ID NO: 30407

SEQ ID NO: 77787 - DNA, 201 bp, Homo sapiens; identical to SEQ ID NO: 30486

SEQ ID NO: 77788 - DNA, 201 bp, Homo sapiens
tctttttaaatagcgattttcttttgtcatttgttaatttatatacatgtctattatcttttttcttgatcaaattaactcatgatttgtctttctggatyttttttaaaaatcaagatttcaatttatttattatgtttactgtttttatattctctactttattgatttctgcttttatccttgctattttatgacttc

SEQ ID NO: 77789 - DNA, 201 bp, Homo sapiens
tctcttaccaggaaggaatgctggtcagtacacacacacacacacacacacacacacacacacacacacactctctctctctctctctcactcactcactmactaactagctgggcatggtggcatgcacgcacgcacacacactagctgggcatggtggcacacgcgcgtgcacacacacacacacacacaaacacatac

SEQ ID NO: 77790 - DNA, 201 bp, Homo sapiens
acacacactctctctctctctctctcactcactcactcactaactagctgggcatggtggcatgcacgcacgcacacacactagctgggcatggtggcacrcgcgcgtgcacacacacacacacacacaaacacatactagctgggcatggtggtgcaccagtaatcccagctaatgggagggctgaggtgggaagatggc

SEQ ID NO: 77791 - DNA, 201 bp, Homo sapiens; identical to SEQ ID NO: 30489

SEQ ID NO: 77792 - DNA, 201 bp, Homo sapiens; identical to SEQ ID NO: 30491

SEQ ID NO: 77793 - DNA, 201 bp, Homo sapiens; identical to SEQ ID NO: 30493

SEQ ID NO: 77794 - DNA, 201 bp, Homo sapiens; identical to SEQ ID NO: 30494

SEQ ID NO: 77795 - DNA, 201 bp, Homo sapiens; identical to SEQ ID NO: 30434

SEQ ID NO: 77796 - DNA, 201 bp, Homo sapiens; identical to SEQ ID NO: 30435

SEQ ID NO: 77797 - DNA, 201 bp, Homo sapiens; identical to SEQ ID NO: 30437

SEQ ID NO: 77798 - DNA, 201 bp, Homo sapiens; identical to SEQ ID NO: 30359

SEQ ID NO: 77799 - DNA, 201 bp, Homo sapiens; identical to SEQ ID NO: 30503

SEQ ID NO: 77800 - DNA, 201 bp, Homo sapiens
agtgacagtgttccctattggaattggagatcgctacgatgcagcccagctacggatcttggcaggcccagcaggcgactccaacgtggtgaagctccagygaatcgaagacctccctaccatggtcaccttgggcaattccttcctccacaaactgtgctctggtgagtcttataatacctttcttacttccctcaaaaa

SEQ ID NO: 77801 - DNA, 201 bp, Homo sapiens; identical to SEQ ID NO: 30526

SEQ ID NO: 77802 - DNA, 201 bp, Homo sapiens
cccccccacatggcacaagtcactgtgggcccggggctcttggggctttcgaccctggggcccaagaggaactccatggttctggatgtggcatttgtccyggaaggatcggacaaaattggtgaagccgacttcaacaggagcaaggagttcatggaggaggtgattcagcggatggatgtgggccaggacagcatccac

SEQ ID NO: 77803 - DNA, 201 bp, Homo sapiens; identical to SEQ ID NO: 30527

SEQ ID NO: 77804 - DNA, 201 bp, Homo sapiens
tgtgtatctatcatctatcctctatctatcatccatctatctatctatctatctaatgtacctagttatctatcctgtatgtatgtatgtatgtatgtatstatctatcaaatctatctcatgtatctagttatcattctatctatctatctatctatctatctatctatctatctatctatctatcctaacccatgtaat

SEQ ID NO: 77805 - DNA, 201 bp, Homo sapiens; identical to SEQ ID NO: 30528

SEQ ID NO: 77806 - DNA, 201 bp, Homo sapiens
gatcaagggtgccatgtgcatcacacccagaggcacataatgtccagctgtcctcctccctccctccctccctccctccctacgtcacttccttccttccytccctccttccctccctccctccctccctcactccctccctcactcctttcttccttccttccttccttccttccttcctttctttcttttctttctttc

SEQ ID NO: 77807 - DNA, 201 bp, Homo sapiens
tgcatcacacccagaggcacataatgtccagctgtcctcctccctccctccctccctccctccctacgtcacttccttccttccctccctccttccctccytccctccctccctcactccctccctcactcctttcttccttccttccttccttccttccttcctttctttcttttctttctttctttcttttcattcgtt

SEQ ID NO: 77808 - DNA, 201 bp, Homo sapiens; identical to SEQ ID NO: 30553

SEQ ID NO: 77809 - DNA, 201 bp, Homo sapiens; identical to SEQ ID NO: 30554

SEQ ID NO: 77810 - DNA, 201 bp, Homo sapiens
cgtgctgagcggtgtggatgagctggagcagcaaagggaagagatcgttagctacctctgtgaccttgcccctgaagcccctcctcctactctgccccccsacatggcacaagtcactgtgggcccggggctcttggggctttcgaccctggggcccaagaggaactccatggttctggatgtggcatttgtcctggaagg

SEQ ID NO: 77811 - DNA, 201 bp, Homo sapiens
aattattataatatatcttgtagtggacttctttaaattaattctagttggagtcttttggacttcttgaagctggatgtctattttcttccctaaatttrttcattatttctactttccattgggttttaatcttattctttattttaaatattggaactattagctcattatccgtgatataggttgcagtactattta

SEQ ID NO: 77812 - DNA, 201 bp, Homo sapiens; identical to SEQ ID NO: 30487

SEQ ID NO: 77813 - DNA, 201 bp, Homo sapiens
gggctcttggggctttcgaccctggggcccaagaggaactccatggttctggatgtggcatttgtcctggaaggatcggacaaaattggtgaagccgactkcaacaggagcaaggagttcatggaggaggtgattcagcggatggatgtgggccaggacagcatccacgtcacggtgctgcagtactcctacatggtgacc

SEQ ID NO: 77814 - DNA, 201 bp, Homo sapiens
taaaaaatgatgagttcttgtcctttgtagggacatggatgaaactggaaatcatcattctcagtaaactatcgcaaggacaaaaaaccaaacaccgcatrttctcactcatagatgggaattgaacaatgagaacacatggacacaggaaggggaacatcacactctggggactggtgtggggtggggggagtggggagg

SEQ ID NO: 77815 - DNA, 201 bp, Homo sapiens
ggggggagtggggagggatagcattaggagatatacgtaatgctaaatgacgagttaatgggtgcagcacaccagcatggcacatgtatacatacgtaacwaacctgcacattgtgcacatgtaccctaaaacttaaagtataataaaaaaaaagttcctgcctgctaattgcaatactggggccatttctgtgtctgttt

SEQ ID NO: 77816 - DNA, 201 bp, Homo sapiens
ttggtgaagccgacttcaacaggagcaaggagttcatggaggaggtgattcagcggatggatgtgggccaggacagcatccacgtcacggtgctgcagtastcctacatggtgaccgtggagtaccccttcagcgaggcacagtccaaaggggacatcctgcagcgggtgcgagagatccgctaccagggcggcaacagga

SEQ ID NO: 77817 - DNA, 201 bp, Homo sapiens; identical to SEQ ID NO: 30580

SEQ ID NO: 77818 - DNA, 201 bp, Homo sapiens; identical to SEQ ID NO: 30582

SEQ ID NO: 77819 - DNA, 201 bp, Homo sapiens; identical to SEQ ID NO: 30586

SEQ ID NO: 77820 - DNA, 201 bp, Homo sapiens; identical to SEQ ID NO: 30587

SEQ ID NO: 77821 - DNA, 201 bp, Homo sapiens; identical to SEQ ID NO: 30588

SEQ ID NO: 77822 - DNA, 201 bp, Homo sapiens; identical to SEQ ID NO: 30589

SEQ ID NO: 77823 - DNA, 201 bp, Homo sapiens; identical to SEQ ID NO: 30590

SEQ ID NO: 77824 - DNA, 201 bp, Homo sapiens
ttatgactttgccaactcatgggctctgagcagtggagaacagtggtgtgaacgggcatctcctcccagcagctcatgcaacatctcctctggggaaatgyagaaggtgggtgtggactggcctgggtgcacctggatggtgtgtgatttctggatctaaaagacagaaggactcagtctcatatccttccatctggggga

SEQ ID NO: 77825 - DNA, 201 bp, Homo sapiens; identical to SEQ ID NO: 30460

SEQ ID NO: 77826 - DNA, 201 bp, Homo sapiens
tgccttggtttccctagcagggctaagtctcagtgccacactcagggagacactaacggagcataccgctgaggcggcccctcttcctgcagggcctgtgrgagcagtgccagcttctgaagagcacctcggtgtttgcccgctgccaccctctggtggaccccgagccttttgtggccctgtgtgagaagactttgtgtg

SEQ ID NO: 77827 - DNA, 201 bp, Homo sapiens; identical to SEQ ID NO: 30591

SEQ ID NO: 77828 - DNA, 201 bp, Homo sapiens
tagtcccagctactcgggagactgaggcaggagaatgacgtgaacccaggaggcggagcttagcactccagcctgggcgacagagtgagactctgtctcaaaaaaaaaaaaaaaaaaaaaaaattagctgggcatggtggcatgtgcctataatcccagctactcaggaggctgaggcaggagaattgcttgaacctggga

SEQ ID NO: 77829 - DNA, 201 bp, Homo sapiens; identical to SEQ ID NO: 30592

SEQ ID NO: 77830 - DNA, 201 bp, Homo sapiens; identical to SEQ ID NO: 30454

SEQ ID NO: 77831 - DNA, 201 bp, Homo sapiens; identical to SEQ ID NO: 30457

SEQ ID NO: 77832 - DNA, 201 bp, Homo sapiens; identical to SEQ ID NO: 30378

SEQ ID NO: 77833 - DNA, 201 bp, Homo sapiens; identical to SEQ ID NO: 30597

SEQ ID NO: 77834 - DNA, 201 bp, Homo sapiens; identical to SEQ ID NO: 30510

SEQ ID NO: 77835 - DNA, 201 bp, Homo sapiens
atgtctttaattaggcgtgattatatttgccaatatgagtgatcaactcatacattcatgtctatagaatcttgcttctttggacagaagcaacttaatgyttttatgtagaaaactgggccgggcacagtgactcatacctgtaatccctgtgttttgggaggctgaggccagaggattccttgagcccaggagttcaag

SEQ ID NO: 77836 - DNA, 201 bp, Homo sapiens; identical to SEQ ID NO: 30513

SEQ ID NO: 77837 - DNA, 201 bp, Homo sapiens; identical to SEQ ID NO: 30517

SEQ ID NO: 77838 - DNA, 201 bp, Homo sapiens; identical to SEQ ID NO: 30520

SEQ ID NO: 77839 - DNA, 201 bp, Homo sapiens; identical to SEQ ID NO: 30522

SEQ ID NO: 77840 - DNA, 201 bp, Homo sapiens; identical to SEQ ID NO: 30523

SEQ ID NO: 77841 - DNA, 201 bp, Homo sapiens; identical to SEQ ID NO: 30524

SEQ ID NO: 77842 - DNA, 201 bp, Homo sapiens; identical to SEQ ID NO: 30624

SEQ ID NO: 77843 - DNA, 201 bp, Homo sapiens; identical to SEQ ID NO: 30625

SEQ ID NO: 77844 - DNA, 201 bp, Homo sapiens; identical to SEQ ID NO: 30626

SEQ ID NO: 77845 - DNA, 201 bp, Homo sapiens; identical to SEQ ID NO: 30627

SEQ ID NO: 77846 - DNA, 201 bp, Homo sapiens; identical to SEQ ID NO: 30631

SEQ ID NO: 77847 - DNA, 201 bp, Homo sapiens
ccaggtggtgcccattggagtgggccctaatgccaacgtgcaggagctggagaggattggctggcccaatgcccctatcctcatccaggactttgagacgmtcccccgagaggctcctgacctggtgctgcagaggtgctgctccggagaggggctgcagatccccaccctctcccctgcacctggtatgctggcaccttg

SEQ ID NO: 77848 - DNA, 201 bp, Homo sapiens; identical to SEQ ID NO: 5803

SEQ ID NO: 77849 - DNA, 201 bp, Homo sapiens; identical to SEQ ID NO: 30530

SEQ ID NO: 77850 - DNA, 201 bp, Homo sapiens; identical to SEQ ID NO: 30532

SEQ ID NO: 77851 - DNA, 201 bp, Homo sapiens
ggggactgtgataactaccatgagctctaaatccatttgcatacccttgtgtttgcagaaccaccaatgacctgtgctttttccctccaacagcatttgcygaaacagccagtggatctgcagcaatgaagaatgtccaggtaggcgacctgccgctcattctcttcctccttccctgaatcggggaggcgtctcctcctc

SEQ ID NO: 77852 - DNA, 201 bp, Homo sapiens; identical to SEQ ID NO: 30634

SEQ ID NO: 77853 - DNA, 201 bp, Homo sapiens; identical to SEQ ID NO: 30633

SEQ ID NO: 77854 - DNA, 201 bp, Homo sapiens; identical to SEQ ID NO: 30635

SEQ ID NO: 77855 - DNA, 201 bp, Homo sapiens; identical to SEQ ID NO: 30637

SEQ ID NO: 77856 - DNA, 201 bp, Homo sapiens; identical to SEQ ID NO: 30541

SEQ ID NO: 77857 - DNA, 201 bp, Homo sapiens
tggagcggctgcgcatctcccagaagtgggtccgcgtggccgtggtggagtaccacgacggctcccacgcctacatcgggctcaaggaccggaagcgaccrtcagagctgcggcgcattgccagccaggtgaagtatgcgggcagccaggtggcctccaccagcgaggccttgaaatacacactgttccaaatcatcagca

SEQ ID NO: 77858 - DNA, 201 bp, Homo sapiens; identical to SEQ ID NO: 30525

SEQ ID NO: 77859 - DNA, 201 bp, Homo sapiens; identical to SEQ ID NO: 30543

SEQ ID NO: 77860 - DNA, 201 bp, Homo sapiens; identical to SEQ ID NO: 30423

SEQ ID NO: 77861 - DNA, 201 bp, Homo sapiens; identical to SEQ ID NO: 30420

SEQ ID NO: 77862 - DNA, 201 bp, Homo sapiens; identical to SEQ ID NO: 30547

SEQ ID NO: 77863 - DNA, 201 bp, Homo sapiens; identical to SEQ ID NO: 30548

SEQ ID NO: 77864 - DNA, 201 bp, Homo sapiens; identical to SEQ ID NO: 30549

SEQ ID NO: 77865 - DNA, 201 bp, Homo sapiens; identical to SEQ ID NO: 30550

SEQ ID NO: 77866 - DNA, 201 bp, Homo sapiens; identical to SEQ ID NO: 30551

SEQ ID NO: 77867 - DNA, 201 bp, Homo sapiens; identical to SEQ ID NO: 30552

SEQ ID NO: 77868 - DNA, 201 bp, Homo sapiens; identical to SEQ ID NO: 5818

SEQ ID NO: 77869 - DNA, 201 bp, Homo sapiens; identical to SEQ ID NO: 30681

SEQ ID NO: 77870 - DNA, 201 bp, Homo sapiens; identical to SEQ ID NO: 30683

SEQ ID NO: 77871 - DNA, 201 bp, Homo sapiens; identical to SEQ ID NO: 30687

SEQ ID NO: 77872 - DNA, 201 bp, Homo sapiens; identical to SEQ ID NO: 30688

SEQ ID NO: 77873 - DNA, 201 bp, Homo sapiens
tcctaatgagagctttcttttgcagggaaaatcctggatgagcttttgcagacctgcgttgaccctgaagactgtccagtgtgtgaggtggctggccggcrttttgcctcaggaaagaaagtcaccttgaatcccagtgaccctgagcactgccagatttggtaaaacagattcctgggttgtttgaagtgatgaatctta

SEQ ID NO: 77874 - DNA, 201 bp, Homo sapiens; identical to SEQ ID NO: 5832

SEQ ID NO: 77875 - DNA, 201 bp, Homo sapiens
aggagattctgtgggaatatggaagtcgttgtacactgtagggctcagaagtgtccacaggttcttcctgaaccattttaatttcttcgctcttttctgckgccactgtgatgttgtcaacctcacctgtgaagcctgccaggagccgggaggcctggtggtgcctcccacagatgccccggtgagccccaccactctgta

SEQ ID NO: 77876 - DNA, 201 bp, Homo sapiens
ctaggagtgctgtcagaaccctgtcttttctctgctgtcttcctgatgttcttcctgaggaagttatttgctccgttctctatgtcacatatgagctactmaaaatgtgcaaatcgtattgtattgtattgtatttgtaacatatctattccttgcaaaaaactgggagttctttgaaggcaagggaagatcttgcttatt

SEQ ID NO: 77877 - DNA, 201 bp, Homo sapiens
actgtggcagcagggttgactcttacggggatcattagggatagggaggcagtattgtgtaatggccttgcattcagatagctcttggttcaaatcctgcrtctgtcatgtattatctgtgggattaaacatcaaagtgttgttaccacattattattatgattgttattactattgtctttatgattatagtcatttaag

SEQ ID NO: 77878 - DNA, 201 bp, Homo sapiens
tcgtatgacctggaattccagttaggatcaaataagatggaagatatatatatacatatacatatatgtatatgtgtgtgtgtgtatgtatatatatatayacacacacacacacatatatatgtatatatatacacacatacactctgcatgtagaatttttatgtaaattaatgcatggtcctttccattagtatttct

SEQ ID NO: 77879 - DNA, 201 bp, Homo sapiens
aagctgctaatagaaaatccgttccaacctgaagcacattgcaaattcctagaactttctggagagctgaattgaggaatttcaggatggagattttttcycctttagtatcaagaatccaaagaaagattttcactgggaaaggaagcagttgtggtcttgaggaagcagatatgatccagagcacgtcatttaaccatc

SEQ ID NO: 77880 - DNA, 201 bp, Homo sapiens; identical to SEQ ID NO: 30572

SEQ ID NO: 77881 - DNA, 201 bp, Homo sapiens; identical to SEQ ID NO: 30575

SEQ ID NO: 77882 - DNA, 201 bp, Homo sapiens; identical to SEQ ID NO: 30577

SEQ ID NO: 77883 - DNA, 201 bp, Homo sapiens; identical to SEQ ID NO: 30265

SEQ ID NO: 77884 - DNA, 201 bp, Homo sapiens
ccagccagtcctcaagtttcatctctcacctgtcctgtaggtgaggagcctgagtgcaacgacatcactgccaggctgcagtatgtcaaggtgggaagctrtaagtctgaagtagaggtggatatccactactgccaggtaagggctctgcttcaataagggctgggtgtggagggctgagcctccgtgttcggataccta

SEQ ID NO: 77885 - DNA, 201 bp, Homo sapiens
gtcaagctcatggtttgaagtggctttgtgaaccaaacactgtctctgactttacccactcctctttccttccagcgtgatgagacgctccaggatggctrtgatactcacttctgcaaggtcaatgagagaggagagtacttctgggagaagagggtcacaggctgcccaccctttgatgaacacaagtgtctggctgag

SEQ ID NO: 77886 - DNA, 201 bp, Homo sapiens; identical to SEQ ID NO: 30705

SEQ ID NO: 77887 - DNA, 201 bp, Homo sapiens; identical to SEQ ID NO: 30581

SEQ ID NO: 77888 - DNA, 201 bp, Homo sapiens; identical to SEQ ID NO: 30583

SEQ ID NO: 77889 - DNA, 201 bp, Homo sapiens; identical to SEQ ID NO: 30585

SEQ ID NO: 77890 - DNA, 201 bp, Homo sapiens; identical to SEQ ID NO: 30593

SEQ ID NO: 77891 - DNA, 201 bp, Homo sapiens
cctggtcttcctgctggatggctcctccaggctgtccgaggctgagtttgaagtgctgaaggcctttgtggtggacatgatggagcggctgcgcatctccyagaagtgggtccgcgtggccgtggtggagtaccacgacggctcccacgcctacatcgggctcaaggaccggaagcgaccgtcagagctgcggcgcattgc

SEQ ID NO: 77892 - DNA, 201 bp, Homo sapiens
tggaagtcgttgtacactgtagggctcagaagtgtccacaggttcttcctgaaccattttaatttcttcgctcttttctgcagccactgtgatgttgtcamcctcacctgtgaagcctgccaggagccgggaggcctggtggtgcctcccacagatgccccggtgagccccaccactctgtatgtggaggacatctcggaa

SEQ ID NO: 77893 - DNA, 201 bp, Homo sapiens
ggaatatggaagtcgttgtacactgtagggctcagaagtgtccacaggttcttcctgaaccattttaatttcttcgctcttttctgcagccactgtgatgktgtcaacctcacctgtgaagcctgccaggagccgggaggcctggtggtgcctcccacagatgccccggtgagccccaccactctgtatgtggaggacatc

SEQ ID NO: 77894 - DNA, 201 bp, Homo sapiens; identical to SEQ ID NO: 30604

SEQ ID NO: 77895 - DNA, 201 bp, Homo sapiens; identical to SEQ ID NO: 30049

SEQ ID NO: 77896 - DNA, 201 bp, Homo sapiens; identical to SEQ ID NO: 30388

SEQ ID NO: 77897 - DNA, 201 bp, Homo sapiens; identical to SEQ ID NO: 30609

SEQ ID NO: 77898 - DNA, 201 bp, Homo sapiens; identical to SEQ ID NO: 30612

SEQ ID NO: 77899 - DNA, 201 bp, Homo sapiens
ttgcctccatggcccagatgggcccctcaaacccaaggtgcccaacttgtcatctctgccatgactgctcctagtgtctgtcgggaccggaagtggaactkcacagaccatgtgtgtgatgccacgtgctccacgatcggcatggcccactacctcaccttcgacgggctcaaatacctgttccccggggagtgccagtac

SEQ ID NO: 77900 - DNA, 201 bp, Homo sapiens; identical to SEQ ID NO: 30615

SEQ ID NO: 77901 - DNA, 201 bp, Homo sapiens; identical to SEQ ID NO: 30046

SEQ ID NO: 77902 - DNA, 201 bp, Homo sapiens; identical to SEQ ID NO: 30617

SEQ ID NO: 77903 - DNA, 201 bp, Homo sapiens; identical to SEQ ID NO: 30048

SEQ ID NO: 77904 - DNA, 201 bp, Homo sapiens; identical to SEQ ID NO: 30333

SEQ ID NO: 77905 - DNA, 201 bp, Homo sapiens
caagtctcagacaacacttcctggagcgggctggaggagggctttagatcagtcactgtggccctgaggacttttggattcttttctcttaggtccggcawgagaacagatgtgtggccctggaaaggtgtccctgcttccatcagggcaaggagtatgcccctggagaaacagtgaagattggctgcaacacttggtgag

SEQ ID NO: 77906 - DNA, 201 bp, Homo sapiens; identical to SEQ ID NO: 30619

SEQ ID NO: 77907 - DNA, 201 bp, Homo sapiens; identical to SEQ ID NO: 30621

SEQ ID NO: 77908 - DNA, 201 bp, Homo sapiens; identical to SEQ ID NO: 30622

SEQ ID NO: 77909 - DNA, 201 bp, Homo sapiens; identical to SEQ ID NO: 30623

SEQ ID NO: 77910 - DNA, 201 bp, Homo sapiens; identical to SEQ ID NO: 30482

SEQ ID NO: 77911 - DNA, 201 bp, Homo sapiens; identical to SEQ ID NO: 30740

SEQ ID NO: 77912 - DNA, 201 bp, Homo sapiens; identical to SEQ ID NO: 30748

SEQ ID NO: 77913 - DNA, 201 bp, Homo sapiens; identical to SEQ ID NO: 30751

SEQ ID NO: 77914 - DNA, 201 bp, Homo sapiens; identical to SEQ ID NO: 30755

SEQ ID NO: 77915 - DNA, 201 bp, Homo sapiens; identical to SEQ ID NO: 30759

SEQ ID NO: 77916 - DNA, 201 bp, Homo sapiens; identical to SEQ ID NO: 30628

SEQ ID NO: 77917 - DNA, 201 bp, Homo sapiens; identical to SEQ ID NO: 30630

SEQ ID NO: 77918 - DNA, 201 bp, Homo sapiens; identical to SEQ ID NO: 30776

SEQ ID NO: 77919 - DNA, 201 bp, Homo sapiens
gagcggctgcgcatctcccagaagtgggtccgcgtggccgtggtggagtaccacgacggctcccacgcctacatcgggctcaaggaccggaagcgaccgtsagagctgcggcgcattgccagccaggtgaagtatgcgggcagccaggtggcctccaccagcgaggccttgaaatacacactgttccaaatcatcagcaag

SEQ ID NO: 77920 - DNA, 201 bp, Homo sapiens; identical to SEQ ID NO: 30642

SEQ ID NO: 77921 - DNA, 201 bp, Homo sapiens
gtgggtccgcgtggccgtggtggagtaccacgacggctcccacgcctacatcgggctcaaggaccggaagcgaccgtcagagctgcggcgcattgccagcyaggtgaagtatgcgggcagccaggtggcctccaccagcgaggccttgaaatacacactgttccaaatcatcagcaagatcgaccgccctgaagccttccg

SEQ ID NO: 77922 - DNA, 201 bp, Homo sapiens; identical to SEQ ID NO: 30648

SEQ ID NO: 77923 - DNA, 201 bp, Homo sapiens; identical to SEQ ID NO: 30645

SEQ ID NO: 77924 - DNA, 201 bp, Homo sapiens; identical to SEQ ID NO: 30651

SEQ ID NO: 77925 - DNA, 201 bp, Homo sapiens; identical to SEQ ID NO: 30652

SEQ ID NO: 77926 - DNA, 201 bp, Homo sapiens; identical to SEQ ID NO: 30655

SEQ ID NO: 77927 - DNA, 201 bp, Homo sapiens; identical to SEQ ID NO: 30656

SEQ ID NO: 77928 - DNA, 201 bp, Homo sapiens; identical to SEQ ID NO: 30449

SEQ ID NO: 77929 - DNA, 201 bp, Homo sapiens; identical to SEQ ID NO: 30659

SEQ ID NO: 77930 - DNA, 201 bp, Homo sapiens; identical to SEQ ID NO: 30662

SEQ ID NO: 77931 - DNA, 201 bp, Homo sapiens; identical to SEQ ID NO: 30663

SEQ ID NO: 77932 - DNA, 201 bp, Homo sapiens; identical to SEQ ID NO: 30665

SEQ ID NO: 77933 - DNA, 201 bp, Homo sapiens; identical to SEQ ID NO: 30666

SEQ ID NO: 77934 - DNA, 201 bp, Homo sapiens; identical to SEQ ID NO: 30443

SEQ ID NO: 77935 - DNA, 201 bp, Homo sapiens; identical to SEQ ID NO: 30667

SEQ ID NO: 77936 - DNA, 201 bp, Homo sapiens; identical to SEQ ID NO: 30441

SEQ ID NO: 77937 - DNA, 201 bp, Homo sapiens; identical to SEQ ID NO: 30670

SEQ ID NO: 77938 - DNA, 201 bp, Homo sapiens; identical to SEQ ID NO: 30672

SEQ ID NO: 77939 - DNA, 201 bp, Homo sapiens; identical to SEQ ID NO: 30785

SEQ ID NO: 77940 - DNA, 201 bp, Homo sapiens; identical to SEQ ID NO: 30673

SEQ ID NO: 77941 - DNA, 201 bp, Homo sapiens
gaccttgccagaccagtgccacaccgtgacttgccagccagatggccagaccttgctgaagagtcatcgggtcaactgtgaccgggggctgaggccttcgygccctaacagccagtcccctgttaaagtggaagagacctgtggctgccgctggacctgcccctgtgagtcctttgcttctccagccagggcagcgtcaaa

SEQ ID NO: 77942 - DNA, 201 bp, Homo sapiens; identical to SEQ ID NO: 30674

SEQ ID NO: 77943 - DNA, 201 bp, Homo sapiens
agagtgcagtggcactattttggctcactgcaaccttggcctcctgggttcaagcacttttcctgcctcagcctccaagtagctgggattacaggcgtgcrccaccacactcggctaatttttgtatttctagtagagatgtggttttgctatgttggctgggctggtcttgaactcctgacctcaagtgatctgcccacc

SEQ ID NO: 77944 - DNA, 201 bp, Homo sapiens; identical to SEQ ID NO: 30676

SEQ ID NO: 77945 - DNA, 201 bp, Homo sapiens; identical to SEQ ID NO: 30677

SEQ ID NO: 77946 - DNA, 201 bp, Homo sapiens; identical to SEQ ID NO: 30787

SEQ ID NO: 77947 - DNA, 201 bp, Homo sapiens; identical to SEQ ID NO: 30678

SEQ ID NO: 77948 - DNA, 201 bp, Homo sapiens; identical to SEQ ID NO: 30789

SEQ ID NO: 77949 - DNA, 201 bp, Homo sapiens; identical to SEQ ID NO: 30790

SEQ ID NO: 77950 - DNA, 201 bp, Homo sapiens; identical to SEQ ID NO: 30679

SEQ ID NO: 77951 - DNA, 201 bp, Homo sapiens; identical to SEQ ID NO: 30792

SEQ ID NO: 77952 - DNA, 201 bp, Homo sapiens
accattccgtggttggtggtctcttaccaggaaggaatgctggtcagtacacacacacacacacacacacacacacacacacacacacactctctctctcwctctctcactcactcactcactaactagctgggcatggtggcatgcacgcacgcacacacactagctgggcatggtggcacacgcgcgtgcacacacaca

SEQ ID NO: 77953 - DNA, 201 bp, Homo sapiens; identical to SEQ ID NO: 30680

SEQ ID NO: 77954 - DNA, 201 bp, Homo sapiens
cattccgtggttggtggtctcttaccaggaaggaatgctggtcagtacacacacacacacacacacacacacacacacacacacacactctctctctctcwctctcactcactcactcactaactagctgggcatggtggcatgcacgcacgcacacacactagctgggcatggtggcacacgcgcgtgcacacacacaca

SEQ ID NO: 77955 - DNA, 201 bp, Homo sapiens; identical to SEQ ID NO: 30682

SEQ ID NO: 77956 - DNA, 201 bp, Homo sapiens; identical to SEQ ID NO: 30685

SEQ ID NO: 77957 - DNA, 201 bp, Homo sapiens; identical to SEQ ID NO: 30462

SEQ ID NO: 77958 - DNA, 201 bp, Homo sapiens; identical to SEQ ID NO: 30686

SEQ ID NO: 77959 - DNA, 201 bp, Homo sapiens; identical to SEQ ID NO: 30803

SEQ ID NO: 77960 - DNA, 201 bp, Homo sapiens
ctatatgaaatggcccttttgctgcatcttttttgggctgatttgcttgggagtcactgagtcatcaaatttttttttttttttttttttttttagctctwtgggagttattgagtgtattttgaaagcatatttaccagactcctccgtcttggcctaaaatggctgtcatctctcttcaaagttgaccccgtgtatatt

SEQ ID NO: 77961 - DNA, 201 bp, Homo sapiens
gcgaccgtcagagctgcggcgcattgccagccaggtgaagtatgcgggcagccaggtggcctccaccagcgaggccttgaaatacacactgttccaaatcwtcagcaagatcgaccgccctgaagccttccgcatcgccctgctcctgatggccagccaggagccccaacggatgtcccggaactttgtccgctacgtcca

SEQ ID NO: 77962 - DNA, 201 bp, Homo sapiens; identical to SEQ ID NO: 30439

SEQ ID NO: 77963 - DNA, 201 bp, Homo sapiens; identical to SEQ ID NO: 30698

SEQ ID NO: 77964 - DNA, 201 bp, Homo sapiens; identical to SEQ ID NO: 30700

SEQ ID NO: 77965 - DNA, 201 bp, Homo sapiens
gctggagaggattggctggcccaatgcccctatcctcatccaggactttgagacgctcccccgagaggctcctgacctggtgctgcagaggtgctgctccrgagaggggctgcagatccccaccctctcccctgcacctggtatgctggcaccttgtgtgcaggtgggagggctgggcgagggctggcatggccttggtgc

SEQ ID NO: 77966 - DNA, 201 bp, Homo sapiens; identical to SEQ ID NO: 30702

SEQ ID NO: 77967 - DNA, 201 bp, Homo sapiens
cctaatgccaacgtgcaggagctggagaggattggctggcccaatgcccctatcctcatccaggactttgagacgctcccccgagaggctcctgacctggwgctgcagaggtgctgctccggagaggggctgcagatccccaccctctcccctgcacctggtatgctggcaccttgtgtgcaggtgggagggctgggcgag

SEQ ID NO: 77968 - DNA, 201 bp, Homo sapiens; identical to SEQ ID NO: 30704

SEQ ID NO: 77969 - DNA, 201 bp, Homo sapiens; identical to SEQ ID NO: 30707

SEQ ID NO: 77970 - DNA, 201 bp, Homo sapiens
ggtgcccattggagtgggccctaatgccaacgtgcaggagctggagaggattggctggcccaatgcccctatcctcatccaggactttgagacgctccccygagaggctcctgacctggtgctgcagaggtgctgctccggagaggggctgcagatccccaccctctcccctgcacctggtatgctggcaccttgtgtgca

SEQ ID NO: 77971 - DNA, 201 bp, Homo sapiens
tgagatcaagaggctgcctggagacatccaggtggtgcccattggagtgggccctaatgccaacgtgcaggagctggagaggattggctggcccaatgccyctatcctcatccaggactttgagacgctcccccgagaggctcctgacctggtgctgcagaggtgctgctccggagaggggctgcagatccccaccctctc

SEQ ID NO: 77972 - DNA, 201 bp, Homo sapiens; identical to SEQ ID NO: 30709

SEQ ID NO: 77973 - DNA, 201 bp, Homo sapiens
atggtcaccggaaatcctgcctctgatgagatcaagaggctgcctggagacatccaggtggtgcccattggagtgggccctaatgccaacgtgcaggagcyggagaggattggctggcccaatgcccctatcctcatccaggactttgagacgctcccccgagaggctcctgacctggtgctgcagaggtgctgctccgga

SEQ ID NO: 77974 - DNA, 201 bp, Homo sapiens; identical to SEQ ID NO: 30431

SEQ ID NO: 77975 - DNA, 201 bp, Homo sapiens
ctacatggtcaccggaaatcctgcctctgatgagatcaagaggctgcctggagacatccaggtggtgcccattggagtgggccctaatgccaacgtgcagragctggagaggattggctggcccaatgcccctatcctcatccaggactttgagacgctcccccgagaggctcctgacctggtgctgcagaggtgctgctc

SEQ ID NO: 77976 - DNA, 201 bp, Homo sapiens; identical to SEQ ID NO: 30711

SEQ ID NO: 77977 - DNA, 201 bp, Homo sapiens; identical to SEQ ID NO: 30421

SEQ ID NO: 77978 - DNA, 201 bp, Homo sapiens
cgggagcaggcgcccaacctggtctacatggtcaccggaaatcctgcctctgatgagatcaagaggctgcctggagacatccaggtggtgcccattggagwgggccctaatgccaacgtgcaggagctggagaggattggctggcccaatgcccctatcctcatccaggactttgagacgctcccccgagaggctcctgac

SEQ ID NO: 77979 - DNA, 201 bp, Homo sapiens; identical to SEQ ID NO: 30713

SEQ ID NO: 77980 - DNA, 201 bp, Homo sapiens; identical to SEQ ID NO: 30433

SEQ ID NO: 77981 - DNA, 201 bp, Homo sapiens
ggtgaccgggagcaggcgcccaacctggtctacatggtcaccggaaatcctgcctctgatgagatcaagaggctgcctggagacatccaggtggtgcccaytggagtgggccctaatgccaacgtgcaggagctggagaggattggctggcccaatgcccctatcctcatccaggactttgagacgctcccccgagaggct

SEQ ID NO: 77982 - DNA, 201 bp, Homo sapiens
cagggtgaccgggagcaggcgcccaacctggtctacatggtcaccggaaatcctgcctctgatgagatcaagaggctgcctggagacatccaggtggtgcmcattggagtgggccctaatgccaacgtgcaggagctggagaggattggctggcccaatgcccctatcctcatccaggactttgagacgctcccccgagag

SEQ ID NO: 77983 - DNA, 201 bp, Homo sapiens; identical to SEQ ID NO: 5853

SEQ ID NO: 77984 - DNA, 201 bp, Homo sapiens; identical to SEQ ID NO: 30715

SEQ ID NO: 77985 - DNA, 201 bp, Homo sapiens; identical to SEQ ID NO: 30716

SEQ ID NO: 77986 - DNA, 201 bp, Homo sapiens
gaagagctcaggctcagctgtcccctctacccacttccactttctcttccagagaaatgaacagagctccctaaaccagtgaatctattcgtaagaagagttcacatcaattggagacactcagggagcacagacttaccatgtagctactttgtgggatggtgtgaggagattgatgagaagcacacacattttttttcc

SEQ ID NO: 77987 - DNA, 201 bp, Homo sapiens
ttccgtggttggtggtctcttaccaggaaggaatgctggtcagtacacacacacacacacacacacacacacacacacacacacactctctctctctctcwctcactcactcactcactaactagctgggcatggtggcatgcacgcacgcacacacactagctgggcatggtggcacacgcgcgtgcacacacacacaca

SEQ ID NO: 77988 - DNA, 201 bp, Homo sapiens; identical to SEQ ID NO: 30811

SEQ ID NO: 77989 - DNA, 201 bp, Homo sapiens
ctctctctctctctctcactcactcactcactaactagctgggcatggtggcatgcacgcacgcacacacactagctgggcatggtggcacacgcgcgtgcacacacacacacacacacaaacacatactagctgggcatggtggtgcaccagtaatcccagctaatgggagggctgaggtgggaagatggcttgaacctg

SEQ ID NO: 77990 - DNA, 201 bp, Homo sapiens; identical to SEQ ID NO: 30717

SEQ ID NO: 77991 - DNA, 201 bp, Homo sapiens; identical to SEQ ID NO: 30813

SEQ ID NO: 77992 - DNA, 201 bp, Homo sapiens; identical to SEQ ID NO: 30718

SEQ ID NO: 77993 - DNA, 201 bp, Homo sapiens; identical to SEQ ID NO: 30720

SEQ ID NO: 77994 - DNA, 201 bp, Homo sapiens; identical to SEQ ID NO: 30721

SEQ ID NO: 77995 - DNA, 201 bp, Homo sapiens
ggaattttacctttcatatgttttgatgttgctgcctagcattcttttatttcaacatgatggactccctttagcatttcttataaggcaggtatagtggygatgaactctttcagcttttgtgcacatgagaaagtctttatttcccttccatttttgaaagacagttttgctagagagagtattcttgactgcccattg

SEQ ID NO: 77996 - DNA, 201 bp, Homo sapiens; identical to SEQ ID NO: 30722

SEQ ID NO: 77997 - DNA, 201 bp, Homo sapiens; identical to SEQ ID NO: 30821

SEQ ID NO: 77998 - DNA, 201 bp, Homo sapiens; identical to SEQ ID NO: 30824

SEQ ID NO: 77999 - DNA, 201 bp, Homo sapiens; identical to SEQ ID NO: 30826

SEQ ID NO: 78000 - DNA, 201 bp, Homo sapiens
aataaactggaagcatttttttttaagcaaatgttttattgaagtaactggaaatttttgactccaggaaaaaaacaaaaatggaggaaagactcagcaamtcctttacagaaaatggagagttatttatgcaagatgggggccacaattcttgaagatcagtcaaacatatataaaattttcctgcataaaacatgcata

SEQ ID NO: 78001 - DNA, 201 bp, Homo sapiens; identical to SEQ ID NO: 30827

SEQ ID NO: 78002 - DNA, 201 bp, Homo sapiens
ttgatcaaattaactcatgatttgtctttctggattttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttca

SEQ ID NO: 78003 - DNA, 201 bp, Homo sapiens
gaccaacactgggctggccctgcggtacctctctgaccacagcttcttggtcagccagggtgaccgggagcaggcgcccaacctggtctacatggtcaccrgaaatcctgcctctgatgagatcaagaggctgcctggagacatccaggtggtgcccattggagtgggccctaatgccaacgtgcaggagctggagaggat

SEQ ID NO: 78004 - DNA, 201 bp, Homo sapiens; identical to SEQ ID NO: 5834

SEQ ID NO: 78005 - DNA, 201 bp, Homo sapiens
ccagggcggcaacaggaccaacactgggctggccctgcggtacctctctgaccacagcttcttggtcagccagggtgaccgggagcaggcgcccaacctgktctacatggtcaccggaaatcctgcctctgatgagatcaagaggctgcctggagacatccaggtggtgcccattggagtgggccctaatgccaacgtgca

SEQ ID NO: 78006 - DNA, 201 bp, Homo sapiens; identical to SEQ ID NO: 5823

SEQ ID NO: 78007 - DNA, 201 bp, Homo sapiens; identical to SEQ ID NO: 30735

SEQ ID NO: 78008 - DNA, 201 bp, Homo sapiens; identical to SEQ ID NO: 5833

SEQ ID NO: 78009 - DNA, 201 bp, Homo sapiens; identical to SEQ ID NO: 30737

SEQ ID NO: 78010 - DNA, 201 bp, Homo sapiens; identical to SEQ ID NO: 30829

SEQ ID NO: 78011 - DNA, 201 bp, Homo sapiens; identical to SEQ ID NO: 5772

SEQ ID NO: 78012 - DNA, 201 bp, Homo sapiens
actggcgctatctctggataggctagagtgcagtggcactattttggctcactgcaaccttggcctcctgggttcaagcacttttcctgcctcagcctccragtagctgggattacaggcgtgcgccaccacactcggctaatttttgtatttctagtagagatgtggttttgctatgttggctgggctggtcttgaactc

SEQ ID NO: 78013 - DNA, 201 bp, Homo sapiens
gatgtgggccaggacagcatccacgtcacggtgctgcagtactcctacatggtgaccgtggagtaccccttcagcgaggcacagtccaaaggggacatccygcagcgggtgcgagagatccgctaccagggcggcaacaggaccaacactgggctggccctgcggtacctctctgaccacagcttcttggtcagccagggt

SEQ ID NO: 78014 - DNA, 201 bp, Homo sapiens
attttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccaagtagctgggattacaggcgtgcgccaccacactcggctaatttttg

SEQ ID NO: 78015 - DNA, 201 bp, Homo sapiens
gaggtgattcagcggatggatgtgggccaggacagcatccacgtcacggtgctgcagtactcctacatggtgaccgtggagtaccccttcagcgaggcacrgtccaaaggggacatcctgcagcgggtgcgagagatccgctaccagggcggcaacaggaccaacactgggctggccctgcggtacctctctgaccacagc

SEQ ID NO: 78016 - DNA, 201 bp, Homo sapiens; identical to SEQ ID NO: 30744

SEQ ID NO: 78017 - DNA, 201 bp, Homo sapiens; identical to SEQ ID NO: 30742

SEQ ID NO: 78018 - DNA, 201 bp, Homo sapiens
ggtgaagccgacttcaacaggagcaaggagttcatggaggaggtgattcagcggatggatgtgggccaggacagcatccacgtcacggtgctgcagtactyctacatggtgaccgtggagtaccccttcagcgaggcacagtccaaaggggacatcctgcagcgggtgcgagagatccgctaccagggcggcaacaggacc

SEQ ID NO: 78019 - DNA, 201 bp, Homo sapiens; identical to SEQ ID NO: 30746

SEQ ID NO: 78020 - DNA, 201 bp, Homo sapiens; identical to SEQ ID NO: 30745

SEQ ID NO: 78021 - DNA, 201 bp, Homo sapiens
gacaaaattggtgaagccgacttcaacaggagcaaggagttcatggaggaggtgattcagcggatggatgtgggccaggacagcatccacgtcacggtgcygcagtactcctacatggtgaccgtggagtaccccttcagcgaggcacagtccaaaggggacatcctgcagcgggtgcgagagatccgctaccagggcggc

SEQ ID NO: 78022 - DNA, 201 bp, Homo sapiens; identical to SEQ ID NO: 30749

SEQ ID NO: 78023 - DNA, 201 bp, Homo sapiens; identical to SEQ ID NO: 30747

SEQ ID NO: 78024 - DNA, 201 bp, Homo sapiens; identical to SEQ ID NO: 30752

SEQ ID NO: 78025 - DNA, 201 bp, Homo sapiens; identical to SEQ ID NO: 30750

SEQ ID NO: 78026 - DNA, 201 bp, Homo sapiens; identical to SEQ ID NO: 30756

SEQ ID NO: 78027 - DNA, 201 bp, Homo sapiens; identical to SEQ ID NO: 30753

SEQ ID NO: 78028 - DNA, 201 bp, Homo sapiens; identical to SEQ ID NO: 30754

SEQ ID NO: 78029 - DNA, 201 bp, Homo sapiens; identical to SEQ ID NO: 30757

SEQ ID NO: 78030 - DNA, 201 bp, Homo sapiens; identical to SEQ ID NO: 30760

SEQ ID NO: 78031 - DNA, 201 bp, Homo sapiens; identical to SEQ ID NO: 30758

SEQ ID NO: 78032 - DNA, 201 bp, Homo sapiens; identical to SEQ ID NO: 30761

SEQ ID NO: 78033 - DNA, 201 bp, Homo sapiens; identical to SEQ ID NO: 30762

SEQ ID NO: 78034 - DNA, 201 bp, Homo sapiens; identical to SEQ ID NO: 30763

SEQ ID NO: 78035 - DNA, 201 bp, Homo sapiens; identical to SEQ ID NO: 30764

SEQ ID NO: 78036 - DNA, 201 bp, Homo sapiens; identical to SEQ ID NO: 30765

SEQ ID NO: 78037 - DNA, 201 bp, Homo sapiens; identical to SEQ ID NO: 30766

SEQ ID NO: 78038 - DNA, 201 bp, Homo sapiens; identical to SEQ ID NO: 30767

SEQ ID NO: 78039 - DNA, 201 bp, Homo sapiens; identical to SEQ ID NO: 30446

SEQ ID NO: 78040 - DNA, 201 bp, Homo sapiens; identical to SEQ ID NO: 30768

SEQ ID NO: 78041 - DNA, 201 bp, Homo sapiens; identical to SEQ ID NO: 30769

SEQ ID NO: 78042 - DNA, 201 bp, Homo sapiens; identical to SEQ ID NO: 30770

SEQ ID NO: 78043 - DNA, 201 bp, Homo sapiens; identical to SEQ ID NO: 30771

SEQ ID NO: 78044 - DNA, 201 bp, Homo sapiens; identical to SEQ ID NO: 30772

SEQ ID NO: 78045 - DNA, 201 bp, Homo sapiens; identical to SEQ ID NO: 30773

SEQ ID NO: 78046 - DNA, 201 bp, Homo sapiens
tctagggtacaagtaaaattttcacagtaatcttttataatattaaaaattctttttaaatagcgattttcttttgtcatttgttaatttatatacatgtytattatcttttttcttgatcaaattaactcatgatttgtctttctggattttttttaaaaatcaagatttcaatttatttattatgtttactgtttttat

SEQ ID NO: 78047 - DNA, 201 bp, Homo sapiens; identical to SEQ ID NO: 30775

SEQ ID NO: 78048 - DNA, 201 bp, Homo sapiens; identical to SEQ ID NO: 30777

SEQ ID NO: 78049 - DNA, 201 bp, Homo sapiens; identical to SEQ ID NO: 30778

SEQ ID NO: 78050 - DNA, 201 bp, Homo sapiens; identical to SEQ ID NO: 30779

SEQ ID NO: 78051 - DNA, 201 bp, Homo sapiens; identical to SEQ ID NO: 30780

SEQ ID NO: 78052 - DNA, 201 bp, Homo sapiens; identical to SEQ ID NO: 30781

SEQ ID NO: 78053 - DNA, 201 bp, Homo sapiens; identical to SEQ ID NO: 30782

SEQ ID NO: 78054 - DNA, 201 bp, Homo sapiens; identical to SEQ ID NO: 30783

SEQ ID NO: 78055 - DNA, 201 bp, Homo sapiens; identical to SEQ ID NO: 30784

SEQ ID NO: 78056 - DNA, 201 bp, Homo sapiens; identical to SEQ ID NO: 30833

SEQ ID NO: 78057 - DNA, 201 bp, Homo sapiens
gctttcgaccctggggcccaagaggaactccatggttctggatgtggcatttgtcctggaaggatcggacaaaattggtgaagccgacttcaacaggagcraggagttcatggaggaggtgattcagcggatggatgtgggccaggacagcatccacgtcacggtgctgcagtactcctacatggtgaccgtggagtaccc

SEQ ID NO: 78058 - DNA, 201 bp, Homo sapiens
atggcacaagtcactgtgggcccggggctcttggggctttcgaccctggggcccaagaggaactccatggttctggatgtggcatttgtcctggaaggatyggacaaaattggtgaagccgacttcaacaggagcaaggagttcatggaggaggtgattcagcggatggatgtgggccaggacagcatccacgtcacggtg

SEQ ID NO: 78059 - DNA, 201 bp, Homo sapiens
cacatggcacaagtcactgtgggcccggggctcttggggctttcgaccctggggcccaagaggaactccatggttctggatgtggcatttgtcctggaagratcggacaaaattggtgaagccgacttcaacaggagcaaggagttcatggaggaggtgattcagcggatggatgtgggccaggacagcatccacgtcacg

SEQ ID NO: 78060 - DNA, 201 bp, Homo sapiens
ccacatggcacaagtcactgtgggcccggggctcttggggctttcgaccctggggcccaagaggaactccatggttctggatgtggcatttgtcctggaasgatcggacaaaattggtgaagccgacttcaacaggagcaaggagttcatggaggaggtgattcagcggatggatgtgggccaggacagcatccacgtcac

SEQ ID NO: 78061 - DNA, 201 bp, Homo sapiens
attgagaagcaggcccctgagaacaaggccttcgtgctgagcggtgtggatgagctggagcagcaaagggaagagatcgttagctacctctgtgaccttgyccctgaagcccctcctcctactctgcccccccacatggcacaagtcactgtgggcccggggctcttggggctttcgaccctggggcccaagaggaactcc

SEQ ID NO: 78062 - DNA, 201 bp, Homo sapiens; identical to SEQ ID NO: 29984

SEQ ID NO: 78063 - DNA, 201 bp, Homo sapiens
cctcattgagaagcaggcccctgagaacaaggccttcgtgctgagcggtgtggatgagctggagcagcaaagggaagagatcgttagctacctctgtgacsttgcccctgaagcccctcctcctactctgcccccccacatggcacaagtcactgtgggcccggggctcttggggctttcgaccctggggcccaagaggaa

SEQ ID NO: 78064 - DNA, 201 bp, Homo sapiens; identical to SEQ ID NO: 29985

SEQ ID NO: 78065 - DNA, 201 bp, Homo sapiens; identical to SEQ ID NO: 29986

SEQ ID NO: 78066 - DNA, 201 bp, Homo sapiens; identical to SEQ ID NO: 30788

SEQ ID NO: 78067 - DNA, 201 bp, Homo sapiens; identical to SEQ ID NO: 30791

SEQ ID NO: 78068 - DNA, 201 bp, Homo sapiens; identical to SEQ ID NO: 30793

SEQ ID NO: 78069 - DNA, 201 bp, Homo sapiens; identical to SEQ ID NO: 30794

SEQ ID NO: 78070 - DNA, 201 bp, Homo sapiens; identical to SEQ ID NO: 30480

SEQ ID NO: 78071 - DNA, 201 bp, Homo sapiens; identical to SEQ ID NO: 30796

SEQ ID NO: 78072 - DNA, 201 bp, Homo sapiens; identical to SEQ ID NO: 30797

SEQ ID NO: 78073 - DNA, 201 bp, Homo sapiens; identical to SEQ ID NO: 30798

SEQ ID NO: 78074 - DNA, 201 bp, Homo sapiens; identical to SEQ ID NO: 30225

SEQ ID NO: 78075 - DNA, 201 bp, Homo sapiens; identical to SEQ ID NO: 30799

SEQ ID NO: 78076 - DNA, 201 bp, Homo sapiens; identical to SEQ ID NO: 30801

SEQ ID NO: 78077 - DNA, 201 bp, Homo sapiens
atagatattttctttgtggttaccatgaagcttacttaaaacagcctatacttataacagtctattctaagcttataacaacttaatttcaattgcacacaaaaactctacttttttactgcctctcccccactttatgttattcatgtcacaaattatattttttaatgttgtgtattcattaactgatttttatagtga

SEQ ID NO: 78078 - DNA, 201 bp, Homo sapiens
atacatatacatatatgtatatgtgtgtgtgtgtatgtatatatatatacacacacacacacacatatatatgtatatatatacacacatacactctgcaygtagaatttttatgtaaattaatgcatggtcctttccattagtatttctatagttcagacaaatgcgattttaatgtgttagacacatataggcatctgt

SEQ ID NO: 78079 - DNA, 201 bp, Homo sapiens; identical to SEQ ID NO: 30804

SEQ ID NO: 78080 - DNA, 201 bp, Homo sapiens; identical to SEQ ID NO: 30805

SEQ ID NO: 78081 - DNA, 201 bp, Homo sapiens; identical to SEQ ID NO: 30806

SEQ ID NO: 78082 - DNA, 201 bp, Homo sapiens; identical to SEQ ID NO: 30807

SEQ ID NO: 78083 - DNA, 201 bp, Homo sapiens; identical to SEQ ID NO: 30808

SEQ ID NO: 78084 - DNA, 201 bp, Homo sapiens
gcacaaattttgttacacttattacctagtatttaaagtttttggacgatattgcaaatggaagttttttttaaattttatgttttgtttgttgcttttayaaaatcagtttttatattttgatcttgtattcttcagccttgctaaattcacttattagttgtagtaatagtgttttttttttttttttgagggggcaga

SEQ ID NO: 78085 - DNA, 201 bp, Homo sapiens
gcgcatctcccagaagtgggtccgcgtggccgtggtggagtaccacgacggctcccacgcctacatcgggctcaaggaccggaagcgaccgtcagagctgyggcgcattgccagccaggtgaagtatgcgggcagccaggtggcctccaccagcgaggccttgaaatacacactgttccaaatcatcagcaagatcgaccg

SEQ ID NO: 78086 - DNA, 201 bp, Homo sapiens
atggagcggctgcgcatctcccagaagtgggtccgcgtggccgtggtggagtaccacgacggctcccacgcctacatcgggctcaaggaccggaagcgacygtcagagctgcggcgcattgccagccaggtgaagtatgcgggcagccaggtggcctccaccagcgaggccttgaaatacacactgttccaaatcatcagc

SEQ ID NO: 78087 - DNA, 201 bp, Homo sapiens
gctgagtttgaagtgctgaaggcctttgtggtggacatgatggagcggctgcgcatctcccagaagtgggtccgcgtggccgtggtggagtaccacgacgsctcccacgcctacatcgggctcaaggaccggaagcgaccgtcagagctgcggcgcattgccagccaggtgaagtatgcgggcagccaggtggcctccacc

SEQ ID NO: 78088 - DNA, 201 bp, Homo sapiens
ggctgagtttgaagtgctgaaggcctttgtggtggacatgatggagcggctgcgcatctcccagaagtgggtccgcgtggccgtggtggagtaccacgacrgctcccacgcctacatcgggctcaaggaccggaagcgaccgtcagagctgcggcgcattgccagccaggtgaagtatgcgggcagccaggtggcctccac

SEQ ID NO: 78089 - DNA, 201 bp, Homo sapiens; identical to SEQ ID NO: 30001

SEQ ID NO: 78090 - DNA, 201 bp, Homo sapiens
ggatggctcctccaggctgtccgaggctgagtttgaagtgctgaaggcctttgtggtggacatgatggagcggctgcgcatctcccagaagtgggtccgcrtggccgtggtggagtaccacgacggctcccacgcctacatcgggctcaaggaccggaagcgaccgtcagagctgcggcgcattgccagccaggtgaagta

SEQ ID NO: 78091 - DNA, 201 bp, Homo sapiens
gctggatggctcctccaggctgtccgaggctgagtttgaagtgctgaaggcctttgtggtggacatgatggagcggctgcgcatctcccagaagtgggtcygcgtggccgtggtggagtaccacgacggctcccacgcctacatcgggctcaaggaccggaagcgaccgtcagagctgcggcgcattgccagccaggtgaa

SEQ ID NO: 78092 - DNA, 201 bp, Homo sapiens
ggtgaagatggcattaagcagtggaggattcttcctatttccctccccccaaccgccccaacacacacatgcttacatacgattctagcctgggtccttgaaagccctttgttcagcccaagattgccctgttcccagggatttgtccagctccaggcctgggagctcagacttgtctggggagtgactgggtcacgtgga

SEQ ID NO: 78093 - DNA, 201 bp, Homo sapiens
cctgctggatggctcctccaggctgtccgaggctgagtttgaagtgctgaaggcctttgtggtggacatgatggagcggctgcgcatctcccagaagtggbtccgcgtggccgtggtggagtaccacgacggctcccacgcctacatcgggctcaaggaccggaagcgaccgtcagagctgcggcgcattgccagccaggt

SEQ ID NO: 78094 - DNA, 201 bp, Homo sapiens
tcctgctggatggctcctccaggctgtccgaggctgagtttgaagtgctgaaggcctttgtggtggacatgatggagcggctgcgcatctcccagaagtgsgtccgcgtggccgtggtggagtaccacgacggctcccacgcctacatcgggctcaaggaccggaagcgaccgtcagagctgcggcgcattgccagccagg

SEQ ID NO: 78095 - DNA, 201 bp, Homo sapiens; identical to SEQ ID NO: 30360

SEQ ID NO: 78096 - DNA, 201 bp, Homo sapiens
gacctggtcttcctgctggatggctcctccaggctgtccgaggctgagtttgaagtgctgaaggcctttgtggtggacatgatggagcggctgcgcatctyccagaagtgggtccgcgtggccgtggtggagtaccacgacggctcccacgcctacatcgggctcaaggaccggaagcgaccgtcagagctgcggcgcatt

SEQ ID NO: 78097 - DNA, 201 bp, Homo sapiens; identical to SEQ ID NO: 30362

SEQ ID NO: 78098 - DNA, 201 bp, Homo sapiens
atcctggagaccagctaactgggcttgctcagcctctctgtgccccagattctttatctggctaataaggatgaaaatccctgtatttcgtatgacctggrattccagttaggatcaaataagatggaagatatatatatacatatacatatatgtatatgtgtgtgtgtgtatgtatatatatatacacacacacacaca

SEQ ID NO: 78099 - DNA, 201 bp, Homo sapiens
accactgtttgctgaatgccacaaggtcctggctccagccacattctatgccatctgccagcaggacagttgccaccaggagcaagtgtgtgaggtgatckcctcttatgcccacctctgtcggaccaacggggtctgcgttgactggaggacacctgatttctgtggtgagtctccaagttacctctgaaaatcctggag

SEQ ID NO: 78100 - DNA, 201 bp, Homo sapiens; identical to SEQ ID NO: 30815

SEQ ID NO: 78101 - DNA, 201 bp, Homo sapiens; identical to SEQ ID NO: 30816

SEQ ID NO: 78102 - DNA, 201 bp, Homo sapiens; identical to SEQ ID NO: 30817

SEQ ID NO: 78103 - DNA, 201 bp, Homo sapiens; identical to SEQ ID NO: 30818

SEQ ID NO: 78104 - DNA, 201 bp, Homo sapiens; identical to SEQ ID NO: 30819

SEQ ID NO: 78105 - DNA, 201 bp, Homo sapiens; identical to SEQ ID NO: 5791

SEQ ID NO: 78106 - DNA, 201 bp, Homo sapiens; identical to SEQ ID NO: 30004

SEQ ID NO: 78107 - DNA, 201 bp, Homo sapiens; identical to SEQ ID NO: 30820

SEQ ID NO: 78108 - DNA, 201 bp, Homo sapiens
tttatcaaatgtacggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgtttt

SEQ ID NO: 78109 - DNA, 201 bp, Homo sapiens; identical to SEQ ID NO: 30823

SEQ ID NO: 78110 - DNA, 201 bp, Homo sapiens; identical to SEQ ID NO: 30367

SEQ ID NO: 78111 - DNA, 201 bp, Homo sapiens; identical to SEQ ID NO: 30825

SEQ ID NO: 78112 - DNA, 201 bp, Homo sapiens; identical to SEQ ID NO: 5786

SEQ ID NO: 78113 - DNA, 201 bp, Homo sapiens; identical to SEQ ID NO: 5783

SEQ ID NO: 78114 - DNA, 201 bp, Homo sapiens
actggacctggtcttcctgctggatggctcctccaggctgtccgaggctgagtttgaagtgctgaaggcctttgtggtggacatgatggagcggctgcgcrtctcccagaagtgggtccgcgtggccgtggtggagtaccacgacggctcccacgcctacatcgggctcaaggaccggaagcgaccgtcagagctgcggcg

SEQ ID NO: 78115 - DNA, 201 bp, Homo sapiens
ctactggacctggtcttcctgctggatggctcctccaggctgtccgaggctgagtttgaagtgctgaaggcctttgtggtggacatgatggagcggctgcvcatctcccagaagtgggtccgcgtggccgtggtggagtaccacgacggctcccacgcctacatcgggctcaaggaccggaagcgaccgtcagagctgcgg

SEQ ID NO: 78116 - DNA, 201 bp, Homo sapiens
gctactggacctggtcttcctgctggatggctcctccaggctgtccgaggctgagtttgaagtgctgaaggcctttgtggtggacatgatggagcggctgygcatctcccagaagtgggtccgcgtggccgtggtggagtaccacgacggctcccacgcctacatcgggctcaaggaccggaagcgaccgtcagagctgcg

SEQ ID NO: 78117 - DNA, 201 bp, Homo sapiens
agcaggctactggacctggtcttcctgctggatggctcctccaggctgtccgaggctgagtttgaagtgctgaaggcctttgtggtggacatgatggagcdgctgcgcatctcccagaagtgggtccgcgtggccgtggtggagtaccacgacggctcccacgcctacatcgggctcaaggaccggaagcgaccgtcagag

SEQ ID NO: 78118 - DNA, 201 bp, Homo sapiens
cagcaggctactggacctggtcttcctgctggatggctcctccaggctgtccgaggctgagtttgaagtgctgaaggcctttgtggtggacatgatggagyggctgcgcatctcccagaagtgggtccgcgtggccgtggtggagtaccacgacggctcccacgcctacatcgggctcaaggaccggaagcgaccgtcaga

SEQ ID NO: 78119 - DNA, 201 bp, Homo sapiens
gcctcccacagatgccccggtgagccccaccactctgtatgtggaggacatctcggaaccgccgttgcacgatttctactgcagcaggctactggacctgrtcttcctgctggatggctcctccaggctgtccgaggctgagtttgaagtgctgaaggcctttgtggtggacatgatggagcggctgcgcatctcccagaa

SEQ ID NO: 78120 - DNA, 201 bp, Homo sapiens
ctggtggtgcctcccacagatgccccggtgagccccaccactctgtatgtggaggacatctcggaaccgccgttgcacgatttctactgcagcaggctacyggacctggtcttcctgctggatggctcctccaggctgtccgaggctgagtttgaagtgctgaaggcctttgtggtggacatgatggagcggctgcgcatc

SEQ ID NO: 78121 - DNA, 201 bp, Homo sapiens
ggagccgggaggcctggtggtgcctcccacagatgccccggtgagccccaccactctgtatgtggaggacatctcggaaccgccgttgcacgatttctacbgcagcaggctactggacctggtcttcctgctggatggctcctccaggctgtccgaggctgagtttgaagtgctgaaggcctttgtggtggacatgatgga

SEQ ID NO: 78122 - DNA, 201 bp, Homo sapiens
tgaagcctgccaggagccgggaggcctggtggtgcctcccacagatgccccggtgagccccaccactctgtatgtggaggacatctcggaaccgccgttgsacgatttctactgcagcaggctactggacctggtcttcctgctggatggctcctccaggctgtccgaggctgagtttgaagtgctgaaggcctttgtggt

SEQ ID NO: 78123 - DNA, 201 bp, Homo sapiens
acctgtgaagcctgccaggagccgggaggcctggtggtgcctcccacagatgccccggtgagccccaccactctgtatgtggaggacatctcggaaccgcygttgcacgatttctactgcagcaggctactggacctggtcttcctgctggatggctcctccaggctgtccgaggctgagtttgaagtgctgaaggccttt

SEQ ID NO: 78124 - DNA, 201 bp, Homo sapiens; identical to SEQ ID NO: 5782

SEQ ID NO: 78125 - DNA, 201 bp, Homo sapiens
tcttcctgaaccattttaatttcttcgctcttttctgcagccactgtgatgttgtcaacctcacctgtgaagcctgccaggagccgggaggcctggtggtrcctcccacagatgccccggtgagccccaccactctgtatgtggaggacatctcggaaccgccgttgcacgatttctactgcagcaggctactggacctgg

SEQ ID NO: 78126 - DNA, 201 bp, Homo sapiens; identical to SEQ ID NO: 30831

SEQ ID NO: 78127 - DNA, 201 bp, Homo sapiens; identical to SEQ ID NO: 30832

SEQ ID NO: 78128 - DNA, 201 bp, Homo sapiens; identical to SEQ ID NO: 30039

SEQ ID NO: 78129 - DNA, 201 bp, Homo sapiens; identical to SEQ ID NO: 30786

SEQ ID NO: 78130 - DNA, 201 bp, Homo sapiens; identical to SEQ ID NO: 29987

SEQ ID NO: 78131 - DNA, 201 bp, Homo sapiens; identical to SEQ ID NO: 29988

SEQ ID NO: 78132 - DNA, 201 bp, Homo sapiens; identical to SEQ ID NO: 29990

SEQ ID NO: 78133 - DNA, 201 bp, Homo sapiens; identical to SEQ ID NO: 29991

SEQ ID NO: 78134 - DNA, 201 bp, Homo sapiens
ctcatacctgtaatccctgtgttttgggaggctgaggccagaggattccttgagcccaggagttcaagaccagcctgggcaacatagcaagaccccatctstacaaaaattaaaaaaagaaatgaattcagaaccaatagattctggtttaggtgcttcaacaatccagaagtctctaatattggtgacgcccatagtccc

SEQ ID NO: 78135 - DNA, 201 bp, Homo sapiens; identical to SEQ ID NO: 29992

SEQ ID NO: 78136 - DNA, 201 bp, Homo sapiens; identical to SEQ ID NO: 29993

SEQ ID NO: 78137 - DNA, 201 bp, Homo sapiens; identical to SEQ ID NO: 29994

SEQ ID NO: 78138 - DNA, 201 bp, Homo sapiens; identical to SEQ ID NO: 29995

SEQ ID NO: 78139 - DNA, 201 bp, Homo sapiens; identical to SEQ ID NO: 29996

SEQ ID NO: 78140 - DNA, 201 bp, Homo sapiens; identical to SEQ ID NO: 29997

SEQ ID NO: 78141 - DNA, 201 bp, Homo sapiens; identical to SEQ ID NO: 29998

SEQ ID NO: 78142 - DNA, 201 bp, Homo sapiens; identical to SEQ ID NO: 30223

SEQ ID NO: 78143 - DNA, 201 bp, Homo sapiens; identical to SEQ ID NO: 30042

SEQ ID NO: 78144 - DNA, 201 bp, Homo sapiens; identical to SEQ ID NO: 30005

SEQ ID NO: 78145 - DNA, 201 bp, Homo sapiens; identical to SEQ ID NO: 30006

SEQ ID NO: 78146 - DNA, 201 bp, Homo sapiens; identical to SEQ ID NO: 30007

SEQ ID NO: 78147 - DNA, 201 bp, Homo sapiens; identical to SEQ ID NO: 30008

SEQ ID NO: 78148 - DNA, 201 bp, Homo sapiens; identical to SEQ ID NO: 30009

SEQ ID NO: 78149 - DNA, 201 bp, Homo sapiens; identical to SEQ ID NO: 30010

SEQ ID NO: 78150 - DNA, 201 bp, Homo sapiens; identical to SEQ ID NO: 30011

SEQ ID NO: 78151 - DNA, 201 bp, Homo sapiens; identical to SEQ ID NO: 30012

SEQ ID NO: 78152 - DNA, 201 bp, Homo sapiens; identical to SEQ ID NO: 30013

SEQ ID NO: 78153 - DNA, 201 bp, Homo sapiens; identical to SEQ ID NO: 30014

SEQ ID NO: 78154 - DNA, 201 bp, Homo sapiens; identical to SEQ ID NO: 30016

SEQ ID NO: 78155 - DNA, 201 bp, Homo sapiens; identical to SEQ ID NO: 30017

SEQ ID NO: 78156 - DNA, 201 bp, Homo sapiens; identical to SEQ ID NO: 30018

SEQ ID NO: 78157 - DNA, 201 bp, Homo sapiens; identical to SEQ ID NO: 30019

SEQ ID NO: 78158 - DNA, 201 bp, Homo sapiens; identical to SEQ ID NO: 30047

SEQ ID NO: 78159 - DNA, 201 bp, Homo sapiens; identical to SEQ ID NO: 30448

SEQ ID NO: 78160 - DNA, 201 bp, Homo sapiens; identical to SEQ ID NO: 30051

SEQ ID NO: 78161 - DNA, 201 bp, Homo sapiens; identical to SEQ ID NO: 30053

SEQ ID NO: 78162 - DNA, 201 bp, Homo sapiens; identical to SEQ ID NO: 30054

SEQ ID NO: 78163 - DNA, 201 bp, Homo sapiens; identical to SEQ ID NO: 30055

SEQ ID NO: 78164 - DNA, 201 bp, Homo sapiens
ttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtgtgtctctgcacgtgagatgggtctcctgaatacag

SEQ ID NO: 78165 - DNA, 201 bp, Homo sapiens; identical to SEQ ID NO: 30025

SEQ ID NO: 78166 - DNA, 201 bp, Homo sapiens; identical to SEQ ID NO: 30027

SEQ ID NO: 78167 - DNA, 201 bp, Homo sapiens; identical to SEQ ID NO: 30026

SEQ ID NO: 78168 - DNA, 201 bp, Homo sapiens
tggaggattcttcctatttccctccccccaaccgccccaacacacacatgcttacatacgattctagcctgggtccttgaaagccctttgttcagcccaasattgccctgttcccagggatttgtccagctccaggcctgggagctcagacttgtctggggagtgactgggtcacgtggagctggaactgttcagaccagg

SEQ ID NO: 78169 - DNA, 201 bp, Homo sapiens; identical to SEQ ID NO: 30028

SEQ ID NO: 78170 - DNA, 201 bp, Homo sapiens; identical to SEQ ID NO: 30030

SEQ ID NO: 78171 - DNA, 201 bp, Homo sapiens
gagatgcgggaacacctcctgaggttgggtgaagatggcattaagcagtggaggattcttcctatttccctccccccaaccgccccaacacacacatgctyacatacgattctagcctgggtccttgaaagccctttgttcagcccaagattgccctgttcccagggatttgtccagctccaggcctgggagctcagactt

SEQ ID NO: 78172 - DNA, 201 bp, Homo sapiens
caacctgcatcttatgccctgcactgtcatcctgacccatcagctgggcttccagagatgcgggaacacctcctgaggttgggtgaagatggcattaagcrgtggaggattcttcctatttccctccccccaaccgccccaacacacacatgcttacatacgattctagcctgggtccttgaaagccctttgttcagccca

SEQ ID NO: 78173 - DNA, 201 bp, Homo sapiens; identical to SEQ ID NO: 30033

SEQ ID NO: 78174 - DNA, 201 bp, Homo sapiens; identical to SEQ ID NO: 30035

SEQ ID NO: 78175 - DNA, 201 bp, Homo sapiens; identical to SEQ ID NO: 30034

SEQ ID NO: 78176 - DNA, 201 bp, Homo sapiens; identical to SEQ ID NO: 30037

SEQ ID NO: 78177 - DNA, 201 bp, Homo sapiens; identical to SEQ ID NO: 30036

SEQ ID NO: 78178 - DNA, 201 bp, Homo sapiens; identical to SEQ ID NO: 30325

SEQ ID NO: 78179 - DNA, 201 bp, Homo sapiens; identical to SEQ ID NO: 30060

SEQ ID NO: 78180 - DNA, 201 bp, Homo sapiens; identical to SEQ ID NO: 30061

SEQ ID NO: 78181 - DNA, 201 bp, Homo sapiens; identical to SEQ ID NO: 30062

SEQ ID NO: 78182 - DNA, 201 bp, Homo sapiens; identical to SEQ ID NO: 30063

SEQ ID NO: 78183 - DNA, 201 bp, Homo sapiens; identical to SEQ ID NO: 30064

SEQ ID NO: 78184 - DNA, 201 bp, Homo sapiens; identical to SEQ ID NO: 30040

SEQ ID NO: 78185 - DNA, 201 bp, Homo sapiens; identical to SEQ ID NO: 30041

SEQ ID NO: 78186 - DNA, 201 bp, Homo sapiens; identical to SEQ ID NO: 30425

SEQ ID NO: 78187 - DNA, 201 bp, Homo sapiens
tgaccagcacatatgtgtgtttgtgtttttgtaaaagcacccacatgctcatgaggctaagagtgggttgtgaggacagatgggtggctgagcagggaggyaggcagagggacagagggaatgttcttctggaaaatcctcaggctcattgtgttctgcagaaggccagcagcactgcattattcaactcttcttgctgga

SEQ ID NO: 78188 - DNA, 201 bp, Homo sapiens; identical to SEQ ID NO: 30067

SEQ ID NO: 78189 - DNA, 201 bp, Homo sapiens; identical to SEQ ID NO: 30068

SEQ ID NO: 78190 - DNA, 201 bp, Homo sapiens; identical to SEQ ID NO: 30043

SEQ ID NO: 78191 - DNA, 201 bp, Homo sapiens; identical to SEQ ID NO: 30044

SEQ ID NO: 78192 - DNA, 201 bp, Homo sapiens; identical to SEQ ID NO: 30473

SEQ ID NO: 78193 - DNA, 201 bp, Homo sapiens; identical to SEQ ID NO: 30045

SEQ ID NO: 78194 - DNA, 201 bp, Homo sapiens
ttaacagtgtttagttattggaatttttatcataatagacttacacttcttagctttgaaatcttagagttattaaatctgagactggagatttcaaatawtattatcatattccaaatggatatctttcagaccaaaatacaggtgaaaatggaaaagctgtcttcaactaccaagggaatttgtgaactagaaaactac

SEQ ID NO: 78195 - DNA, 201 bp, Homo sapiens
attcacccaagtatgacagccctaaatataaaatagtggcaaaaagtcaatagaactcttatgtccaggtccaaagaatacattcattttaaattgaacaygcatcttgagtaacagctcccttctaccttagcaattcgcaaagccatcaactactcccttctaattttactgatctctctgtgcattactgaatctaga

SEQ ID NO: 78196 - DNA, 201 bp, Homo sapiens
aaccgagatctcgccactgcactccagcctggcactgcactccagcttggcaacagagcaagactccgtctcaaaaaaaaaaaaaaaaaagagagagagasagaacatcagaaacgagctcatttgatagagagacagagagcctcagaaacgagctcatttgataaaagagagagagagagagcatcagaaacgagctca

SEQ ID NO: 78197 - DNA, 201 bp, Homo sapiens
ccttgtttcctcaggctccttttggccgtgacagtttctcagacttccctgtttttgatgactttgacaatgttgagggatactggtcaggtattttgtasaacatcatgagatttatctgatgtttttctcctaattagactgaggttacgggttttgttcagaggaggaccacagaagtaaagtgccatttctatcatg

SEQ ID NO: 78198 - DNA, 201 bp, Homo sapiens
catgttggccaggctggtctcgaactcctgacatgaagtgatcttcccaccttggcctcccaaagtgctgggatcacaggtgtgagccctggcgccctgcyttagcttttccgtcatgtcttgttttggcttcaggatcctgtatgacatcgagtccccttgtttcctcaggctccttttggccgtgacagtttctcagac

SEQ ID NO: 78199 - DNA, 201 bp, Homo sapiens
taactttacatgcactgacccatttaatcctcttaccaagccagaggtagaaactattctcatctccattccactggtgatgaaactggagcggagtgagrtagggcacttgccccagcacagagctaggaaggggccgctgggacctgcccggctctgactccaggacaccccatcctttaacacttactacctattctg

SEQ ID NO: 78200 - DNA, 201 bp, Homo sapiens
tttcacttagcctaatgttctcaaggttcctccatgttgtagcacaaatcagtacttcgttcctttttattgctgaacagccttccattgtgtagacaggycacgttttgtttgtgcatccatcagctttccatcacagtccctgcacacaccataacctgtatgtctctgcagaacaaagtccctttccactcttcccta

SEQ ID NO: 78201 - DNA, 201 bp, Homo sapiens
caaaaaaaaacaatcaggcccagtgcagtggctcacacctataatcccagcactttgggatgctgaggcgcgtagatcacctgaggtcaggagttcaagaycagcctgaccaccatggagataccccgtctctactaaaaatacaaaatgatccaggtgtgatggcacatgcctgtaatcccagctacttgggaggctgag

SEQ ID NO: 78202 - DNA, 201 bp, Homo sapiens
aggatcccaggagggcactcatggtggtttatgggactctggactcctgagaagcggccttgagtctacaggatacatctacagcctgacctgaccacccracactcccaggcagccgcggcttgctcccctgctggccatttccagcctgctagaaaacccacctttttgttcctaccgaccgtggctttgagatcaagt

SEQ ID NO: 78203 - DNA, 201 bp, Homo sapiens
ggttgagaccagcctgggcaacatctacaaaaaatacaaaaaactaaccaggtgtcatggtgcatgcctgtggtcccaactactcaggaggctgaggtagratcacctgagcctgggacattgaggctgcagtgagccacgactgcaccactgcactgcagcctgggtgacagagcaaagccctgtggaaaaaaaaaaaaa

SEQ ID NO: 78204 - DNA, 201 bp, Homo sapiens
cttgctctaggactggaaatctggggtttattaccaaagtcattcaaattaatgaaatcatagcaactgtccaccttcatctccctgggaatttgctgtaygtagagttaacagtgtttagttattggaatttttatcataatagacttacacttcttagctttgaaatcttagagttattaaatctgagactggagattt

SEQ ID NO: 78205 - DNA, 201 bp, Homo sapiens
tctgtgctgcctggtgtgtgcagtggggttggtttagtgtctcccacaagtagccatacacatcatgcagttacagggcttaggacagagcctggtccacrctgagggaccgtcaatggcagcttgccacgtttccttcctttctgcgtgaagtgtgtagggctccctttctgtgttgccattttataaacaaggaagtca

SEQ ID NO: 78206 - DNA, 201 bp, Homo sapiens
gatcctcccacctgagcctcctaagtagctgggaccacatacgtgtcccaccatgcccagctaatttttacttttaatttttgtggagatgaggtctcacygtgttgcccaggctggactcagactcctggactcaagcagtcctcccgcgtccatccctcaaagtgttgggattacaggcatgagccaccaaaaccggct

SEQ ID NO: 78207 - DNA, 201 bp, Homo sapiens
ggatcagaccttggggtcttctggccagagcttgtcaccagccccatggcctctccaggcgtgctcatgcccacaacccgcggccagccccacgtggtgcygctcagccttctctgcccctcctgggaatctgtcattcgtgggtgcttcagagtaaaatcaatgagtttctgagcagaatgagtgagtgatctagtttct

SEQ ID NO: 78208 - DNA, 201 bp, Homo sapiens
cccgaaaggcttctgagacacccttcagtcaatagtgatccatgtgggccaggctgaggccctggcttgggcacagtcctgtaggcacagtccactgccaygctatccacagacaaaattttctcaagcggaggggctgccacctctgtaggcaggacgctggtggggctgggctgctggtggttcaggtggaagtcacaa

SEQ ID NO: 78209 - DNA, 201 bp, Homo sapiens
tagcagacagtcacaactttaccttatttccaatctttggaaaacaaagggcttaaggtaaaaactttgtggagccattaagctggaagaggattcagctmtatctggtgaattttaaaatgttaaaaatattctatattgtcttcttccaggaactttcacattcattcagactttgtagtttccacatttatttgtcca

SEQ ID NO: 78210 - DNA, 201 bp, Homo sapiens
gagggttcggggagaacaaacaacctgagttggctcttggtggtctgggggttgcttcctacaggcagtgggatccgggtgcatcttggaggatgggcatygtgagcctgaggaaggaaggagctttcctgcagagagaacacgtgtaaaggcctgcaggcacctcagcttttcaagagctgccagtagttcattttcgct

SEQ ID NO: 78211 - DNA, 201 bp, Homo sapiens
tgacgctgatgactggtctgtctttaccagcccttgagtttcttgaagtcagttatgtttttggttcctaaatatgtgccccgtatgagtcaggctgaccrtgaatcagatgtgatcctgccctcagaatctcctgttggggggaaaacccttagacaattatagaacaggtggtaagagctattcctccatttacctcat

SEQ ID NO: 78212 - DNA, 201 bp, Homo sapiens
ttcttcatcagagtgagctggagaatcacccaaagaggcctttccaaatactcacatccacaccctcccaacaaccctacctgcagacctggaattcccasaggtccaggcccctgtatttcacaataacctccccaggtggttccaacacatgccccaattaagaatcaccatcaggctgggcacggtggctgctcacgc

SEQ ID NO: 78213 - DNA, 201 bp, Homo sapiens
acccgcggccagccccacgtggtgccgctcagccttctctgcccctcctgggaatctgtcattcgtgggtgcttcagagtaaaatcaatgagtttctgagmagaatgagtgagtgatctagtttctataaattaggcatgctttatacattatgtttgtgtagaaaatccctggtttaatatttttactttatgcctatct

SEQ ID NO: 78214 - DNA, 201 bp, Homo sapiens
ggcaggagaatcccttgaacccggaaggcagaggctgcagtgagccgggatcgtgccactgcacttcagcctggtgacagcgagactctacctcaaaaaawaataataatgataataatatgacctggctaggcatgagtcattacgggctcacacctgtaattccagcactttggtggctgaggcaagcagattgcttga

SEQ ID NO: 78215 - DNA, 201 bp, Homo sapiens
atgttcttgaatcactgccattaagggagattcacgtttctttcagatgaggtttcgcataagctcttggagatgtacaggaaggagctgctcctgaagcrcacggtggccaaggagcttgcccacaccggggatcccgacctcaccctgagctacctgtccatgtggctgcaccagccctatgtggagagcgacagcagg

SEQ ID NO: 78216 - DNA, 201 bp, Homo sapiens
gttgcagtgagccgagattgtgccactgcactccagcctgggtgacaaagtgcgactcccgtctcaaaaaaaaaatttatatatataattttttaagtgcytagttgataggttctggctagagccagaataaaagccaggacctgtcttgttttcaaatgttaaatctcagctggcatgtacagcgaagtctcatgaaag

SEQ ID NO: 78217 - DNA, 201 bp, Homo sapiens
ccacaacccgcggccagccccacgtggtgccgctcagccttctctgcccctcctgggaatctgtcattcgtgggtgcttcagagtaaaatcaatgagtttytgagcagaatgagtgagtgatctagtttctataaattaggcatgctttatacattatgtttgtgtagaaaatccctggtttaatatttttactttatgcc

SEQ ID NO: 78218 - DNA, 201 bp, Homo sapiens
gcggacactggctccttccacgtctcaccaggcagacagtctgcctaggacccagtgccgcaggcctggatcagaccccaggatcagaccttggggtcttytggccagagcttgtcaccagccccatggcctctccaggcgtgctcatgcccacaacccgcggccagccccacgtggtgccgctcagccttctctgcccct

SEQ ID NO: 78219 - DNA, 201 bp, Homo sapiens
gcctgaagctgcgggcccgcctggaacacgctcccattgccaccagaaaccgtcgttgtatggctttcttcagaacggggagagacagtcacatttactgraggggaaaaacctaaacattttgggaaacaggtgaacatggcgtgtactgtgtcatggcccactcactgcactcaccacccaaaaccagctaggccaagt

SEQ ID NO: 78220 - DNA, 201 bp, Homo sapiens
actcatggctcccattggaaatttcaaaagccatggcttcgccgacagcaaccacgctctccagttctctctggccagagtgcacctccatcccacagggkaaccggttcaagtcccccgaaaggcttctgagacacccttcagtcaatagtgatccatgtgggccaggctgaggccctggcttgggcacagtcctgtagg

SEQ ID NO: 78221 - DNA, 201 bp, Homo sapiens
taatatctgctattattatgacaagctccatagaaaaatgtagacagcagggcagaaagacattattctttataaataaaaggttcatctgtgcaatattsacattagaaaaatatacattgcttgccatagaccttctctggataaaatcagacgaatctaggatctgactccacttcactgtgagggctctggctccac

SEQ ID NO: 78222 - DNA, 201 bp, Homo sapiens
tggggtcttctggccagagcttgtcaccagccccatggcctctccaggcgtgctcatgcccacaacccgcggccagccccacgtggtgccgctcagccttytctgcccctcctgggaatctgtcattcgtgggtgcttcagagtaaaatcaatgagtttctgagcagaatgagtgagtgatctagtttctataaattaggc

SEQ ID NO: 78223 - DNA, 201 bp, Homo sapiens
aagaaacatttctccaaagaagacacacaaatgcccagtaaggccaggcacggtggctcacatctgtaatcccagcactttgggaggccaacgcaggtggmtcacctgaggttgggagttcaagaccagcctggccaacatggtgaaaccctgtctctaccaaaaacacaaaaattaggtgggcatagtggcgcacatctg

SEQ ID NO: 78224 - DNA, 201 bp, Homo sapiens
accaggcagacagtctgcctaggacccagtgccgcaggcctggatcagaccccaggatcagaccttggggtcttctggccagagcttgtcaccagccccayggcctctccaggcgtgctcatgcccacaacccgcggccagccccacgtggtgccgctcagccttctctgcccctcctgggaatctgtcattcgtgggtgc

SEQ ID NO: 78225 - DNA, 201 bp, Homo sapiens
tctgcctaggacccagtgccgcaggcctggatcagaccccaggatcagaccttggggtcttctggccagagcttgtcaccagccccatggcctctccaggsgtgctcatgcccacaacccgcggccagccccacgtggtgccgctcagccttctctgcccctcctgggaatctgtcattcgtgggtgcttcagagtaaaat

SEQ ID NO: 78226 - DNA, 201 bp, Homo sapiens
agcgcacggtggccaaggagcttgcccacaccggggatcccgacctcaccctgagctacctgtccatgtggctgcaccagccctatgtggagagcgacagyaggctgcatctggagagcatgctgctggagacaggccaccgagctctctgacgtcctgagacggctgcggacactggctccttccacgtctcaccaggca

SEQ ID NO: 78227 - DNA, 201 bp, Homo sapiens
gggtcttctggccagagcttgtcaccagccccatggcctctccaggcgtgctcatgcccacaacccgcggccagccccacgtggtgccgctcagccttctytgcccctcctgggaatctgtcattcgtgggtgcttcagagtaaaatcaatgagtttctgagcagaatgagtgagtgatctagtttctataaattaggcat

SEQ ID NO: 78228 - DNA, 201 bp, Homo sapiens
tggcctcctgaagtgctgggattacaggcgtgagccactgccctcggtccaacttcttatcttggcctattaggttctagttgtctgatcacctactcacrcactagtccttttctgtctatttcattccagcacactggtttttttgtttgcttgtttgttttgttttgttttctgttttttgaactcaccaacctcatt

SEQ ID NO: 78229 - DNA, 201 bp, Homo sapiens
tttgtacagacggggttctcatgttggccaggctggtctcgaactcctgacatgaagtgatcttcccaccttggcctcccaaagtgctgggatcacaggtktgagccctggcgccctgccttagcttttccgtcatgtcttgttttggcttcaggatcctgtatgacatcgagtccccttgtttcctcaggctccttttgg

SEQ ID NO: 78230 - DNA, 201 bp, Homo sapiens
ctgaatcccaataagagaggaagaaaaaagtgcagggaagagaaatggaggtagagaaggagaaactaaagtcatgagaagtcagagacatatcagaaggractagagggcgagaacgcaggctagcacagatgacagcaggggctcccctttactgaaatgtacagcggcaggcaccgtgcttaactttacatgcactga

SEQ ID NO: 78231 - DNA, 201 bp, Homo sapiens
tcctccatgttgtagcacaaatcagtacttcgttcctttttattgctgaacagccttccattgtgtagacaggccacgttttgtttgtgcatccatcagcyttccatcacagtccctgcacacaccataacctgtatgtctctgcagaacaaagtccctttccactcttccctattcccccacatgtgccctgtaagaact

SEQ ID NO: 78232 - DNA, 201 bp, Homo sapiens
atggagtttcactcttgttgcccaggctggagtgcagtggggtgatctctgcccactgcaacctctgcctcctgggttcaagtgattctcctgtctcagcytcccaagtagctgggattacaggtgcctgccaccacacccagctaattgttgtatttttatttgtttttttttaatttttgttttggccaggcgcagtgg

SEQ ID NO: 78233 - DNA, 201 bp, Homo sapiens
ctaccctttagcaatcacccctctacacgcttcttctctcagccctgggcaaccactgatctcctctctgtctacagttcgcctattctggagatttcatyaaaattgaatcatataatatgtggtattttgtgtctggttgctttcacttagcctaatgttctcaaggttcctccatgttgtagcacaaatcagtacttc

SEQ ID NO: 78234 - DNA, 201 bp, Homo sapiens
agctcttataactcaataataaaaagacaattttaaaagctgggtgcagtggcacgtggctatagtctcagctacttgggaggctggggtgggaagatcgmttgaacccaggaatttgagaccagcctgatcaacacagcaagacttcatctcaaaacaacaacaaaagacaattttacaatgggcaaagtctaagaaaca

SEQ ID NO: 78235 - DNA, 201 bp, Homo sapiens
acaagataagcccatcggaagtctgaataaaaatctgcttctgtccctgagacagtaactcatggctcccattggaaatttcaaaagccatggcttcgccracagcaaccacgctctccagttctctctggccagagtgcacctccatcccacaggggaaccggttcaagtcccccgaaaggcttctgagacacccttcag

SEQ ID NO: 78236 - DNA, 201 bp, Homo sapiens
cacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcctcct

SEQ ID NO: 78237 - DNA, 201 bp, Homo sapiens
taaaattgaatcatataatatgtggtattttgtgtctggttgctttcacttagcctaatgttctcaaggttcctccatgttgtagcacaaatcagtacttygttcctttttattgctgaacagccttccattgtgtagacaggccacgttttgtttgtgcatccatcagctttccatcacagtccctgcacacaccataac

SEQ ID NO: 78238 - DNA, 201 bp, Homo sapiens
ttcacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcctc

SEQ ID NO: 78239 - DNA, 201 bp, Homo sapiens
taagtgtaacttctttaagaaaaaattggaaaaaaaaatccagtagatgccagtcttctattgaaaaagacacgtgggtataatatagctgatgcctaacmaaagctacttcctagtcactccttcagaagagggttatcctcattccatcttccccaccactggttttccaaggcagtcctgaaaattcaatttgtgtgt

SEQ ID NO: 78240 - DNA, 201 bp, Homo sapiens
attcacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcct

SEQ ID NO: 78241 - DNA, 201 bp, Homo sapiens
tattcacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcc

SEQ ID NO: 78242 - DNA, 201 bp, Homo sapiens
caatattcacattagaaaaatatacattgcttgccatagaccttctctggataaaatcagacgaatctaggatctgactccacttcactgtgagggctctsgctccacggtgacgaccgactccacagcttctagaggaactccttctagcgggcccatccgcaggcacgcccctctgcatcagtcactgtgacaatgtcc

SEQ ID NO: 78243 - DNA, 201 bp, Homo sapiens
tgttccaaagcattctctccaggaaacgctgccacctgtgcctgggtcagcctcctaggctctcctgactgagcataaacaggcagcccactgacatcccrggatgagagagcagcacctatagaccccctcctggcttctaagttagccagtgcctgaagctgcgggcccgcctggaacacgctcccattgccaccagaa

SEQ ID NO: 78244 - DNA, 201 bp, Homo sapiens
ttgagcccaggcggcagaggttgcagtgagccaagatcgcgccactgcactccagcttgggctacagagtaagacttggtctcaaaaataattaaattaawttaatttaatttaatttaaaaaatcatgcaagtagaaatgactttttcccccttctatcaataaaatgctgcccagaatgactagcttattttcttttta

SEQ ID NO: 78245 - DNA, 201 bp, Homo sapiens
gagacggctgcggacactggctccttccacgtctcaccaggcagacagtctgcctaggacccagtgccgcaggcctggatcagaccccaggatcagacctyggggtcttctggccagagcttgtcaccagccccatggcctctccaggcgtgctcatgcccacaacccgcggccagccccacgtggtgccgctcagccttc

SEQ ID NO: 78246 - DNA, 201 bp, Homo sapiens
tcctggcctcaagtgatccacccacctcagcctcccaaagtgttgggattacaggcgtgagccaccatgttcgtccaggaaatctttatctttggacaccraaattagaattttgtataatttttatgagtcacaatcactattgtccttttggttattttcaaccatttaaaaatgtaaaaaccatcttagcttatgggc

SEQ ID NO: 78247 - DNA, 201 bp, Homo sapiens
tcacattagaaaaatatacattgcttgccatagaccttctctggataaaatcagacgaatctaggatctgactccacttcactgtgagggctctggctccrcggtgacgaccgactccacagcttctagaggaactccttctagcgggcccatccgcaggcacgcccctctgcatcagtcactgtgacaatgtcctcctcc

SEQ ID NO: 78248 - DNA, 201 bp, Homo sapiens
cagagacatatcagaagggactagagggcgagaacgcaggctagcacagatgacagcaggggctcccctttactgaaatgtacagcggcaggcaccgtgcytaactttacatgcactgacccatttaatcctcttaccaagccagaggtagaaactattctcatctccattccactggtgatgaaactggagcggagtgag

SEQ ID NO: 78249 - DNA, 201 bp, Homo sapiens
caaccactgatctcctctctgtctacagttcgcctattctggagatttcattaaaattgaatcatataatatgtggtattttgtgtctggttgctttcacytagcctaatgttctcaaggttcctccatgttgtagcacaaatcagtacttcgttcctttttattgctgaacagccttccattgtgtagacaggccacgtt

SEQ ID NO: 78250 - DNA, 201 bp, Homo sapiens
gagccacccgactcagcctcccaaagtgctgggattacaggcatgagccaccacacccagcaacagtgattttatgccaatactgaatgaatgattggtgrttcttcatcagagtgagctggagaatcacccaaagaggcctttccaaatactcacatccacaccctcccaacaaccctacctgcagacctggaattccca

SEQ ID NO: 78251 - DNA, 201 bp, Homo sapiens
cagtgtttagttattggaatttttatcataatagacttacacttcttagctttgaaatcttagagttattaaatctgagactggagatttcaaataatatyatcatattccaaatggatatctttcagaccaaaatacaggtgaaaatggaaaagctgtcttcaactaccaagggaatttgtgaactagaaaactaccatt

SEQ ID NO: 78252 - DNA, 201 bp, Homo sapiens
gccatcagctgagctcatcccccgtgcactccacaacgctgaggctctgcacatggctcaccagtgccaggtgctgccagtcagcagtgccgtgctgtttscacagcagcctgcatacgtctatattgcccagcccgtttcacctggcggggtcacacaaaccaccccctggtattgttagcacgtccacataatggcatc

SEQ ID NO: 78253 - DNA, 201 bp, Homo sapiens
acgctgaggctctgcacatggctcaccagtgccaggtgctgccagtcagcagtgccgtgctgtttgcacagcagcctgcatacgtctatattgcccagccygtttcacctggcggggtcacacaaaccaccccctggtattgttagcacgtccacataatggcatctccacagctgtgtcatccagaagaaacccatagcc

SEQ ID NO: 78254 - DNA, 201 bp, Homo sapiens
tgcaaggcagcccccacccggcactgcaacatgctcctcggtgacagctacctgatggaaggtggcacagaggacctcacgctgccgacctgcgaggcccrtattcctagcgaggggcagtagtgcccagctgggaggaccctggcttttcgatggtccatctctgtcagctcaggcccagagtgcgtggggagggaacag

SEQ ID NO: 78255 - DNA, 201 bp, Homo sapiens
gactcatacattcctcttagaaatttgaaccgtagacatgtacaaaggtggtaattatagctttatgatagcaaaaagctggagtcaccaaatgggagaayggaaaaattatggtacattcatatggtatcattttagacatcatgtcatttctgtagattgtaaaataaaaattttagacaagtgaaagtgaacgaacca

SEQ ID NO: 78256 - DNA, 201 bp, Homo sapiens
tgacttgccctcctcccccaggctgagagccagcgacatcatggagcccaacctgacctacgtctacccgcacacccgcatccagtctctggtgagcatcmtgcgcaccacggtccaccatgccttcccggtggtcacagagaaccgcggtaacgagaaggagttcatgaagggcaaccagctcatcagcaacaacatcaa

SEQ ID NO: 78257 - DNA, 201 bp, Homo sapiens
taaccttgcatgagtttaccttgagatgagattgacagctccctcagcagttcgaggagggaagaattccagggagaaccacttgtcaccagattccaatygccgcctcatcttctcccggagtctctcatgccgctcggggtccaggcccggggtggaacatctcgaactatctttggagctctcactgccactgctggc

SEQ ID NO: 78258 - DNA, 201 bp, Homo sapiens
actgaccaggggctgctgtgaatgctgtttggagaaatcggggctgggggtaggcagggttatgttttgaatttctgagaccagagcttctttctgtggcrttgtaacagctgtgctttgcctcctagagtcttagagagcctccttgtgtctctggtaaccaccgtggtggtgtttgtggcctcgatggtgttaggagaa

SEQ ID NO: 78259 - DNA, 201 bp, Homo sapiens
gctcactgcagcctcagcctcccaggctcaagcgatcctcccacctcagcttcttgagtagctgggaccataggcatataccttttgtactttttgtagcracatggtctcactacattgcccaggctggcctccaactcttaggctcaagtgatcctcctgcctcagcctcccaaagtgttgggattacaggcatgagcc

SEQ ID NO: 78260 - DNA, 201 bp, Homo sapiens
tttcaccctgcccagggctcttcgtggggaaggaaggccccatgatccacagtggttcggtggtgggagctggcctccctcaggtaagatgggctgagagrgtgtgggcctctgggcaggcctagtgggaggtctggttacactgggccaaatccattgggacaccctgacatcacattggaacctggtgccattctggct

SEQ ID NO: 78261 - DNA, 201 bp, Homo sapiens
ttagaagctcagaaaatgtgtgttgagtgaccagctctgtcctggctggccagatctgtccccaggtgtgctgacctcatgactgaccaggtgaacaggaygttgtgcagccataaggttggaaatcagggcagcaagtgactagaggtcacaagaggtatccagggtgatattattctaagataagataaaagggaccct

SEQ ID NO: 78262 - DNA, 201 bp, Homo sapiens
tacttacatttgctagtttattaataaaggatatcataaaggatacagaagaacagccagatggagagattcaaggaacgtgggagggggcacggagcttycatgccctctccaggcacgctaccctccaggaacctccaaacggttcagctgtctggaagctctctgaaccttgtcattttggagttttatggaagcttt

SEQ ID NO: 78263 - DNA, 201 bp, Homo sapiens
agacatcatgattgagagttaggggaatcctaactgtggcaagcacagcctcgctgtaggaacagttagaaagagggtcagcagactcactttctttcatrccaccccccaagccctgtgcagcagcttacagttatgcagaccaaggccaagttccgaaacgagactcaaaaaaaagcctggatgtgcacgagtacttgt

SEQ ID NO: 78264 - DNA, 201 bp, Homo sapiens
tgccgtgtacaacagtgtggacacttttgaaatacacacaataatttcaggttagtggtttctcccaggggagagaggaaggaaaactgtttttttttttkttttgttttgtttcttaaaatggtactgaatgttttcttttttaaaaatacctggagcatatatggcatgttgttgagatttgttaaagctacagttgtg

SEQ ID NO: 78265 - DNA, 201 bp, Homo sapiens
agctagaggcaggagagtgggagccagtgtccaagggcagatactgagtttggttctagaaacgcttaaggcagctgtatggggcaggctccagaccccargggaaaaatggatcacttggtggaataagactgattatttaagctaaggcagtggatgaaaaatcctagagagaggctgagatctacaacatgaacaaag

SEQ ID NO: 78266 - DNA, 201 bp, Homo sapiens
tgaattgaaggttcacaggactccctccttgagtttggttaacttgctagagcgggtcagaaaacacagaaatgctacttacatttgctagtttattaatraaggatatcataaaggatacagaagaacagccagatggagagattcaaggaacgtgggagggggcacggagctttcatgccctctccaggcacgctaccc

SEQ ID NO: 78267 - DNA, 201 bp, Homo sapiens
attccccagtgattcacttggtcagccaccctcctgggtcagaaggtactcttagtagacttcttagccctgtatcagatgtgtgtgttactgacctgccsgcctcgtaaggctctttcaatcagagactcagtttagagtcacggaccaccttctttttgtattcctgcaagttcggcacatacccagaaggcaccttga

SEQ ID NO: 78268 - DNA, 201 bp, Homo sapiens
aagttttggagaccatggataataaggtgggtcttacaattcttcatctctggggatcaaatcagtcttaacatggcattttttttctcttctaaaggccycagtaaacatctttacaccttgttttttgaaccttttcatgcgatacaggcagacctcactttatgcgctttgctttatttcacctcgcaggtactgcag

SEQ ID NO: 78269 - DNA, 201 bp, Homo sapiens
ggagaatggaaaaattatggtacattcatatggtatcattttagacatcatgtcatttctgtagattgtaaaataaaaattttagacaagtgaaagtgaaygaaccacagagttgtgtgtatcaacatggctaattctcaaagacttaatgttgagaaaaaaagagcaagttacagaatatacaagtgccgtgtacaacag

SEQ ID NO: 78270 - DNA, 201 bp, Homo sapiens
catccagcgagctacggaacatgtgtgatgagcacatcgcctctgaggagccagccgagaaggaggacctcctgcagcagatgctggaaaggaggtgagarcctggcggggcccccactgcccgcagggctacacagcggtggggtgagcctttggctcagatgttgtgaggtggctcctgagtttcctgggaaagttgga

SEQ ID NO: 78271 - DNA, 201 bp, Homo sapiens
gtgccgttataatcactattacagaggtaagacacaacaacagcgctatcattttgtgtgagagcagcacttcagacttttcacagcgcttgcctgtttaytatctcaggtgagttaagacatcatgattgagagttaggggaatcctaactgtggcaagcacagcctcgctgtaggaacagttagaaagagggtcagcag

SEQ ID NO: 78272 - DNA, 201 bp, Homo sapiens
aggattgttgtggagcccaagtgagctgagaacgtgtcaacacataacaagtgtgcagtgctgagtccctgcaagatggccatcatagttgtctttattgrttgcttgtagcatgcctagcactgtgctgagaactttatggaaatgattttattttgatcaccatccccaggtggtagatagcattgtccttgcttacaa

SEQ ID NO: 78273 - DNA, 201 bp, Homo sapiens
tggaaggtggcacagaggacctcacgctgccgacctgcgaggcccatattcctagcgaggggcagtagtgcccagctgggaggaccctggcttttcgatgktccatctctgtcagctcaggcccagagtgcgtggggagggaacagaggcaccttccccagcgggtgtgttcaactgggcggagctgcgacaaaggaagag

SEQ ID NO: 78274 - DNA, 201 bp, Homo sapiens
cggtctcctccctggagggatgggtgtcccaccccgctaatcctgccttggtctttctggtgaccagccccttttctgaagccatctaagggcccccagcygccactcatctcattagcaaacaaaagataccacggctcaaaaaaaaaaaaagacaaagtatgtttgtgtgtgtgtgtgtgtgtgtgtgtgtgtgtgtgt

SEQ ID NO: 78275 - DNA, 201 bp, Homo sapiens
ctcccaaagtgctgagattacagacgtgagccactgcgcccagctaattcctacagtcaattttagaatattttcatcacctgagaggaaaccctgcactsattagcagccactgcctgttctccttgcccctgactccaggcaaccagtgatctcctttctgtctatttgcctattctagatatctaaaaaccttctaaa

SEQ ID NO: 78276 - DNA, 201 bp, Homo sapiens
agccccaacagccccccagaccctcagctgcaagagccgcattcttactgatttgactcaagaggctcccacttcaaaggtgtgagaagagtaaaaaagartccttggttatctcaccgccgtgcctcaggattctttctcctcgacgctggtacccgtgcggggaaacagagggtgacgcttggctggtgcccagctccc

SEQ ID NO: 78277 - DNA, 201 bp, Homo sapiens
aaaagcaaaactccatctcaaaaaaaaaaaacaaaaacaaaaaacagaaacaagtaatcagagccaccagggcacagacaggccaacagagggcatagggycatctggcagtctggttaagaaaataagacaaacacttaaaaacaaacaaaacacttgcacagcaatgggcaaacacacagtagtgaatgggtgtgtggt

SEQ ID NO: 78278 - DNA, 201 bp, Homo sapiens
gagacaagcggtcccgtctcacacggcttagtgctttgcccacccctggctggggtggacttaccggctctcaggggaagttggcactgttctcatcacaygcgacagggagagtagatttgacagcaggggcagctttatcaggccgtgaagatgtgtgtgcgttcttgccgcaatgagcatgtggacagatctgttttt

SEQ ID NO: 78279 - DNA, 201 bp, Homo sapiens
ggcgcgggtgaccggaagccccgcccccaacatggccgtgcccacaggtctcgttggaggccgtgcctttatcgtcatgtgacgcgagtcctcgccccacycgtctgcagccactcctggtctcagtcccagagctcgagagggccacgtgaccgtcccggggccagtcacgtgaggcgcagatcctggctgggagggggt

SEQ ID NO: 78280 - DNA, 201 bp, Homo sapiens
tgcatgctgaccctgtgctggcggtggagaataggagaccaccgctgcttctcaccgtgcctggaggattggagagcccttccctacttctacctgggcaygcctgccaccctctcccatcccacggccttggggctcctgcctcctgggagaattttctactcatctcaagtgaaggggtcttgtggtagggagcacgag

SEQ ID NO: 78281 - DNA, 201 bp, Homo sapiens
tcttgaactcctgaactcaagtgattcacctgcctcggcctcccaaagtgctgggattacatgcgtcagccactgcacccggcctcagtcttttcttctaygcggcacaaccctggcatgcatagtgcgtacttacacaggttttgttgcagtaggttaacttatgtcccttgaaatgtaattgccaactacactgacaga

SEQ ID NO: 78282 - DNA, 201 bp, Homo sapiens
ggaaacccgactgggagaagggggcgggctttgaacttttcttctggaaataagaagccaaagcaccaggctggcatcgtgacttttattttgtcatgccrtaaggcctagaagcatctcaggcaaatgaagatggtcccagattaaaaacccaaccaagaaaggccacagacaggcatattcttaggaaggcgttttgta

SEQ ID NO: 78283 - DNA, 201 bp, Homo sapiens
ttttaacctcacctttgtcttcctggcaagcctccttgttctcattgaggtgaggtggtttggattcacctgctcgcttaggaggttttagagtcccgcaytccttttccccacctccttccagaatgtcaggaaactgagaatgcagattcctgcagaaagtggcctcttgttcactaaaggtaaaggtttcacctctgg

SEQ ID NO: 78284 - DNA, 201 bp, Homo sapiens
cttgaactcctgaactcaagtgattcacctgcctcggcctcccaaagtgctgggattacatgcgtcagccactgcacccggcctcagtcttttcttctatrcggcacaaccctggcatgcatagtgcgtacttacacaggttttgttgcagtaggttaacttatgtcccttgaaatgtaattgccaactacactgacagag

SEQ ID NO: 78285 - DNA, 201 bp, Homo sapiens
acatggctaattctcaaagacttaatgttgagaaaaaaagagcaagttacagaatatacaagtgccgtgtacaacagtgtggacacttttgaaatacacasaataatttcaggttagtggtttctcccaggggagagaggaaggaaaactgtttttttttttgttttgttttgtttcttaaaatggtactgaatgttttct

SEQ ID NO: 78286 - DNA, 201 bp, Homo sapiens
tcttcccactggtcacctattgggtctgcagggttggtggaggtcatagtcactgggtctcacccaacctccagagaccctttctgttccctctacctagycccgacacccaggactgcgagtccctggaaggcagaaacttcatattatttaggtttggttcgtctctttctagcacttggtaagacagcaggagggaaa

SEQ ID NO: 78287 - DNA, 201 bp, Homo sapiens
tcccactggtcacctattgggtctgcagggttggtggaggtcatagtcactgggtctcacccaacctccagagaccctttctgttccctctacctagcccygacacccaggactgcgagtccctggaaggcagaaacttcatattatttaggtttggttcgtctctttctagcacttggtaagacagcaggagggaaaaaa

SEQ ID NO: 78288 - DNA, 201 bp, Homo sapiens
tcagctgatatgcatattcatgtaaatttttgttgttcttgtcattgtttgagacagagtctcactctgtcgcccaggctggaatgcagtggtacggtctyggatcactgcgacctccacccccgcctctgagttcaagctgttctcctacctcagcctcccaagtagctgggactacatgcatacaccaccatgcctggc

SEQ ID NO: 78289 - DNA, 201 bp, Homo sapiens
tgaggcaggagaatggtgtgaacccgggaggcggagcttgcagtgagctgagattgcgccactgcactccagcctgggcgacagagcgagactccgtctcaaaaaaaaaaaaaaaaagtggaagttgcttttaaaaatactttccatgttagtttgtcttgtgactaacctcatttccatagacactaactacaaaagata

SEQ ID NO: 78290 - DNA, 201 bp, Homo sapiens
ctattgggtctgcagggttggtggaggtcatagtcactgggtctcacccaacctccagagaccctttctgttccctctacctagccccgacacccaggacygcgagtccctggaaggcagaaacttcatattatttaggtttggttcgtctctttctagcacttggtaagacagcaggagggaaaaaagcagcccaccagt

SEQ ID NO: 78291 - DNA, 201 bp, Homo sapiens
tgggttcctactgcacagggtggggcagggagcatcagggggcaggcagccacacccccgacacatcaagacacctgagtggcaggttcaagccggaggcrctgtatttccacacaggaagaaggccaaaaaaggtgacactgccccctcccagtggctccatgctcctcagctatggctgtccgggccgcctcactcaaa

SEQ ID NO: 78292 - DNA, 201 bp, Homo sapiens
gaaagccagaacccagagtgtaggggagtgctggctccacacctccccgcagcgccatgatgttcttcaggcccagctgcttagctttgtgcagatggccygtgatctcctccaggcgctgacggcagcaggtcatgtgcaggatggtctccaggccacagtagttcacggcggtgctggcgatcatcatggaggaggtct

SEQ ID NO: 78293 - DNA, 201 bp, Homo sapiens
ccagctgcttagctttgtgcagatggcccgtgatctcctccaggcgctgacggcagcaggtcatgtgcaggatggtctccaggccacagtagttcacggckgtgctggcgatcatcatggaggaggtctccttgtctgagccagggtcacctgctgggtgccaggtcacgtctatgtagagggggccacctgctgccatcc

SEQ ID NO: 78294 - DNA, 201 bp, Homo sapiens
ctaggttcaagcggttcttctgccccagcctcccgagtagatgggattacaggcgcccaccaccatgcccggctaatttttgtatttttagtagagatagrgtttcaccatgttggccaggctggtctcgaactcctgacctcaggtgatactgcttcggtctcccagagtgctgggattacaggtatgagccactatacc

SEQ ID NO: 78295 - DNA, 201 bp, Homo sapiens
aactcaagttcggagtggtacagacatgtatccttttcacggttcctggtgttcgtggacttcagtggtcaccaagattctttcttacatagaaatgggtytaacagtaagcatagtattagaagggccgcttattagctattcagctttaatatttctaatgatcactgaaggacacaaaagaaggactttaataagcaa

SEQ ID NO: 78296 - DNA, 201 bp, Homo sapiens
agggctgacagtttgctccccaggcaccaccactcccgcctcccaccttaaccttgcatgagtttaccttgagatgagattgacagctccctcagcagttygaggagggaagaattccagggagaaccacttgtcaccagattccaatcgccgcctcatcttctcccggagtctctcatgccgctcggggtccaggcccgg

SEQ ID NO: 78297 - DNA, 201 bp, Homo sapiens
tggtctcacatctttttctgcacctgcttccctctttgttttccgttgcttcactcaacttagctgtactctctgcctttgttctttggaggggcagtggractgggctggagaagggatctcctccttctgcgcttttctgctgtgcattcacgtactgctggctggtgagcagcctccgtatgtgcagtgggggaggag

SEQ ID NO: 78298 - DNA, 201 bp, Homo sapiens
agtttaacttcccctatttccgaagcgacaggtatggaaaggttagaaattggtttcttttttggaaacaacatgttcatgcgctgcgggtcagactcgayacttgctctagcctggcagtatcccctgcggggaaacccgactgggagaagggggcgggctttgaacttttcttctggaaataagaagccaaagcaccag

SEQ ID NO: 78299 - DNA, 201 bp, Homo sapiens
ttctttaaaaagtgcaagtctggccactttgggaggccaaggcgggcagatcacctaagatcgggagtttgagaccattctgaccagtgtggagaaacccygtctctagtaaaaatacaaaattagccggtaaaaatacaaaattagccgggcgtggtggcgcatgcctgtaatcccagctactcgggcgactgaggcagg

SEQ ID NO: 78300 - DNA, 201 bp, Homo sapiens
tacctcaaaaaaaaaaaagaaaaaaaagtgcaagtcctcccattgcccctcagacctcctgagtcagatcctctggagtggggcccagcagctgtggttcwgcaagccctccaggtgacgctcacgctgctaatgaaggtggccagctctccctcttccgccgcccagattgttgagggtaagccagagaaccaatggatt

SEQ ID NO: 78301 - DNA, 201 bp, Homo sapiens
actgatttgactcaagaggctcccacttcaaaggtgtgagaagagtaaaaaagagtccttggttatctcaccgccgtgcctcaggattctttctcctcgaygctggtacccgtgcggggaaacagagggtgacgcttggctggtgcccagctcccctggtttgtttgtggctcagctgtcagggcctccaaataagggtgg

SEQ ID NO: 78302 - DNA, 201 bp, Homo sapiens
agccctcgttagctgtttatcccaatcaagctgtgtctggctgtgcactatccaggcctccacattctgtgacaaactaacagggccggctcctgtcactyctgttctcgccagcgggttttaccctgaaggtgactcaggccttctctttgccctagatcgtggggatcatcacacggcacaacctcacctatgaatttc

SEQ ID NO: 78303 - DNA, 201 bp, Homo sapiens
gagctgagcgctgagcatgtgccctgtggaaggacattttagttcagatgccagctggcccaagccctttttggagctaaccttgtccccttggcctccartgtgtgagccctcgttagctgtttatcccaatcaagctgtgtctggctgtgcactatccaggcctccacattctgtgacaaactaacagggccggctcct

SEQ ID NO: 78304 - DNA, 201 bp, Homo sapiens
gacatcatgattgagagttaggggaatcctaactgtggcaagcacagcctcgctgtaggaacagttagaaagagggtcagcagactcactttctttcatgycaccccccaagccctgtgcagcagcttacagttatgcagaccaaggccaagttccgaaacgagactcaaaaaaaagcctggatgtgcacgagtacttgtg

SEQ ID NO: 78305 - DNA, 201 bp, Homo sapiens
gaaggattgcctgagcccaggagttcaaggccagcctgggcaacatagcgagactccatctcttaaaaaaacaaaaaacacacctgtaatcccagcacttygggaggccgaggtgggtggatcacctgaggccaggagtttgagaccagcctggccaacatggtgaaatcccgactctactaaaaatataaaaattagcca

SEQ ID NO: 78306 - DNA, 201 bp, Homo sapiens
ttgacacccaggctccctcaccccttctactaaattgtacttacatttgtaatgtgcttgccttcagctgatatgcatattcatgtaaatttttgttgttsttgtcattgtttgagacagagtctcactctgtcgcccaggctggaatgcagtggtacggtcttggatcactgcgacctccacccccgcctctgagttcaa

SEQ ID NO: 78307 - DNA, 201 bp, Homo sapiens
gctggtctcgaactcctgacctcaggtgatactgcttcggtctcccagagtgctgggattacaggtatgagccactatacctggccattttcttctgtttygtaagtatttgttttcttgtacatagttgagaagtttgcaggaattagtataagatactccatattgttctgtcaccttgcactccctcactgaaccctg

SEQ ID NO: 78308 - DNA, 201 bp, Homo sapiens
accatttcaggaaccaagttcaggctaccaagtggcctccgggaaagccagaacccagagtgtaggggagtgctggctccacacctccccgcagcgccatsatgttcttcaggcccagctgcttagctttgtgcagatggcccgtgatctcctccaggcgctgacggcagcaggtcatgtgcaggatggtctccaggccac

SEQ ID NO: 78309 - DNA, 201 bp, Homo sapiens
tacaaaggaatgcatcgggtttgagggagagctggggcagttcagaagagccccccaccccgcccgtggtctgagcagggctggagagccagcacagcttsctcccaggggcctgcgggcactgtcatgaggctggatgacttgccctcctcccccaggctgagagccagcgacatcatggagcccaacctgacctacgtc

SEQ ID NO: 78310 - DNA, 201 bp, Homo sapiens
ctccctcagcagttcgaggagggaagaattccagggagaaccacttgtcaccagattccaatcgccgcctcatcttctcccggagtctctcatgccgctcrgggtccaggcccggggtggaacatctcgaactatctttggagctctcactgccactgctggcactgccctccaagcaggggttgaggctgctgtttcctc

SEQ ID NO: 78311 - DNA, 201 bp, Homo sapiens
tagtgtattttatgtgtggccaaagacaattcttcttccagtgtggtccagggaagccaaaagagtagacacccctgtgtcagtagtctttcttggtctcrcatctttttctgcacctgcttccctctttgttttccgttgcttcactcaacttagctgtactctctgcctttgttctttggaggggcagtgggactgggc

SEQ ID NO: 78312 - DNA, 201 bp, Homo sapiens
gaacatctgttacttgaaacagttcgtgcacaggatggaaggggtgagggcttgactatgcagccagatttctcctgaattcatgctactccaaaaagacmgtgttgtgggttagaacttgatgctggccatgttccaaaaatagccagacccaagttcagtaagggcacgaatttctcagaacaaaagctgccccatctg

SEQ ID NO: 78313 - DNA, 201 bp, Homo sapiens
tgttcgtatgttaccattcagatacctgacaaacacactcttcagttttgggatttggaatttagcttgtggaattagcttttgtcaaaattagcaagctytttgtgtcaacagccagatagtaaatatttaaggctttgtgggccaagaatcagaatggaagctcttatgtagatgtttatgtaactatttacatgtgtg

SEQ ID NO: 78314 - DNA, 201 bp, Homo sapiens
tttaatgcatggggtgggagaggcgaggaagtcaccatcaaaccactttatctacagttagcataagatgtgagaagtgttgacaggaagctgcagcttaratgggatgatcacaactccatggcaacaagatgacacaaatgcagcagagaccccaggggacaggagcctcttgcagtctgtccctaggcccagccctgc

SEQ ID NO: 78315 - DNA, 201 bp, Homo sapiens
aaagcaagcttgtccaacccatggcccaacacagattcatataccttttaaaaacatttatgagatttttctgagtttttcttttcttagctcatcagctrtcattagtgtattttatgtgtggccaaagacaattcttcttccagtgtggtccagggaagccaaaagagtagacacccctgtgtcagtagtctttcttgg

SEQ ID NO: 78316 - DNA, 201 bp, Homo sapiens
gtggtacagacatgtatccttttcacggttcctggtgttcgtggacttcagtggtcaccaagattctttcttacatagaaatgggtctaacagtaagcatrgtattagaagggccgcttattagctattcagctttaatatttctaatgatcactgaaggacacaaaagaaggactttaataagcaaagacatatacctat

SEQ ID NO: 78317 - DNA, 201 bp, Homo sapiens
tcacgaggaaggtttttgtagccaaggtctcctgacccaggggcgtttctgcactgactgttggtctttcctttttcaccctgcccagggctcttcgtggrgaaggaaggccccatgatccacagtggttcggtggtgggagctggcctccctcaggtaagatgggctgagagggtgtgggcctctgggcaggcctagtgg

SEQ ID NO: 78318 - DNA, 201 bp, Homo sapiens
gaggctgaggcaggagaatggcatgaacctgggaggcggagcttgcagtaagccaagatcacgccactgcactccagcctgggtgacagagcaagactccrtctcaaaaacaaacaaacaaaaacatcaatggctgggtgcagtggctcatgcctgtaatctcaggactttgggaggccgaggcaggcagatcacctgagg

SEQ ID NO: 78319 - DNA, 201 bp, Homo sapiens
tcacggaccaccttctttttgtattcctgcaagttcggcacatacccagaaggcaccttgatgtttttactgatgccggggttttctggaaggaagatccrgtgggaacatggtgcagcagtgatcgtgccgatctttgatctgccccctgagctgggggctgagattctgagatcacagaaaacacagaggtcaggggct

SEQ ID NO: 78320 - DNA, 201 bp, Homo sapiens
tccagcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgcta

SEQ ID NO: 78321 - DNA, 201 bp, Homo sapiens
ccagcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctat

SEQ ID NO: 78322 - DNA, 201 bp, Homo sapiens
tgttgcttctctgtaaccacttgaatctctcagatccccattggggcccttgtcttggaggacagcctcttcagtgtccccagttatatgtatatattatwtatatatatatatatatatatatacacacacacactatatatatacacacacacacacacacacacacacacaaacacacattatatatttctgtttgtt

SEQ ID NO: 78323 - DNA, 201 bp, Homo sapiens
cccatgcggagctgcctcttcatgccgttggcgtctcaggcagtcagtgacacgtggtctctttgcaggatgtcaccccatacatgaacccttcgcctttyaccgtctcgcccaacacccacgtctcccaagtcttcaacctgttcagaacgatgggcctgcgccacctgcccgtggtgaacgctgtgggagaggtgagcg

SEQ ID NO: 78324 - DNA, 201 bp, Homo sapiens
tccacaggaaagctcaggacagctgggaaagctgaaggaccagaaccatgtgctgtggggagcagtgcagggtctagcagacatcccttgggtaccaggargaaggagcactggccctgggttcctcctgattccgattcagaatccagggagagggggtatcctgttgcctcacttgggtcatgtgccactccttggctt

SEQ ID NO: 78325 - DNA, 201 bp, Homo sapiens
tgggagaatcgcttgaacccgggagacagaggctgcagtgagccgagatcgcgccattgcactccagcctgggcaatgagagcaaaactgtctcaaaaaamaacaacaaaaaaaaaaaacaaacaaaatcaataaatttgaccacatcaaagtacatattgtatttataaagacaaaaactccaaataacaacaataaaac

SEQ ID NO: 78326 - DNA, 201 bp, Homo sapiens
cagcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatc

SEQ ID NO: 78327 - DNA, 201 bp, Homo sapiens
acctgcccgtggtgaacgctgtgggagaggtgagcgaggccccggccctgcccccacctttgagagaggatcccctagccaggtgctgtttgtgcacccakgcttctcaccagaaacgtaggcatcccaccaggaggggagagtgtggcccaacactagctttgaaccctgctcggcttccgtgcactcgggaccctttcc

SEQ ID NO: 78328 - DNA, 201 bp, Homo sapiens
acttgggtcatgtgccactccttggctttgggggcaggcacgttgattgaaaattctatcaagacaggatgtaggagatggcttgttcccctctggagaawcaagctgctcttcccagattaaaggaaaccacagaagctgcagccaggtcctagggttcaggctcatttgaaccaccagcctgagccactcttttgaacc

SEQ ID NO: 78329 - DNA, 201 bp, Homo sapiens
atcgcttgaacccgggagacagaggctgcagtgagccgagatcgcgccattgcactccagcctgggcaatgagagcaaaactgtctcaaaaaaaaacaacaaaaaaaaaaaacaaacaaaatcaataaatttgaccacatcaaagtacatattgtatttataaagacaaaaactccaaataacaacaataaaacaccataa

SEQ ID NO: 78330 - DNA, 201 bp, Homo sapiens
agcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatca

SEQ ID NO: 78331 - DNA, 201 bp, Homo sapiens
cagccgagaaggaggacctcctgcagcagatgctggaaaggaggtgagagcctggcggggcccccactgcccgcagggctacacagcggtggggtgagccyttggctcagatgttgtgaggtggctcctgagtttcctgggaaagttggatggggagcgggctgggaacatggatcagaagcgctcccgctgagggtatcc

SEQ ID NO: 78332 - DNA, 201 bp, Homo sapiens
gcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatcat

SEQ ID NO: 78333 - DNA, 201 bp, Homo sapiens
tgatccttcggtcgcagcttgtcaccctgcttgtccgaggagtttgttactctgaaagccagtcggtaagtctctccgaggcagaaatcagccaggccagrcctgacgaagctcgaggggttgggcgctgccggcgggccgtgaacagtgccatagggaaagctgaatgcaaggcgagaagtgcagagtggacttagggga

SEQ ID NO: 78334 - DNA, 201 bp, Homo sapiens
ctacgactcccagaaaggtcccggcggacccccgtgcgcagcgggacgcagtgggcgccagggaccgcagtgccccgggcccagcgctcttctccaggtgmtcgccggggaggcaggtttaaaaggcaggagccggaagccgtctcggcgcccaggtggccgagaatccagtcaccaggtcactgagtcaccgatgggggc

SEQ ID NO: 78335 - DNA, 201 bp, Homo sapiens
tgtgaacacagcccccatcctcgccactgtcatcacacggcgttctcctgtgtatcttctctcctttccctaaggacgcttgtcaccggatttggggcccrccctaatccagcatgggttcatctgaactcggtcacatctgtagagaccttgtttccagaaaggtcgcattcataggtactagggcttaggacttggcca

SEQ ID NO: 78336 - DNA, 201 bp, Homo sapiens
agaagtaaaggaccatttcaggaaccaagttcaggctaccaagtggcctccgggaaagccagaacccagagtgtaggggagtgctggctccacacctcccygcagcgccatgatgttcttcaggcccagctgcttagctttgtgcagatggcccgtgatctcctccaggcgctgacggcagcaggtcatgtgcaggatggt

SEQ ID NO: 78337 - DNA, 201 bp, Homo sapiens
tactccacgctgtgttctttcggtccaacccggaggctctgagagctacacctgtggttcagtgagtcagccagatgtgtgattccagcccttggctgcaracaggtgagcattctctaagtgcggtcggccatccacatttgtgggtcctgcatccatggaattacgtagggtcaaccaactgtggagcaaatatattca

SEQ ID NO: 78338 - DNA, 201 bp, Homo sapiens
tattttaatgaatggagttatagggttttctctaccttgatagtcagtcaactagaaaacccttctgttgaatatctttctaaaaagtgccccttcttccygtctcaggaagagttcattgcacatatttgactctttatttgataaatttagggtcttacaaaatgttagaatcccattttgacatccattctcattata

SEQ ID NO: 78339 - DNA, 201 bp, Homo sapiens
attttttttatagaaatggggttttgctgtgttgcccaggctggttttgaactcctgggctcaagcaatctgctggcctcggcctcccaaagtgctgggaytacatgcgtgagccgctgcacccagcccacccatttacccagttgtggtaaatgctgtagcagaattagcagttcaggggtagtatgtggagcgtgctgc

SEQ ID NO: 78340 - DNA, 201 bp, Homo sapiens
gatctctgggggccttctgaaagcactgcccacacaaatagagaaggaaggaaagcaaatgtaaggtgacattggctgagtgcagtggctcatgcctgtartcccagcactttgggaggctgaggtgggtggatcacttgaggtcaggagctcgagaccagcctgaccaacatggtgaaaccccgtctctactaaaaatac

SEQ ID NO: 78341 - DNA, 201 bp, Homo sapiens
ggtgaccagccccttttctgaagccatctaagggcccccagccgccactcatctcattagcaaacaaaagataccacggctcaaaaaaaaaaaaagacaamgtatgtttgtgtgtgtgtgtgtgtgtgtgtgtgtgtgtgtgtgtgtgtgtgtgtgtattgttggggctcagaaaatgatacctggaaatatggtgctttg

SEQ ID NO: 78342 - DNA, 201 bp, Homo sapiens
tctcagaacaaaagctgccccatctgtgcttgccttgcaggctgctcttcttacacatcacagaattcaattcaaatcatcacagtgacccagctactggraaggctgaggcagaaggattgcctgagcccaggagttcaaggccagcctgggcaacatagcgagactccatctcttaaaaaaacaaaaaacacacctgta

SEQ ID NO: 78343 - DNA, 201 bp, Homo sapiens
tacctacaatgacatggccacactcttcttcaacccgcaggagtctgccatcctccagctcttccaccaggatggtgagtgtctgcactgcagcccaatcrtgggtgattggtgtcatctcggacacagccaggcttgcccttcattccaagcaagaccaggacttctttgtaacgcccacccagacaaaagattggtttc

SEQ ID NO: 78344 - DNA, 201 bp, Homo sapiens
gaatatacaagtgccgtgtacaacagtgtggacacttttgaaatacacacaataatttcaggttagtggtttctcccaggggagagaggaaggaaaactgtttttttttttgttttgttttgtttcttaaaatggtactgaatgttttcttttttaaaaatacctggagcatatatggcatgttgttgagatttgttaaag

SEQ ID NO: 78345 - DNA, 201 bp, Homo sapiens
attcataggtactagggcttaggacttggccatatcttttggtggggggacacattcaccccccagccactttacttagtgctttctcacttaaacttccwaataagccatttgcatctcatgaatcaggaagaaagggagtgcagacagatcaggggacttgcccagggtgccacagctaggacttggccaaggacttgg

SEQ ID NO: 78346 - DNA, 201 bp, Homo sapiens
catttgcatctcatgaatcaggaagaaagggagtgcagacagatcaggggacttgcccagggtgccacagctaggacttggccaaggacttggtttgactrgagagctctcactctggagcgcttgctgctgctgcaccacctgcctcagcagcctggagctgggcatattcaggcatcaaggggaggggctctaaggtga

SEQ ID NO: 78347 - DNA, 201 bp, Homo sapiens
cttctctgctgtgtggagctgcttttggacgtttagttgccaatgtcctaaaaaggtactctgtgtgtgtgcgtgtgtgtgcgcatgtgcatgtgtgtgcrcgtgtgcgtgtgtatgcatgtgtgtgcgtgtgcgtgcgttgatgtgtctgtgcccatgcatgcacatatgtgcataggcacaagagtatgagctgtaggt

SEQ ID NO: 78348 - DNA, 201 bp, Homo sapiens
cataggttatatgcaaatatacaccattttatatctgggacttgagcatccctggattttggtatccatcgggatcctggaccctatccctggtgaatackgaggaacaactgtactctttccttgttgcttctctgtaaccacttgaatctctcagatccccattggggcccttgtcttggaggacagcctcttcagtgt

SEQ ID NO: 78349 - DNA, 201 bp, Homo sapiens
ccagcccaccctctcctggtgctgcctggggaggcaaatcatgctcactccggcgggcacagctggctggggctgttccggggcatggaagattcccagtyacccactcactcagaaagccgggagtcatcggacaccttgctggtcagaggtcctgggggtggttttgaaccatcagagcttggacttttctgacttccc

SEQ ID NO: 78350 - DNA, 201 bp, Homo sapiens
tccatcgggatcctggaccctatccctggtgaatactgaggaacaactgtactctttccttgttgcttctctgtaaccacttgaatctctcagatccccaytggggcccttgtcttggaggacagcctcttcagtgtccccagttatatgtatatattatatatatatatatatatatatatatacacacacacactatat

SEQ ID NO: 78351 - DNA, 201 bp, Homo sapiens
gcgggcacagctggctggggctgttccggggcatggaagattcccagtcacccactcactcagaaagccgggagtcatcggacaccttgctggtcagaggycctgggggtggttttgaaccatcagagcttggacttttctgacttccccagcaaggatcttcccacttcctgctccctgtgttcccaccctccagtgttg

SEQ ID NO: 78352 - DNA, 201 bp, Homo sapiens
cttgttgcttctctgtaaccacttgaatctctcagatccccattggggcccttgtcttggaggacagcctcttcagtgtccccagttatatgtatatattwtatatatatatatatatatatatatacacacacacactatatatatacacacacacacacacacacacacacacaaacacacattatatatttctgtttg

SEQ ID NO: 78353 - DNA, 201 bp, Homo sapiens
ggagatgccagtgacaacatacagttcatgactaggtttaggaattgggcactgagaaaattctcaatatttcagagagtccttcccttatttgggactcytaacacggtatcctcgctagttggttttaagggaaacactctgctcctgggtgtgagcagaggctctggtcttgccctgtggtttgactctccttagaac

SEQ ID NO: 78354 - DNA, 201 bp, Homo sapiens
atatgccacgcatgtgccatatttgtaagccaactcccacgatttatccgttatcagctggactcccatagcaccctgggttgtaactgtgggtgaaaagrcctgtctcctttctctttccccagttccctgagacaggaccggtgtcctgcctggggtatccccagagtttggcacacggtgatagccaacattcactga

SEQ ID NO: 78355 - DNA, 201 bp, Homo sapiens
ggcccttgtcttggaggacagcctcttcagtgtccccagttatatgtatatattatatatatatatatatatatatatatacacacacacactatatatayacacacacacacacacacacacacacacaaacacacattatatatttctgtttgttttgtttttttaagacggagtcttactctgttacccaggccggag

SEQ ID NO: 78356 - DNA, 201 bp, Homo sapiens
aatggacaagtaaggccatgattttgctcatgtcctagtttcagaatgtataagctctgaggcctaaggaatgttgttattagggtaggaaacagtaactyacttttcttgggctgaaagaagcaacacacccattcctgagcatgtgtgagaatgtggagcagcccatgggctgggggctgcgggggcagggcaggggac

SEQ ID NO: 78357 - DNA, 201 bp, Homo sapiens
gtggatcacctgaggccaggagtttgagaccagcctggccaacatggtgaaatcccgactctactaaaaatataaaaattagccaggtttggtggcgggcrcctgtaatcccagctactctggaggctgaggcaggagaatcgcttgaacccggaaggcagaggttgcagtgaaccaagattgtgccatagcactccagcc

SEQ ID NO: 78358 - DNA, 201 bp, Homo sapiens
ttttctcttgctttagtttcagagcatctccttacggaagatccagtttaacttcccctatttccgaagcgacaggtatggaaaggttagaaattggtttyttttttggaaacaacatgttcatgcgctgcgggtcagactcgacacttgctctagcctggcagtatcccctgcggggaaacccgactgggagaagggggc

SEQ ID NO: 78359 - DNA, 201 bp, Homo sapiens
ggagaagggggcgggctttgaacttttcttctggaaataagaagccaaagcaccaggctggcatcgtgacttttattttgtcatgccgtaaggcctagaakcatctcaggcaaatgaagatggtcccagattaaaaacccaaccaagaaaggccacagacaggcatattcttaggaaggcgttttgtattccccagtgatt

SEQ ID NO: 78360 - DNA, 201 bp, Homo sapiens
gggtccaggcccggggtggaacatctcgaactatctttggagctctcactgccactgctggcactgccctccaagcaggggttgaggctgctgtttcctcwggcttcgttcaccatggctgggttcctactgcacagggtggggcagggagcatcagggggcaggcagccacacccccgacacatcaagacacctgagtgg

SEQ ID NO: 78361 - DNA, 201 bp, Homo sapiens
ctgtaacagccctgcaagacacagataacattttatttttttaaaaagttgttagtcccctaaaccaaagagcaacatatactgcagaaataaaaagttartcatagcaaaggagaagtaacagtatctggttttaataatagctcatatattccattggtacatatttacaaagggccaaactcaactaatttatttaaa

SEQ ID NO: 78362 - DNA, 201 bp, Homo sapiens
gaggtgtcctgaagaggagggtggttatttggagactatcagtggaaatgaagagctcagctgatggctgtagatcctcacccacatggtccctcaccccygaaaggttttttttgagggctggttcctatttgataatggctccagatgatttagaagctagccactgatttcagtaaatacttctgcctccttccactc

SEQ ID NO: 78363 - DNA, 201 bp, Homo sapiens
ccatctgtgcttgccttgcaggctgctcttcttacacatcacagaattcaattcaaatcatcacagtgacccagctactgggaaggctgaggcagaaggawtgcctgagcccaggagttcaaggccagcctgggcaacatagcgagactccatctcttaaaaaaacaaaaaacacacctgtaatcccagcactttgggagg

SEQ ID NO: 78364 - DNA, 201 bp, Homo sapiens
tgcgatctcggctcaccacaacctccacctcccaggttccagtgattctcctgcctcagcctccaaagtagctgggactacaggtgcgcgccaccatgccyggctaattttgtatttttagtagagacagggtttcaccatgttggctagactggtcttgaactcctgacctcaggtgatccacctgccttgacctcccaa

SEQ ID NO: 78365 - DNA, 201 bp, Homo sapiens
tcacttttatatgcactgggtaaccaaaacactcgtgtgactcactttattgtgatatttgctttattgtggtggtctagaaccaaacccatgctatctgyaaggtaggcctatgttggcatttattccctaggcctttatcctgccaaccagagttccccctgtcagtgcaccttgcccagcctcttaagagtccatcat

SEQ ID NO: 78366 - DNA, 201 bp, Homo sapiens
aaatccttaagctccatcagtactgctgtgttcgtttgcccatgcgcagtagcctgtggcctccccacccacagaaatccagcatcctcacccgggctggygagcagcgcaaacggagccagtccatgaagtcctacccatccagcgagctacggaacatgtgtgatgagcacatcgcctctgaggagccagccgagaagg

SEQ ID NO: 78367 - DNA, 201 bp, Homo sapiens
acaagtgccgtgtacaacagtgtggacacttttgaaatacacacaataatttcaggttagtggtttctcccaggggagagaggaaggaaaactgttttttkttttgttttgttttgtttcttaaaatggtactgaatgttttcttttttaaaaatacctggagcatatatggcatgttgttgagatttgttaaagctacag

SEQ ID NO: 78368 - DNA, 201 bp, Homo sapiens
agtaaaaaagagtccttggttatctcaccgccgtgcctcaggattctttctcctcgacgctggtacccgtgcggggaaacagagggtgacgcttggctggkgcccagctcccctggtttgtttgtggctcagctgtcagggcctccaaataagggtggagaggaggaaatggcaggcagccagcagcccgagacaaatgga

SEQ ID NO: 78369 - DNA, 201 bp, Homo sapiens
cattttttaaaatataaaaaagcacaccatttgtgctatgagaatttcagacaacacccagaaacaaatatctccttaagcactacctcacggatgttttyccattatgaatgctgacgtacaaataatcctaattttgtttaatcaaaaagggatattatacttttaattctccatcctgctttatttttattttttaat

SEQ ID NO: 78370 - DNA, 201 bp, Homo sapiens
cccagctgcttagctttgtgcagatggcccgtgatctcctccaggcgctgacggcagcaggtcatgtgcaggatggtctccaggccacagtagttcacggyggtgctggcgatcatcatggaggaggtctccttgtctgagccagggtcacctgctgggtgccaggtcacgtctatgtagagggggccacctgctgccatc

SEQ ID NO: 78371 - DNA, 201 bp, Homo sapiens
aaagcacaccatttgtgctatgagaatttcagacaacacccagaaacaaatatctccttaagcactacctcacggatgttttcccattatgaatgctgacktacaaataatcctaattttgtttaatcaaaaagggatattatacttttaattctccatcctgctttatttttattttttaattgcatcttgctcttttgc

SEQ ID NO: 78372 - DNA, 201 bp, Homo sapiens
caaataacaacaataaaacaccataaataaagtgaaaacaagtccacagcctgagagaggttatttactatgcatttaagaggcagataattagtatccasaatacaggaagaggctgggcgcggtggctgacgcctgtaatcccagcactttgggaggccgaggcaggcggatcacttgaggtcaggagttcaagaccag

SEQ ID NO: 78373 - DNA, 201 bp, Homo sapiens
gaaattatttttctttaaaaagtgcaagtctggccactttgggaggccaaggcgggcagatcacctaagatcgggagtttgagaccattctgaccagtgtrgagaaaccccgtctctagtaaaaatacaaaattagccggtaaaaatacaaaattagccgggcgtggtggcgcatgcctgtaatcccagctactcgggcga

SEQ ID NO: 78374 - DNA, 201 bp, Homo sapiens
ttccagctccaggtaaccccagtgcacctgctacctttatcccataccacgaggaagaatccagaaatgtatgaccttcctctgttgagaactaatagatrtgttgggttcatccttccacacccattacctgagcgttgagagatatgggaatctgtagtcgtctttttacctcagagaaagtgcacaccacatgccctg

SEQ ID NO: 78375 - DNA, 201 bp, Homo sapiens
gttctcattgtaaccctaacatgtgagaataaaatgtcttctgtctcctctgtctcctttagccttttgtctccatgctgctttctttctttctttctttytttgagacagagtctcgctgtcacccaggctggagtgcagtggtgccatctcagctcactgcaagctccgcctcccaggttcacgccattctcctgcctc

SEQ ID NO: 78376 - DNA, 201 bp, Homo sapiens
  misc_feature (1)...(201): n = A,T,C or G, or insertion/deletion polymorphism (see Tables 1-2)
accagagaaaatctaattaatactctcattttctgaatgttcccccctaaaaacaacaaaaaccccactaggagtggaatttgaggcctccccaaccaccnaccaaaaaaggagggtgaaatgaaaggaagaagaaaaactcagcattctttcctctgacaaagagtaaaacgacaaggaatatcggcctgaattctcttc

SEQ ID NO: 78377 - DNA, 201 bp, Homo sapiens
ggtaccttgttcagtctagaggagggttcgtccttctggaaccaagggctcacgtggaaagtggtgaggaggaccttcagtgaaagcattaaccacacccmccgaattacactgggtgtcccttactcggtacatggaatggtagttttgatgagactgggggggtcaactggatcagaaacagctttcctcttgtgccca

SEQ ID NO: 78378 - DNA, 201 bp, Homo sapiens
gttcatgactaggtttaggaattgggcactgagaaaattctcaatatttcagagagtccttcccttatttgggactcttaacacggtatcctcgctagttkgttttaagggaaacactctgctcctgggtgtgagcagaggctctggtcttgccctgtggtttgactctccttagaaccaccgcccaccagaaacataaag

SEQ ID NO: 78379 - DNA, 201 bp, Homo sapiens
ttcttctccaggctggcccgccccctctgactaggcacccaaagtgagcatctgggcattgggcattcatgcttatcttcccccaccttctacatggtatyagtcccagcaggcatccctggggcagacgtgctttggctcaagatggccttcatttacgtttagttttttttaaaaccgtggaggttgcccacgggcctc

SEQ ID NO: 78380 - DNA, 201 bp, Homo sapiens
gcccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagt

SEQ ID NO: 78381 - DNA, 201 bp, Homo sapiens
ccaacaggcgttcagggataccagatcaccctccagagaaggaacagctcactctggctggctctgcctggaacatctgttacttgaaacagttcgtgcayaggatggaaggggtgagggcttgactatgcagccagatttctcctgaattcatgctactccaaaaagaccgtgttgtgggttagaacttgatgctggcca

SEQ ID NO: 78382 - DNA, 201 bp, Homo sapiens
gtgacaggaaagcctttcgagaggcccaaggtggcctcgccagccctgcagtattgatgtgcagtattgcaccacagctctgcggaccttggccattgccrcagtcgcagcttccttttttctgtttgcactgtttgtttgtatgatgttagctaattccactgtgtatataaattgtattttttttaatttgtaaaatgc

SEQ ID NO: 78383 - DNA, 201 bp, Homo sapiens
aacttcttaaagcccaatctagagttggtcatacctggggtgtatctactgtaagggtgactagatctctgtacccggatgtagattccggaggtctctgygtagagcagtgggtaccaggaggaagggttgggagagagtaggacatgccactcctgaaccttcttgtcttttgtcacctctcccctagctcttttgttc

SEQ ID NO: 78384 - DNA, 201 bp, Homo sapiens
cccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtg

SEQ ID NO: 78385 - DNA, 201 bp, Homo sapiens
agggcagatcgatcagaggagtcccaggggccccgcccgagggcacctccatctctctgggctgggctgacttccccggtccagggaggcacctcagggarggggctgagagcagcccccgcttcttcattcggctcactgagcacttgtgggggcacgacctcatcttctaaaggcatcttttcttccaaatggtccagc

SEQ ID NO: 78386 - DNA, 201 bp, Homo sapiens
ctctagaattcatctcctcctgctagcagccgcgtcctggaggagcagcggatggggaatccattctgtttcttcctggtgtttaggaagttgccccacamacagattgccccgatgtccaaccagaagaagtgaaactgctgctgggtctggagaggtgaagacccgtggccagcttctgttgttgccatcggccattgc

SEQ ID NO: 78387 - DNA, 201 bp, Homo sapiens
ccttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtgc

SEQ ID NO: 78388 - DNA, 201 bp, Homo sapiens
cggccattgctttttgttcgcttgcttttggttttgcaagaagagcggcctctgtctctgatctgcttcaaatcatcattccatcagtgacagaagtggcygttccatcagtggtcgcagccagttcagctcctgcatccatccccaagtgttctgtaagtcccaggggcattttctgccttgtgtttttgtcatttttca

SEQ ID NO: 78389 - DNA, 201 bp, Homo sapiens
cttgtcttggaggacagcctcttcagtgtccccagttatatgtatatattatatatatatatatatatatatatatacacacacacactatatatatacacacacacacacacacacacacacacaaacacacattatatatttctgtttgttttgtttttttaagacggagtcttactctgttacccaggccggagtgca

SEQ ID NO: 78390 - DNA, 201 bp, Homo sapiens
cagtggtcgcagccagttcagctcctgcatccatccccaagtgttctgtaagtcccaggggcattttctgccttgtgtttttgtcatttttcaatcagttycattcaatgagaactccctgtgttacctgtgttacggtgacaccttgagaatgggctacttcccctcctagcaacccgcaacaccatcccagacctcagg

SEQ ID NO: 78391 - DNA, 201 bp, Homo sapiens
tgtcttggaggacagcctcttcagtgtccccagttatatgtatatattatatatatatatatatatatatatatacacacacacactatatatatacacayacacacacacacacacacacacaaacacacattatatatttctgtttgttttgtttttttaagacggagtcttactctgttacccaggccggagtgcagt

SEQ ID NO: 78392 - DNA, 201 bp, Homo sapiens
cgcaaggagcaagttactacttcatttcctcttttcccaatttctggacaagaccaaggcaatttgaccaacatttatggggcatcaactctgagagtgcygaaggggcatttgccctcaaagagcttgcagtctagggacgtagacacaagcaattgcacataggcaactcgtgttgtgtgctattataacagttacatg

SEQ ID NO: 78393 - DNA, 201 bp, Homo sapiens
tgctggaacggaaacttcttaaagcccaatctagagttggtcatacctggggtgtatctactgtaagggtgactagatctctgtacccggatgtagattcyggaggtctctgcgtagagcagtgggtaccaggaggaagggttgggagagagtaggacatgccactcctgaaccttcttgtcttttgtcacctctccccta

SEQ ID NO: 78394 - DNA, 201 bp, Homo sapiens
caagtgatccacccatctcggcctcccaaattgctaggattacaggtgtgtcaccacgcccagcctggtttatatatatatgtttttgtttttgtttttgytttttttttggcaaagtctcactctgttgcccaagctggagtggagtggcaagatctcggctcactgcaaactccacctcctgggttcaagcgattctcc

SEQ ID NO: 78395 - DNA, 201 bp, Homo sapiens
atctcttaaaaaaacaaaaaacacacctgtaatcccagcactttgggaggccgaggtgggtggatcacctgaggccaggagtttgagaccagcctggccarcatggtgaaatcccgactctactaaaaatataaaaattagccaggtttggtggcgggcgcctgtaatcccagctactctggaggctgaggcaggagaatc

SEQ ID NO: 78396 - DNA, 201 bp, Homo sapiens
aatggctccagatgatttagaagctagccactgatttcagtaaatacttctgcctccttccactcctaaccactaaaaaaggctccctctgcggatctgtktttctagaccatccttggagaaacacaggaggaggaggatgagattcttccaaggaaagactatgaggtgagctcctttgatactgcttgggcaactaaa

SEQ ID NO: 78397 - DNA, 201 bp, Homo sapiens
tatgaatattttaatttcccagtgctagtggcagttgcttttttttttttttttttttgagacggagtcttgctctgtcgcccaggctggagtgcagtggygccatctctgctcactgcaagctccgcctcccgggttcacgccattctcctgcctcagcctccggagtagctaggacttacaggcgcctgccaccacgcc

SEQ ID NO: 78398 - DNA, 201 bp, Homo sapiens
gaggcaggagaatcgcttgaacccggaaggcagaggttgcagtgaaccaagattgtgccatagcactccagcctgggcgacaaaagcaaaactccatctcaaaaaaaaaaaacaaaaacaaaaaacagaaacaagtaatcagagccaccagggcacagacaggccaacagagggcatagggtcatctggcagtctggttaa

SEQ ID NO: 78399 - DNA, 201 bp, Homo sapiens
ctaattttttgtatttttagtagagacggggtttcaccgtgttagccaggatggtctccatctcctgacctcgtgatccacccgccttggcctcccaaagygctgggattacaggcgtgagccaccgcgcctggcctttttttttttttttttttttttttgagacagtctcgctctatcacctaggctggactgcagtgg

SEQ ID NO: 78400 - DNA, 201 bp, Homo sapiens
ccatttcagcctcccgagtagctggactacagatgttcaccaccatacccggctaattttttttcttttatttttagtagagacgaggtctctctttgttrcccaggccggtctcgaacatctgaactcaatttatcctcccacctcagcctcccaaagtgctgggattacaagtgtaagctgctgcaccaggcgtgagct

SEQ ID NO: 78401 - DNA, 201 bp, Homo sapiens
ctgtgtggagctgcttttggacgtttagttgccaatgtcctaaaaaggtactctgtgtgtgtgcgtgtgtgtgcgcatgtgcatgtgtgtgcacgtgtgcrtgtgtatgcatgtgtgtgcgtgtgcgtgcgttgatgtgtctgtgcccatgcatgcacatatgtgcataggcacaagagtatgagctgtaggtcctcccca

SEQ ID NO: 78402 - DNA, 201 bp, Homo sapiens
ggggtttcaccgtgttagccaggatggtctccatctcctgacctcgtgatccacccgccttggcctcccaaagtgctgggattacaggcgtgagccaccgygcctggcctttttttttttttttttttttttttgagacagtctcgctctatcacctaggctggactgcagtggcgcgatctctgctcactgcaacctctg

SEQ ID NO: 78403 - DNA, 201 bp, Homo sapiens
tgggattacaggcgtgagccaccgcgcctggcctttttttttttttttttttttttttgagacagtctcgctctatcacctaggctggactgcagtggcgygatctctgctcactgcaacctctgcctcctgggttcaagtgattctcctgcctcagcctcccaagtagctgagagtacaggtgcccgccaccacacccag

SEQ ID NO: 78404 - DNA, 201 bp, Homo sapiens
tctcaggcaaatgaagatggtcccagattaaaaacccaaccaagaaaggccacagacaggcatattcttaggaaggcgttttgtattccccagtgattcasttggtcagccaccctcctgggtcagaaggtactcttagtagacttcttagccctgtatcagatgtgtgtgttactgacctgccggcctcgtaaggctctt

SEQ ID NO: 78405 - DNA, 201 bp, Homo sapiens
gcacacatgttgactgaccaggggctgctgtgaatgctgtttggagaaatcggggctgggggtaggcagggttatgttttgaatttctgagaccagagctkctttctgtggcgttgtaacagctgtgctttgcctcctagagtcttagagagcctccttgtgtctctggtaaccaccgtggtggtgtttgtggcctcgatg

SEQ ID NO: 78406 - DNA, 201 bp, Homo sapiens
tccaggatccctgcctattcattcacaggtgtgagaaaatgttcatgataaggaagtcagaaaccaccttttgggggctgggggctctttattggataacycgtctctctcctctcctcagagacaagagagactttgtatcagcaggagcggctgctggagttgctgcagctttcggggcgccaatcgggggtaccttgt

SEQ ID NO: 78407 - DNA, 201 bp, Homo sapiens
cctggcaagcctccttgttctcattgaggtgaggtggtttggattcacctgctcgcttaggaggttttagagtcccgcactccttttccccacctccttcmagaatgtcaggaaactgagaatgcagattcctgcagaaagtggcctcttgttcactaaaggtaaaggtttcacctctggtgagattaaagaagaaaggcc

SEQ ID NO: 78408 - DNA, 201 bp, Homo sapiens
cacttagaaagttagcaccgggagaggaagcagaaccaaattcacggtgaatcacggccatagtgacattttcatcatgagtgtggatgaacaaaaggccmtcatcccgattctttcatctgtgcattcagaatgtgaagaatacacttgcccgtgtggctgccgttggtagaggtcagtttttggcctgtttgattgatg

SEQ ID NO: 78409 - DNA, 201 bp, Homo sapiens
ccaagcaagaccaggacttctttgtaacgcccacccagacaaaagattggtttctgcctcctgtgttggaaggggaactggtatggggtgtggtcgggccyggtaggtctactgggccttggcaggcatccggtagtgggactcaggttggctcttcccttgcaggtactttcagccccgtcactctggccttgttcttcg

SEQ ID NO: 78410 - DNA, 201 bp, Homo sapiens
ccttgcatgagtttaccttgagatgagattgacagctccctcagcagttcgaggagggaagaattccagggagaaccacttgtcaccagattccaatcgcsgcctcatcttctcccggagtctctcatgccgctcggggtccaggcccggggtggaacatctcgaactatctttggagctctcactgccactgctggcact

SEQ ID NO: 78411 - DNA, 201 bp, Homo sapiens
caaaccactttatctacagttagcataagatgtgagaagtgttgacaggaagctgcagcttagatgggatgatcacaactccatggcaacaagatgacacraatgcagcagagaccccaggggacaggagcctcttgcagtctgtccctaggcccagccctgcttgtcctccctggctgttatcttcggtactgcaaagag

SEQ ID NO: 78412 - DNA, 201 bp, Homo sapiens
tacagttagcataagatgtgagaagtgttgacaggaagctgcagcttagatgggatgatcacaactccatggcaacaagatgacacaaatgcagcagagamcccaggggacaggagcctcttgcagtctgtccctaggcccagccctgcttgtcctccctggctgttatcttcggtactgcaaagagaacacagacatatc

SEQ ID NO: 78413 - DNA, 201 bp, Homo sapiens
caagccctccaggtgacgctcacgctgctaatgaaggtggccagctctccctcttccgccgcccagattgttgagggtaagccagagaaccaatggatttygagttatgggtgtgcctgctctcctccatcagccggtggcagcaggttccgggatacccgaggtcaaatgctatctgaatggcgtaaaggtgccaggaat

SEQ ID NO: 78414 - DNA, 201 bp, Homo sapiens
aacaagatgacacaaatgcagcagagaccccaggggacaggagcctcttgcagtctgtccctaggcccagccctgcttgtcctccctggctgttatcttcrgtactgcaaagagaacacagacatatctggcttggtgacctggctgtcctggaaaagtcagcttcatgtatgagtgtgcccatcctctgaacttgattac

SEQ ID NO: 78415 - DNA, 201 bp, Homo sapiens
ggttttaataatagctcatatattccattggtacatatttacaaagggccaaactcaactaatttatttaaaaaaaaaagaagcgtggcacagtggctcaygcctatatgctcagcactttgggaggccaaggcaggaggatcgcttaaagccaggagttcaagaccatcctgggcaataaagtgagactttgttcctaca

SEQ ID NO: 78416 - DNA, 201 bp, Homo sapiens
tgagctgagaacgtgtcaacacataacaagtgtgcagtgctgagtccctgcaagatggccatcatagttgtctttattggttgcttgtagcatgcctagcrctgtgctgagaactttatggaaatgattttattttgatcaccatccccaggtggtagatagcattgtccttgcttacaagggaacagaactgagcccgag

SEQ ID NO: 78417 - DNA, 201 bp, Homo sapiens
agccaggcccacctccatccccacctcttccacggctgaaaaatcaaaagccttttatttccttatcactggaaagaagtcatcttagtcatacaacgggyggagcactgcaaacgggtgggagaatccagaatccgggtgttgccagattccagcccagagtttggcttcacgattctctgggggtatgccttgggctgc

SEQ ID NO: 78418 - DNA, 201 bp, Homo sapiens
agggatgatcgttgctgactttgaaaatgatgttttgtttctttggtttaatatggaggtcactaagggctgaagactggggacagtttccctagaaaacraagcccaaggcaaaaggtcactcgctaaagttttgtgggggttcctattcaaaggaagcaagagtgaggcggagtgagaggctgttttagttaactactg

SEQ ID NO: 78419 - DNA, 201 bp, Homo sapiens
agggtgacgcttggctggtgcccagctcccctggtttgtttgtggctcagctgtcagggcctccaaataagggtggagaggaggaaatggcaggcagccarcagcccgagacaaatggatccagatgctcaagctggcctcacacctgcctcatccgccacgtgggcagacctctggcctcagacagggctgccttcaccc

SEQ ID NO: 78420 - DNA, 201 bp, Homo sapiens
gcatggtggctcacgcctgtaatactagccctttgggaggctgaggcaggaagatctcttgagctcaggagttccagacaagactgagcaacataaggaamcctgtttttaataaataaacaaacaaaaaacaaaacaaaaaccaagtcaccccaaaccttagcaacttcacacaatgcacatctattatctcatcacctc

SEQ ID NO: 78421 - DNA, 201 bp, Homo sapiens
ctttgggaggctgaggcaggaagatctcttgagctcaggagttccagacaagactgagcaacataaggaaccctgtttttaataaataaacaaacaaaaamcaaaacaaaaaccaagtcaccccaaaccttagcaacttcacacaatgcacatctattatctcatcacctctgtgctctgtggatcagggatctggccctg

SEQ ID NO: 78422 - DNA, 201 bp, Homo sapiens
gatcgcaccactgcactctagcctgggcaacagagtgggactcggtctcaaaaaataaataaataaatgaatgaataaagtagaaatcttccctgcctacyttgcaggattgttgtggagcccaagtgagctgagaacgtgtcaacacataacaagtgtgcagtgctgagtccctgcaagatggccatcatagttgtcttt

SEQ ID NO: 78423 - DNA, 201 bp, Homo sapiens
ggaggaccttcagtgaaagcattaaccacaccccccgaattacactgggtgtcccttactcggtacatggaatggtagttttgatgagactgggggggtcractggatcagaaacagctttcctcttgtgcccataacctccacactggactttctgtacttctcatatcaataccctccctaaccccaaatcaaaccgct

SEQ ID NO: 78424 - DNA, 201 bp, Homo sapiens
cccatttccatccccagttcctcttacccggaagctgttacagcccagtccgctctgggctccaatcctgtccatcctgcccccgaagcagctggatctcygcaggctccgaggggcagtgagcagcgccctcagcttgctttttaggagggcagatcgatcagaggagtcccaggggccccgcccgagggcacctccatc

SEQ ID NO: 78425 - DNA, 201 bp, Homo sapiens
aggctgaggcaggagaatcgcttgaacccggaaggcagaggttgcagtgaaccaagattgtgccatagcactccagcctgggcgacaaaagcaaaactccrtctcaaaaaaaaaaaacaaaaacaaaaaacagaaacaagtaatcagagccaccagggcacagacaggccaacagagggcatagggtcatctggcagtctg

SEQ ID NO: 78426 - DNA, 201 bp, Homo sapiens
atcgcttgaacccggaaggcagaggttgcagtgaaccaagattgtgccatagcactccagcctgggcgacaaaagcaaaactccatctcaaaaaaaaaaamcaaaaacaaaaaacagaaacaagtaatcagagccaccagggcacagacaggccaacagagggcatagggtcatctggcagtctggttaagaaaataagac

SEQ ID NO: 78427 - DNA, 201 bp, Homo sapiens
ttccagccagagccgcgcctctaccaggctgtgtcttcctcctgaaatgttgctcttcactccgtaccactggtgttccttggttctccacctgcgtaggkatttgcgcattagatgagagaatttcaagcaaaatactttgagttttacaaagatataaaacacctagtaattattgctgcagactttccttttttcttc

SEQ ID NO: 78428 - DNA, 201 bp, Homo sapiens
aacccggaaggcagaggttgcagtgaaccaagattgtgccatagcactccagcctgggcgacaaaagcaaaactccatctcaaaaaaaaaaaacaaaaacmaaaaacagaaacaagtaatcagagccaccagggcacagacaggccaacagagggcatagggtcatctggcagtctggttaagaaaataagacaaacactt

SEQ ID NO: 78429 - DNA, 201 bp, Homo sapiens
ggactgcagtggcgcgatctctgctcactgcaacctctgcctcctgggttcaagtgattctcctgcctcagcctcccaagtagctgagagtacaggtgccygccaccacacccagctaatttttgtatttttagtagagctggggtttcaccatgttggccaggatagtcttgatctcttgacctcatgatccgcctgcct

SEQ ID NO: 78430 - DNA, 201 bp, Homo sapiens
tgagagaggatcccctagccaggtgctgtttgtgcacccaggcttctcaccagaaacgtaggcatcccaccaggaggggagagtgtggcccaacactagckttgaaccctgctcggcttccgtgcactcgggaccctttcccctgcctgccagcagatggcaccagcgtcccactggccgtcctttccagccagagccgcg

SEQ ID NO: 78431 - DNA, 201 bp, Homo sapiens
caggtgcccgccaccacacccagctaatttttgtatttttagtagagctggggtttcaccatgttggccaggatagtcttgatctcttgacctcatgatcsgcctgcctcggcctcccaaagtgctgggattacaggcgtgagccaccgtgcccagcccccccccttttttttttaagcattttctcagcagactagctaa

SEQ ID NO: 78432 - DNA, 201 bp, Homo sapiens
ctggggtttcaccatgttggccaggatagtcttgatctcttgacctcatgatccgcctgcctcggcctcccaaagtgctgggattacaggcgtgagccacygtgcccagcccccccccttttttttttaagcattttctcagcagactagctaaggacaatagatggcatgtcctgacacccatggggcactctgggtgtt

SEQ ID NO: 78433 - DNA, 201 bp, Homo sapiens
tcaagtgatcctcctgcctcagcctcccaaagtgttgggattacaggcatgagccattgcacccagtcatctcaggcagtttttaaaaaatttttatatakagagaaaaagtgcactcagcagccagcatgatccaaaggagaagcagctgcaccctctcaagtgatgacggggacacccctcggctgatgaacaagtttc

SEQ ID NO: 78434 - DNA, 201 bp, Homo sapiens
agagtttgaggttatagtgagctatgatcatgccactgcactccagccttggtgacagagcaagactctgtctctatttaaaaaaaaaaaaaaaaaaaaaaagccagctcctgtcagatgttggttgagcactgctcaggtcaatgtcaattccccagcacttcctgccggccccaaggagctgagtgggctgcggctgcc

SEQ ID NO: 78435 - DNA, 201 bp, Homo sapiens
gagtttgaggttatagtgagctatgatcatgccactgcactccagccttggtgacagagcaagactctgtctctatttaaaaaaaaaaaaaaaaaaaaaaagccagctcctgtcagatgttggttgagcactgctcaggtcaatgtcaattccccagcacttcctgccggccccaaggagctgagtgggctgcggctgcca

SEQ ID NO: 78436 - DNA, 201 bp, Homo sapiens
cacagtgatttagctcaagcccagtcttcttttgtctgtgctttcgttatccacttctcctttctcatattattattttttattgtatgtgtgtgtgtgtktgtgtgtgtgtgtgtgtgtgtgtgtgtgtgtgtgtgtgtgtgttttaaagtaaagacagtctccctatgttgcccaggctgttctcgaactccttgacac

SEQ ID NO: 78437 - DNA, 201 bp, Homo sapiens
gtgatttagctcaagcccagtcttcttttgtctgtgctttcgttatccacttctcctttctcatattattattttttattgtatgtgtgtgtgtgtttgtktgtgtgtgtgtgtgtgtgtgtgtgtgtgtgtgtgtgtgttttaaagtaaagacagtctccctatgttgcccaggctgttctcgaactccttgacaccagc

SEQ ID NO: 78438 - DNA, 201 bp, Homo sapiens
tgcctgctctccacgtggaatttagcttaaaactggttggccaagatgtatttcttcccctctgccaccataaccctgtaaactgaatcattcttttcctrtgtgaacagaaaggtcgaagatatgaggcggtgaagtggatggtggtgtttgccattggagtctgcactggcctggtgaggaggcagggcctggagggat

SEQ ID NO: 78439 - DNA, 201 bp, Homo sapiens
aactggttggccaagatgtatttcttcccctctgccaccataaccctgtaaactgaatcattcttttcctgtgtgaacagaaaggtcgaagatatgaggcrgtgaagtggatggtggtgtttgccattggagtctgcactggcctggtgaggaggcagggcctggagggatggtgggccatagggctggaggggcttacag

SEQ ID NO: 78440 - DNA, 201 bp, Homo sapiens
gatagtcagtcaactagaaaacccttctgttgaatatctttctaaaaagtgccccttcttcctgtctcaggaagagttcattgcacatatttgactctttrtttgataaatttagggtcttacaaaatgttagaatcccattttgacatccattctcattataggtggtttgaaaaatggtaactttctgtgagatgtgcc

SEQ ID NO: 78441 - DNA, 201 bp, Homo sapiens
tctttcctttttcaccctgcccagggctcttcgtggggaaggaaggccccatgatccacagtggttcggtggtgggagctggcctccctcaggtaagatgrgctgagagggtgtgggcctctgggcaggcctagtgggaggtctggttacactgggccaaatccattgggacaccctgacatcacattggaacctggtgcc

SEQ ID NO: 78442 - DNA, 201 bp, Homo sapiens
ttggtgtcatctcggacacagccaggcttgcccttcattccaagcaagaccaggacttctttgtaacgcccacccagacaaaagattggtttctgcctccwgtgttggaaggggaactggtatggggtgtggtcgggcccggtaggtctactgggccttggcaggcatccggtagtgggactcaggttggctcttcccttg

SEQ ID NO: 78443 - DNA, 201 bp, Homo sapiens
tcctctgacaaagagtaaaacgacaaggaatatcggcctgaattctcttcccaagaagaaagaaagcacaccaacgcaggcatttgtcttctgtccatggkgctgaagtttattcactttcaaaccactttcagtaacaggtgaggttctaccttaaaatttaatgcatggggtgggagaggcgaggaagtcaccatcaaa

SEQ ID NO: 78444 - DNA, 201 bp, Homo sapiens
gccgtttgtatagtttaatatgctactctgatgggactgctttgaatgaaccaaaaagcactgtatccactgctgtgttttgttctatttctttttttttyttttttttaaatttgagatggagtctcactcttagtgcccaggttggagtgcaatggctcgatctcagctcactgcaacctccaccccaccctaggttca

SEQ ID NO: 78445 - DNA, 201 bp, Homo sapiens
tcaccatcaaaccactttatctacagttagcataagatgtgagaagtgttgacaggaagctgcagcttagatgggatgatcacaactccatggcaacaagrtgacacaaatgcagcagagaccccaggggacaggagcctcttgcagtctgtccctaggcccagccctgcttgtcctccctggctgttatcttcggtactg

SEQ ID NO: 78446 - DNA, 201 bp, Homo sapiens
tttgtatttttagtagagacgaggcttctccatgttggtcaggctggtcttgaactcctggcctcgggtgatccgcccgccttggcctcccaaagtgctgrgattacagacgtgagccactgcgcccagctaattcctacagtcaattttagaatattttcatcacctgagaggaaaccctgcactcattagcagccactg

SEQ ID NO: 78447 - DNA, 201 bp, Homo sapiens
ctgcctcctggattcaagcgattctcctgcctcagccttatgagtagctgggattataggcacgtgccaccgcatccagctaatttttgtatttttagtaragatggggcttctgacatcaggtgatccacccgccttggcttcccaaagtgttgggattacaggcgtgagccaccacgcctggccttgttatcctttctt

SEQ ID NO: 78448 - DNA, 201 bp, Homo sapiens
ccaggatagtcttgatctcttgacctcatgatccgcctgcctcggcctcccaaagtgctgggattacaggcgtgagccaccgtgcccagcccccccccttytttttttaagcattttctcagcagactagctaaggacaatagatggcatgtcctgacacccatggggcactctgggtgttggggcagaaacttgagaggg

SEQ ID NO: 78449 - DNA, 201 bp, Homo sapiens
gagatgatttaaaagtatataggaggacctacataggttatatgcaaatatacaccattttatatctgggacttgagcatccctggattttggtatccatygggatcctggaccctatccctggtgaatactgaggaacaactgtactctttccttgttgcttctctgtaaccacttgaatctctcagatccccattgggg

SEQ ID NO: 78450 - DNA, 201 bp, Homo sapiens
aaaaggaaaatacagggaaagggataaacctcactgacttggaggaaatcaagaggagtgagcacagcatcagaaagccccctggccccagactgcacccrctttcctggccctaccttgaaatccatcaggtctgcgttggacacggcattgtacatgggattagctctggtctgacctaggagctggaatgccagtaaa

SEQ ID NO: 78451 - DNA, 201 bp, Homo sapiens
tcagtgtccccagttatatgtatatattatatatatatatatatatatatatatacacacacacactatatatatacacacacacacacacacacacacamacaaacacacattatatatttctgtttgttttgtttttttaagacggagtcttactctgttacccaggccggagtgcagtggcgcgatcttggcccactg

SEQ ID NO: 78452 - DNA, 201 bp, Homo sapiens
aaatcaagaggagtgagcacagcatcagaaagccccctggccccagactgcacccgctttcctggccctaccttgaaatccatcaggtctgcgttggacayggcattgtacatgggattagctctggtctgacctaggagctggaatgccagtaaaaggaggaagctcacggtggtggtggagaaggagctcatgctggcg

SEQ ID NO: 78453 - DNA, 201 bp, Homo sapiens
gctacagtttgctgtgccctgatctaaagggggacccaagtgctgtgtttattttattattattgtttttcttttttgggacaggatctcactctgtcgcytaggctggagtagggtggcatgattatagctcactgcaacctatgcctcccaggctcaagcgatcctccacctcagcctcctgagtagctgggatcacag

SEQ ID NO: 78454 - DNA, 201 bp, Homo sapiens
aaagggggacccaagtgctgtgtttattttattattattgtttttcttttttgggacaggatctcactctgtcgcctaggctggagtagggtggcatgatyatagctcactgcaacctatgcctcccaggctcaagcgatcctccacctcagcctcctgagtagctgggatcacaggcgcgtgccaccacacctggctaat

SEQ ID NO: 78455 - DNA, 201 bp, Homo sapiens
ttcgcttgcttttggttttgcaagaagagcggcctctgtctctgatctgcttcaaatcatcattccatcagtgacagaagtggctgttccatcagtggtcrcagccagttcagctcctgcatccatccccaagtgttctgtaagtcccaggggcattttctgccttgtgtttttgtcatttttcaatcagtttcattcaat

SEQ ID NO: 78456 - DNA, 201 bp, Homo sapiens
gctgcaggtggtgctgctgctgcggtgagcgtgagacccgcacccccgaggagctggtaagaagccggcggagtcggcctggggagggggcggttgctaarggactgagagaggcgttgccgggggtggggccgggccaatctgggcccgcaggtggcagcgggtggggcctggggaccgcagccagggctctcgaagcgt

SEQ ID NO: 78457 - DNA, 201 bp, Homo sapiens
gggcaacatggcaaaaacccatttgtactaaaaatacaaaaaattagctgggtgcagtggtgcgtgcctgtcatcccagctaccctggacactgaggtggragaatcaccacagcccaagaagttgaggctgccgtgagccatgaccaagccactgcactccagcctgggtgacagagtgagaacctgtctcaaaaagaac

SEQ ID NO: 78458 - DNA, 201 bp, Homo sapiens
gcggtggctgacgcctgtaatcccagcactttgggaggccgaggcaggcggatcacttgaggtcaggagttcaagaccagcctggccaacatggtgaaacsctgtctctactaaaaatacaaattgagctgagtgtggtggtgtgcacctttagtccagatacttgggaggcagaggcaggagaatcacttgaacccagga

SEQ ID NO: 78459 - DNA, 201 bp, Homo sapiens
gttgaggctgccgtgagccatgaccaagccactgcactccagcctgggtgacagagtgagaacctgtctcaaaaagaacaaaagccaggcatggtggctcrcgcctgtaatactagccctttgggaggctgaggcaggaagatctcttgagctcaggagttccagacaagactgagcaacataaggaaccctgtttttaat

SEQ ID NO: 78460 - DNA, 201 bp, Homo sapiens
gaaagcaaatgtaaggtgacattggctgagtgcagtggctcatgcctgtaatcccagcactttgggaggctgaggtgggtggatcacttgaggtcaggagytcgagaccagcctgaccaacatggtgaaaccccgtctctactaaaaatacaaaaattagccaggcatggtggtgtgcacctgtagtcccagctactcggg

SEQ ID NO: 78461 - DNA, 201 bp, Homo sapiens
tcgggaggctgaggcaggagaatcatgaagggcagggctctgcaggaaggttgacttatttgggagtgtcttagtttaagttctcttgaaccggagacagrtattccagtattagtggctgatcttggagacaaacccaggaaatgtcagtggagagtggggaagtgatacagaaaaagtagaagtcagtgaccacctctg

SEQ ID NO: 78462 - DNA, 201 bp, Homo sapiens
cgggaggctgaggcaggagaatcatgaagggcagggctctgcaggaaggttgacttatttgggagtgtcttagtttaagttctcttgaaccggagacagakattccagtattagtggctgatcttggagacaaacccaggaaatgtcagtggagagtggggaagtgatacagaaaaagtagaagtcagtgaccacctctgg

SEQ ID NO: 78463 - DNA, 201 bp, Homo sapiens
catggcagcatactcctgtaatcccagctacttgggaggctgacgtgggaggatcgcttgagcccaagagtttgaggttatagtgagctatgatcatgccmctgcactccagccttggtgacagagcaagactctgtctctatttaaaaaaaaaaaaaaaaaaaaaaagccagctcctgtcagatgttggttgagcactgc

SEQ ID NO: 78464 - DNA, 201 bp, Homo sapiens
aagctgtgtctggctgtgcactatccaggcctccacattctgtgacaaactaacagggccggctcctgtcactcctgttctcgccagcgggttttaccctkaaggtgactcaggccttctctttgccctagatcgtggggatcatcacacggcacaacctcacctatgaatttctgcaggcccggctgaggcagcactacc

SEQ ID NO: 78465 - DNA, 201 bp, Homo sapiens
ttcagaagagccccccaccccgcccgtggtctgagcagggctggagagccagcacagcttgctcccaggggcctgcgggcactgtcatgaggctggatgayttgccctcctcccccaggctgagagccagcgacatcatggagcccaacctgacctacgtctacccgcacacccgcatccagtctctggtgagcatcctgc

SEQ ID NO: 78466 - DNA, 201 bp, Homo sapiens
ccgtttgtatagtttaatatgctactctgatgggactgctttgaatgaaccaaaaagcactgtatccactgctgtgttttgttctatttctttttttttcytttttttaaatttgagatggagtctcactcttagtgcccaggttggagtgcaatggctcgatctcagctcactgcaacctccaccccaccctaggttcaa

SEQ ID NO: 78467 - DNA, 201 bp, Homo sapiens
gagtatgtatttgccattaaactgtttgcttttacagcttacagagagacttagagtgaaaggcactggcaggcagtatgtgcccctaacaggtgtgtgcytataaactgttaaggaggccttgcttctcttctaggagagcttgcttttcagatattttcttgctcaagcagcttctctctgacatgttcttgattaagt

SEQ ID NO: 78468 - DNA, 201 bp, Homo sapiens
atgcaaggcgagaagtgcagagtggacttaggggaggagtcgccacagccgggtggtgagaagcaacagcggtttattccttcatagttcaaggccagaartacaaaatccgggtgtcaccagggcagcgctccctggctctggtgctgtccttgccccttcctagctcatgggagttgcctgcagaccttggtgctcctg

SEQ ID NO: 78469 - DNA, 201 bp, Homo sapiens
agcatgtgtcgggggatagaagtacaaaggaatgcatcgggtttgagggagagctggggcagttcagaagagccccccaccccgcccgtggtctgagcagrgctggagagccagcacagcttgctcccaggggcctgcgggcactgtcatgaggctggatgacttgccctcctcccccaggctgagagccagcgacatcat

SEQ ID NO: 78470 - DNA, 201 bp, Homo sapiens
cctaataagccatttgcatctcatgaatcaggaagaaagggagtgcagacagatcaggggacttgcccagggtgccacagctaggacttggccaaggactyggtttgactggagagctctcactctggagcgcttgctgctgctgcaccacctgcctcagcagcctggagctgggcatattcaggcatcaaggggaggggc

SEQ ID NO: 78471 - DNA, 201 bp, Homo sapiens
tgtgtgtgcgtgtgcgtgcgttgatgtgtctgtgcccatgcatgcacatatgtgcataggcacaagagtatgagctgtaggtcctccccacagcctatcartgtggttcaaagccatgttctcggtgttttccttcactagctacattggattgggccacatctattcggggacctttgccctgattggtgcagcggcttt

SEQ ID NO: 78472 - DNA, 201 bp, Homo sapiens
caccattttatatctgggacttgagcatccctggattttggtatccatcgggatcctggaccctatccctggtgaatactgaggaacaactgtactctttycttgttgcttctctgtaaccacttgaatctctcagatccccattggggcccttgtcttggaggacagcctcttcagtgtccccagttatatgtatatatt

SEQ ID NO: 78473 - DNA, 201 bp, Homo sapiens
gcttttttctgccgggttaaagggcagcccagcctcagggctgacagtttgctccccaggcaccaccactcccgcctcccaccttaaccttgcatgagttyaccttgagatgagattgacagctccctcagcagttcgaggagggaagaattccagggagaaccacttgtcaccagattccaatcgccgcctcatcttctc

SEQ ID NO: 78474 - DNA, 201 bp, Homo sapiens
ctgcctgtgtgtggtgcccaggatgactcactacccacaatgcctactgacactactggcggggatgggatcctgcggatcctcagcgtggggcccaggargaagtaaaggaccatttcaggaaccaagttcaggctaccaagtggcctccgggaaagccagaacccagagtgtaggggagtgctggctccacacctcccc

SEQ ID NO: 78475 - DNA, 201 bp, Homo sapiens
ggtcacctattgggtctgcagggttggtggaggtcatagtcactgggtctcacccaacctccagagaccctttctgttccctctacctagccccgacaccsaggactgcgagtccctggaaggcagaaacttcatattatttaggtttggttcgtctctttctagcacttggtaagacagcaggagggaaaaaagcagccc

SEQ ID NO: 78476 - DNA, 201 bp, Homo sapiens
gcatttcagataagtgttactcaagctgaagcaactttacctcctacctttgtattttaggaaggcacacctgcctttatgacatagcactcccaactctygtccattgatgtgtggccactttatggcttcagtatcaaaaagcctccaggcattggcttgagggaaggccagagttaaaggcaagaagctttgatcctg

SEQ ID NO: 78477 - DNA, 201 bp, Homo sapiens
tgctacacttggaaataaggctgtgtgacagatctcttgctcttcacaggtgggtctctttgtggacttttttgtgcgactcttcacccaactcaagttcrgagtggtacagacatgtatccttttcacggttcctggtgttcgtggacttcagtggtcaccaagattctttcttacatagaaatgggtctaacagtaagc

SEQ ID NO: 78478 - DNA, 201 bp, Homo sapiens
ctgtaacgacctgtaacaaatgactcccataggtcactttgcaaggtggtgagtatgaggcatggcaggggtcataatctcaggagacttcaagggccccmccgcttgcacatctgtgaagcaggctggtcatgatgggagctgagcgctgagcatgtgccctgtggaaggacattttagttcagatgccagctggcccaa

SEQ ID NO: 78479 - DNA, 201 bp, Homo sapiens
gactgaggcaggggaattgctggaacccagaaggcggaggttgcaatgagtggagattgtgccattgcactccagcctgggcaacaagagtgaaactctayctcaaaaaaaaaaaagaaaaaaaagtgcaagtcctcccattgcccctcagacctcctgagtcagatcctctggagtggggcccagcagctgtggttctgc

SEQ ID NO: 78480 - DNA, 201 bp, Homo sapiens
tggagtgtcatagaatctgatgaggttgggatccatgggggtaacaggtgggaaaacagtttactctgtttaaggtgaacttattgcctggtgttttgtgytcagagcaaataccctcttcaggagcagatacaaaaagccggcatcttctccagcagctcttagtaaaatacaagcccaggcccttcagacccggattag

SEQ ID NO: 78481 - DNA, 201 bp, Homo sapiens
gttccccagatggggtctagaaggagaggcagcctggaggactgggtctgctctccaggcattatggaggtgggttttcttttgcagcaaattcaggtgctttttttttttttgtagcaaattgcagcaaaatcaaaggctttttctatttggaaccagagttggggctttcggtcaagtggtgccctggattttcctccc

SEQ ID NO: 78482 - DNA, 201 bp, Homo sapiens
cttcaggagcagatacaaaaagccggcatcttctccagcagctcttagtaaaatacaagcccaggcccttcagacccggattaggcaaagactatgtctgktttccaaatacttgttagtacacaaaaggcacatgaacttgtagtttgtctgcatggcaaacctttcttcactttgctcagtttttatttttttgagaca

SEQ ID NO: 78483 - DNA, 201 bp, Homo sapiens
aggcatattcttaggaaggcgttttgtattccccagtgattcacttggtcagccaccctcctgggtcagaaggtactcttagtagacttcttagccctgtrtcagatgtgtgtgttactgacctgccggcctcgtaaggctctttcaatcagagactcagtttagagtcacggaccaccttctttttgtattcctgcaagt

SEQ ID NO: 78484 - DNA, 201 bp, Homo sapiens
tttttaaatttgagatggagtctcactcttagtgcccaggttggagtgcaatggctcgatctcagctcactgcaacctccaccccaccctaggttcaagcrgttcttctgccccagcctcccgagtagatgggattacaggcgcccaccaccatgcccggctaatttttgtatttttagtagagatagggtttcaccatgt

SEQ ID NO: 78485 - DNA, 201 bp, Homo sapiens
caccccaccctaggttcaagcggttcttctgccccagcctcccgagtagatgggattacaggcgcccaccaccatgcccggctaatttttgtatttttagyagagatagggtttcaccatgttggccaggctggtctcgaactcctgacctcaggtgatactgcttcggtctcccagagtgctgggattacaggtatgagc

SEQ ID NO: 78486 - DNA, 201 bp, Homo sapiens
taggacttacaggcgcctgccaccacgcctggctaattttttgtatttttagtagagacggggtttcaccgtgttagccaggatggtctccatctcctgayctcgtgatccacccgccttggcctcccaaagtgctgggattacaggcgtgagccaccgcgcctggcctttttttttttttttttttttttttgagacagt

SEQ ID NO: 78487 - DNA, 201 bp, Homo sapiens
tcatggagcccaacctgacctacgtctacccgcacacccgcatccagtctctggtgagcatcctgcgcaccacggtccaccatgccttcccggtggtcacrgagaaccgcggtaacgagaaggagttcatgaagggcaaccagctcatcagcaacaacatcaagttcaaggtaaagaaaacggcatgagaggaaaggcagg

SEQ ID NO: 78488 - DNA, 201 bp, Homo sapiens
tatcacctaggctggactgcagtggcgcgatctctgctcactgcaacctctgcctcctgggttcaagtgattctcctgcctcagcctcccaagtagctgaragtacaggtgcccgccaccacacccagctaatttttgtatttttagtagagctggggtttcaccatgttggccaggatagtcttgatctcttgacctcat

SEQ ID NO: 78489 - DNA, 201 bp, Homo sapiens
gtcccaggggccccgcccgagggcacctccatctctctgggctgggctgacttccccggtccagggaggcacctcagggagggggctgagagcagcccccrcttcttcattcggctcactgagcacttgtgggggcacgacctcatcttctaaaggcatcttttcttccaaatggtccagcaaattctttagaaaaggaaa

SEQ ID NO: 78490 - DNA, 201 bp, Homo sapiens
ggcgccaatcgggggtaccttgttcagtctagaggagggttcgtccttctggaaccaagggctcacgtggaaagtggtgaggaggaccttcagtgaaagcrttaaccacaccccccgaattacactgggtgtcccttactcggtacatggaatggtagttttgatgagactgggggggtcaactggatcagaaacagcttt

SEQ ID NO: 78491 - DNA, 201 bp, Homo sapiens
ctccatggtcaggcgaaaggaagttattttttagtatataaagtcagctgagaaccaaatgtgatgaagctcccaggaatccaacccccaaatagaaatascaagaaaaggcgggggagcacaagcatcctctctccaaagctcctcctcttccatgtcccccgcgaccctcctccagcatgctgcggggacaggcttaga

SEQ ID NO: 78492 - DNA, 201 bp, Homo sapiens
ttaactgtccactttttacaaacaaattgctggaatacagcaaatcacggatcaattctgcacacatgttgactgaccaggggctgctgtgaatgctgttyggagaaatcggggctgggggtaggcagggttatgttttgaatttctgagaccagagcttctttctgtggcgttgtaacagctgtgctttgcctcctagag

SEQ ID NO: 78493 - DNA, 201 bp, Homo sapiens
acctcctgcagcagatgctggaaaggaggtgagagcctggcggggcccccactgcccgcagggctacacagcggtggggtgagcctttggctcagatgttktgaggtggctcctgagtttcctgggaaagttggatggggagcgggctgggaacatggatcagaagcgctcccgctgagggtatcccaggcagcatctggt

SEQ ID NO: 78494 - DNA, 201 bp, Homo sapiens
ctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctcca

SEQ ID NO: 78495 - DNA, 201 bp, Homo sapiens
gaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccacc

SEQ ID NO: 78496 - DNA, 201 bp, Homo sapiens
agtggtgaggaggaccttcagtgaaagcattaaccacaccccccgaattacactgggtgtcccttactcggtacatggaatggtagttttgatgagactgrgggggtcaactggatcagaaacagctttcctcttgtgcccataacctccacactggactttctgtacttctcatatcaataccctccctaaccccaaatc

SEQ ID NO: 78497 - DNA, 201 bp, Homo sapiens
gagatgccagcaacagaaatggacttcgacctccttaagaaagagaaagaaatccacaggaaagctcaggacagctgggaaagctgaaggaccagaaccaygtgctgtggggagcagtgcagggtctagcagacatcccttgggtaccaggaggaaggagcactggccctgggttcctcctgattccgattcagaatccag

SEQ ID NO: 78498 - DNA, 201 bp, Homo sapiens
tggagaagggatctcctccttctgcgcttttctgctgtgcattcacgtactgctggctggtgagcagcctccgtatgtgcagtgggggaggagatgccttyaagaggagcacacctgtactatacttgtgctacacttggaaataaggctgtgtgacagatctcttgctcttcacaggtgggtctctttgtggactttttt

SEQ ID NO: 78499 - DNA, 201 bp, Homo sapiens
ttgtcctttccccaaggatttttaatttgacccatgaaaatttcctctcaagtgaaggaccagagagaaatgagcagagggctaggtacaacttccagggrcacatctcacccattagcctctgccgtgcgggaaagcagccccactcttgcttctgtcttctcttctgtctcttccggttctcatggctgctatggtttt

SEQ ID NO: 78500 - DNA, 201 bp, Homo sapiens
ccgtccaggcagggagccaaagtcagtcttcgcttgagggttggcggtcgctggaagtggtagccattgggagttacactaatcccgcgaagggtgcgcargggaggcggcagccccccccaagaagagaggcaggccggcctccagcgctccccgcccacaagcacgtccttgcccccgggaggttgtttgccggctcca

SEQ ID NO: 78501 - DNA, 201 bp, Homo sapiens
ctctgcagcacacgcagctggagagggcttctgtccctgtcagcggcagagggcgttggggctggccggggcaccttgtccctgctatggtccacatgctmacgctgtccacctgccaggtggagtgtatgtggctgtggccctccctcgtggaggtgccgtgctttaaagaggccttagtgcccgggatgggcacagtgt

SEQ ID NO: 78502 - DNA, 201 bp, Homo sapiens
aaagccaaggcccagagtggtgggcgggaggcagttcttccccaccgctcctcacctctctctgtctcctcccgtcccacccccaagtctgttcacacagygagcctgcagttttcaaggtggcttgtcaaggacatctcctgacatgcacgttcacctcctgaccttgttcctgctgtaaatttgtgaattaagtgggga

SEQ ID NO: 78503 - DNA, 201 bp, Homo sapiens
aggctcgtagacgcggttcgggggcggtcgcagcccagggccccccagccacccgcgaactcacccgttgactccgaccttcaccttccccatggtgtctsagcgatgtggctcggctgcgcggagggagagaacagtgagcgcctagtggccccggccgacacacacgcctcccctcccctcccccaccaggcctccatg

SEQ ID NO: 78504 - DNA, 201 bp, Homo sapiens
tgcccgctgcagctcagctccaggctgagctccactaaccagtcagcgtcagagcccagtgcgagccctgacttcctccacctgtcagcctccctggggcygcccacagaatagcttcttccatgtttggccaacagcagatagcctaggactggagcgaggagaggaaaaggccttgttctctgaagtagtggtgccagc

SEQ ID NO: 78505 - DNA, 201 bp, Homo sapiens
ctggagtgatcctcccaccccagccttctgagtagctgggcccacaggtgtgtgccaccatacccagctaatttttatttgtatttttttgtagagatggkgtctccctgtgtttcccaggcaggtcttaaactcttgggcttaagtgatcctcctgcctcggcctcccaaagtactagaattagagacatgagccatgtg

SEQ ID NO: 78506 - DNA, 201 bp, Homo sapiens
ggtgacatttacagcctggcctttggggtcgggtcaacgctaggctggcaggggaagggcggggccgtgaggtgagccggcgctgcaggaaggggccaccrccagaggggccattttgcggtggaaatgtccttttccaactacccatgactcagcttctcccggcttggcaccatgccacagccaccacacctctgcggg

SEQ ID NO: 78507 - DNA, 201 bp, Homo sapiens
caggctggccgcttctccacgggccctgccttcctcacctgatgatcttgaggctgttgtcatacttctcatggttcacacccatgacgaacatgggggcrtcagcagagggggcagagatgatgacccttttggctcccccctgcaaatgagcctacagcagagaagcagacagttatgaacccgggtcctgcctttgca

SEQ ID NO: 78508 - DNA, 201 bp, Homo sapiens
ccgggggaaatgattttgagatgattcaaacattacatttattgtgtactttattactatttttaaaaattattattattatttttagagacagagttttrctcttgttgcccaggctggagtgcaatggcgcaatcttggctcactgcagcctccgcctcccgggctcaagcaattctcctgcctcagcctcccaagtag

SEQ ID NO: 78509 - DNA, 201 bp, Homo sapiens
cagcagcgcaactgcgaggacatgatccagatgttccaggtgaggacggagctgccctctgctctcaggggtgggtggggcaggtggatgcttccgtggcrgctggcctggaacgcaggccctgcctcctgcttggggagccttacctggcaactggggccctcacggggctagactggggggtaaggagcagcatcagga

SEQ ID NO: 78510 - DNA, 201 bp, Homo sapiens
cagcctagatccctcgcatgcacagttcacgtaaggtagggttcaggatcctgtgagaatctaatgccgccgcggatctgacaggaggtggagctcaggcygtaatgccagtgatggggagcagctgtaaatacagatgaagcttcactcacttgcccactgctcacctcctgctatttggcctggttcctaacaggccac

SEQ ID NO: 78511 - DNA, 201 bp, Homo sapiens
gaggatttctcaggctatgccatggcagctgcagaggcccagggagaggtaacctctgctcccggcctcagggccctctggctctgcctctccagcctgamgcccactcccccgctcctctccttgctctgtccccccatgtggctgtcatcctctacctgcgtctcccctcttcctttatccttttgcttttctttctcc

SEQ ID NO: 78512 - DNA, 201 bp, Homo sapiens
tgacaggaggtggagctcaggctgtaatgccagtgatggggagcagctgtaaatacagatgaagcttcactcacttgcccactgctcacctcctgctattyggcctggttcctaacaggccacagacaggtactggtccgtggcctggggtttggggacttctgcattaggggaaccgttaggaggacttgctgacctcag

SEQ ID NO: 78513 - DNA, 201 bp, Homo sapiens
gtgcagtgaggggacagcccaggaccagcgcagtacaggggatgaggggtgagccgggccccataggaacctgtgtggccctgggagcctgtggatctgcwccatcccgcccacactgactttcctcaccactcttatcagtcttaaaagaacacagcctgcagcagtacctttgcattcctccataggcaaagatttcca

SEQ ID NO: 78514 - DNA, 201 bp, Homo sapiens
tgacccactctgttgatacactatgtgtcctgcagatgcttttacagggttaaatgataccacaagaggcagggcagcgggctcgacgagctctgttctgrtgcgggcaggaggcgggagcccggatctgtgcgactgaaggtgggagactgggccgggtggacctggtggtctggtgtgggcaggaggtgggcaatgagg

SEQ ID NO: 78515 - DNA, 201 bp, Homo sapiens
aatggtgtattcgctgccttctgccttggtctggtttattttaaaatctgagccttcagtaatggctgcctgggcccccggcccagccactgctcttggcrtgttggcctcctggcgggggcaacagaggcgctgtgaacgccacctgttaaccccgatggccctgcctgccccaccacagctggagttggccacggccaa

SEQ ID NO: 78516 - DNA, 201 bp, Homo sapiens
caccggctgtgttatccccatccaagactcaggccaccctgaaacctaaggaccatcatcagccccttggaagggccaagggggttgagaagcagcagttsccagagcagccttttgagaaagctgccttccagaaacagaatgatacccccaaggggcctcagcctcccactgtgtctcccatccgttccagccgccccc

SEQ ID NO: 78517 - DNA, 201 bp, Homo sapiens
ccatcatgcctgacctcagcctctgagttcccaagacacaggcggggcccatttccctgtcagggtgggtttggagagagttcagtccctgccgctccctsgccatcccgcggccccgccctcgcttccggtacttctcacgggctgccagagggtgaggcagcaggaggaggagtgccgtccgtcttcaggattcctgcc

SEQ ID NO: 78518 - DNA, 201 bp, Homo sapiens
accggctgtgttatccccatccaagactcaggccaccctgaaacctaaggaccatcatcagccccttggaagggccaagggggttgagaagcagcagttgscagagcagccttttgagaaagctgccttccagaaacagaatgatacccccaaggggcctcagcctcccactgtgtctcccatccgttccagccgcccccc

SEQ ID NO: 78519 - DNA, 201 bp, Homo sapiens
gaagcggccatgtggggcactgccacccacagtctgggcacaagctttgtacatggtattcaccaccccactatgccaccccaggaatgcttgctgctgcytagctcagctgcaccctttagggagaaaacgcttgtacactcagcatcatcaaactcaaagggcaggagtaaaggtcagaaattaactggacagggcaag

SEQ ID NO: 78520 - DNA, 201 bp, Homo sapiens
ggacagggatgcacccgctgcgcactagcatcccggggcctgcggtgccggaggccgtgggggaggggctcctctgcgacacgtgaccccgcagagcgcgraaggaaagaaagcgtcccccacctaggggtccgggtcgggatctcgggcgggagtagggacctcctgtttctggggactaggggaaggaggctccgggca

SEQ ID NO: 78521 - DNA, 201 bp, Homo sapiens
agaaaccttttggcccaaggataggcagtgatttttttttttttttttttttttttgagacggtgtcttgctttgtcgctcaggctggactgcagtggtgsaatctcagctcattgcaacctccaccttccaggttcaagcgattcttgtgcctcagactcccaagtagctaggattacaggtgtgtaccaccatccctgg

SEQ ID NO: 78522 - DNA, 201 bp, Homo sapiens
acccgacgcttctaccctcatacccacaatatggatgggttcttcattgccaagttcaagaaattttccaattctatccctcagtcccagacaggtaagtratctttttcttcccttcgtcaccacctttgctctttccacctttcaggaggctttatggtgtgacaagaggaagggaaaggaaagattcatgcatccctt

SEQ ID NO: 78523 - DNA, 201 bp, Homo sapiens
gcacccgctgcgcactagcatcccggggcctgcggtgccggaggccgtgggggaggggctcctctgcgacacgtgaccccgcagagcgcgaaaggaaagamagcgtcccccacctaggggtccgggtcgggatctcgggcgggagtagggacctcctgtttctggggactaggggaaggaggctccgggcagatggcgccg

SEQ ID NO: 78524 - DNA, 201 bp, Homo sapiens
aaggataggcagtgatttttttttttttttttttttttttgagacggtgtcttgctttgtcgctcaggctggactgcagtggtgcaatctcagctcattgsaacctccaccttccaggttcaagcgattcttgtgcctcagactcccaagtagctaggattacaggtgtgtaccaccatccctggctaatttttgtatttt

SEQ ID NO: 78525 - DNA, 201 bp, Homo sapiens
ctactttctccccgcttttttttttccgcagccgcctggttcaactgggcacgcaccgagcgtgtgggccccgacgtaggggggaagggactgagattggyccgatgggaggtgatcggtgctggttcccaggactggactgtgggcagcaggacactagggagtcaaggacggggacccttacacgcttggatgaaacag

SEQ ID NO: 78526 - DNA, 201 bp, Homo sapiens
cggcctcccaaagtgctgggattacaggcatgagccaccgcacccggcctgtgcactttatttctattattattacattataatatataatgaaataattwtacatctcaccataatgtagaatcagtgggagccatgaacttgttttccgcaactagacggtcccatctgggggtgatgggagatagtgacagatcatca

SEQ ID NO: 78527 - DNA, 201 bp, Homo sapiens
ggagtctcatactctgttgcctaggctggagtgcagtggtgtggtctcagctcactgcagcctctgcctccggggtgcaagcgattctcctgcttcagcaygcctgtagctgggactataggcatgtgccatgaagcctggctgatttttgtaattttagtagagacggagtttcaccatgttggccaggctggtctcaaa

SEQ ID NO: 78528 - DNA, 201 bp, Homo sapiens
ctccccagcagtgagggtctctctcttcctcttgtgctcttgctggggctggtggtccaggggtcttactccttggaggccatgtgggccatgaggtccaycaccctgttgctgtagccaaattcgttgtcatacctagaagatgaaaagagttgtcagggccctttttctgagccagccaccagagggcgccagaccctg

SEQ ID NO: 78529 - DNA, 201 bp, Homo sapiens
ccctgcactttttaagagccagtctctggccccagccacataccaggaaatgagcttgacaaagtggtcgttgagggcaatgccagccccagcgtcaaagrtggaggagtgggtgtcgctgttgaagtcagaggagaccacctggtgctcagtgtagcccaggatgcccttgagggggccctccgacgcctgcttcaccac

SEQ ID NO: 78530 - DNA, 201 bp, Homo sapiens
atggcctctgcagcacacgcagctggagagggcttctgtccctgtcagcggcagagggcgttggggctggccggggcaccttgtccctgctatggtccacrtgctcacgctgtccacctgccaggtggagtgtatgtggctgtggccctccctcgtggaggtgccgtgctttaaagaggccttagtgcccgggatgggcac

SEQ ID NO: 78531 - DNA, 201 bp, Homo sapiens
agcggctcaagagtgttgtgggcaacttgcatcggctgggagtcaccaacaccattatcagccactatgatgggcgccagttccccaaggtgagactcgarctgtgtgtcttctgaggcttcttccggttgaccttctcccttcctgacctcaatgtttagactcgaccctagtaaatattgccctgctggttgcagaaga

SEQ ID NO: 78532 - DNA, 201 bp, Homo sapiens
gagcggctcaagagtgttgtgggcaacttgcatcggctgggagtcaccaacaccattatcagccactatgatgggcgccagttccccaaggtgagactcgrgctgtgtgtcttctgaggcttcttccggttgaccttctcccttcctgacctcaatgtttagactcgaccctagtaaatattgccctgctggttgcagaag

SEQ ID NO: 78533 - DNA, 201 bp, Homo sapiens
tgtggatgaagatttggctgtctgagaggagcccggccccaaggggcaagggaaagggatgtgatgccaggagtgctggctgtataccaagtggattcctyagatggctgataaccaagccgataggacaggagtgagagcagaggtagtgtcttgcagactccaacccaagccttgaggagggagcgggtgactgacagg

SEQ ID NO: 78534 - DNA, 201 bp, Homo sapiens
ccaaatctaagagacaagaggcaagaaggcatgaggaggggaggctcctccagaatatgtgagcagccctaggccacctccccattaagagggcgaatgcrgcatctccttacccccaggagggcccaagaggttgaattttatctcccttgagcttccctgccaggctggcctggcttaaggcatggctgcaactgaagg

SEQ ID NO: 78535 - DNA, 201 bp, Homo sapiens
aagctgctgtcacttaaaagaagtaatttagtatgtaggaccacataggtgtttggtaaaaatgggaaaaccacatcggtagacttgccgatcaccagggsctagtgcagagtggatcagcctatacagtaggcaggcttgttgggagcgaagttgccttgaggtgatgacacttctcatgtggattcctggacaggaggg

SEQ ID NO: 78536 - DNA, 201 bp, Homo sapiens
aaagccctggagtcagagctaggggtgattgaactccggggagaggagggcaatagaagtgtaggggaaggcggggcacactagctcatgcctgtaatccyagcactttctgggaggccaaggcgggtggatcacctgaggtcaggtgttcgagaccagcctggctaacatggcgaaacctcgtctctactaaaaatacaa

SEQ ID NO: 78537 - DNA, 201 bp, Homo sapiens
ggattacaggtgtgtaccaccatccctggctaatttttgtatttttagtagagatggtttcaccatgtgggctaggctggtcttgaactcctggcctcaarcaatccacttgccttggcctcccaaagtgctggaattacaggtgtgagccaccacgcctggcctataggcagtgatcttttaatacaaggttcaactagg

SEQ ID NO: 78538 - DNA, 201 bp, Homo sapiens
gaggagtctggcctggatctcaagggaagggtggggttttctgaaacagccttgagagcactgcttactgggatataaccctgggtttagttggaagaggsagagaagtgctactttagaaatagtagaatttgtctgggcgtggtggctcatgcctgtaatcccagcactcacctgaggtcaggaattcgacacggtgaa

SEQ ID NO: 78539 - DNA, 201 bp, Homo sapiens
tctcttttgtcatccataaaatgggatggtaattgtgcttgggttggcccttgtattacgcttggattgtgagggttaaaatgatgcgtttagaagtcctyggcagtgttcagcacatagtcagcagccataacttttattaagctgctgtcacttaaaagaagtaatttagtatgtaggaccacataggtgtttggtaaa

SEQ ID NO: 78540 - DNA, 201 bp, Homo sapiens
tctcgtcgtcctccacctccacctccaccacctattcctcgtcggcccgcttcatgcccggcaccatctggtcgttctcgcacgcccgccggctcgggccsggactggagcccactctggtgcaagggcctggcttgtcgtgggtgcacccggatggggtgggcgtccagatcgacaccatcacgcccgagatccgcgctc

SEQ ID NO: 78541 - DNA, 201 bp, Homo sapiens
gaggcaaggatatagcgtaaatttgggagactaaattgagtgaaactggaaggggctggtgagggaggggctgtaccttgcaacgagtgattctttcacascccaaggtttcccaaagaatattgatggaaaccaggtacctgctgtggtttcataggaaaagctccgggacctcaagccattgcttgagtaggtcaacaa

SEQ ID NO: 78542 - DNA, 201 bp, Homo sapiens
gaggtcaggagttcaagaccagctggtcaacatggtgaaacctcatctctactaaaaatacaaaaattagccggacatggtggcgcacggttgtgattgtycggaggctgaggcaggagaattgcttgaacccaggaggcagaggttgcagtgagccgagatcacaccactgcactccagcctgggtgacagagtgagatt

SEQ ID NO: 78543 - DNA, 201 bp, Homo sapiens
ctgattagctcatcgctctgcagcacgctgctgtgtagagagccttagctggattcggatggtgcgtgatactggcagtgactcttcttcctccctagatyccctgccctcattctggtctctttatagcaacactgtaactcctgtcttctgcctggaaggcctgggatggcttgagcgctacactgggaggtagctaaa

SEQ ID NO: 78544 - DNA, 201 bp, Homo sapiens
actcctgtcttctgcctggaaggcctgggatggcttgagcgctacactgggaggtagctaaaggcctcctgcgttctattttcagctcccctgccttgtgygtgacctttttttgagcccccattttcccaacataggaatggtccctgctttctctcttcaacccagggatacagttttttggaagagagatatttggtc

SEQ ID NO: 78545 - DNA, 201 bp, Homo sapiens
tcccagacaggtaagtaatctttttcttcccttcgtcaccacctttgctctttccacctttcaggaggctttatggtgtgacaagaggaagggaaaggaargattcatgcatcccttactccagcctttgcatgcttggctgagagaaccctctcattccagctagaattgcttttgagtgctggaccccatgtgaacagg

SEQ ID NO: 78546 - DNA, 201 bp, Homo sapiens
tgggccctccctaggaccgcgaggccgcggggcgggcccggtgcattctgtggatgaagatttggctgtctgagaggagcccggccccaaggggcaagggraagggatgtgatgccaggagtgctggctgtataccaagtggattccttagatggctgataaccaagccgataggacaggagtgagagcagaggtagtgtc

SEQ ID NO: 78547 - DNA, 201 bp, Homo sapiens
cttgtccagggttagcgtgcccttgacaggcttactgtctccctccagggactcgtgggctcccggcgcatgagggcaccacagttcatgccttcacatcrtagatgaagaaaccaagacccagaaaagataagggtcttagctaagaaaacataatctgatgcgactggttcccttagtggcctgactgtatgcatgaga

SEQ ID NO: 78548 - DNA, 201 bp, Homo sapiens
gcgggtgactgacaggctttggtttggcggcctcccctctcatctcagctattatgaccccttgtgggcgggcctgggaactacctatgcagcccagtgtrgcggagattcagcactgggtgaggattggccgaatgttctaggaaatgaccgctgggtctaggggcgaccttcagggatctccaccctgctggagtttac

SEQ ID NO: 78549 - DNA, 201 bp, Homo sapiens
ccgatgggaggtgatcggtgctggttcccaggactggactgtgggcagcaggacactagggagtcaaggacggggacccttacacgcttggatgaaacagraggactttgggaacgactgagatggggaattggagccggagcccagcaccgctcgcggctgcacgcggcctgccccctcccctttctttctttcaaaggc

SEQ ID NO: 78550 - DNA, 201 bp, Homo sapiens
gtaggtgaacaagtgcaattttagaagtaaatgcaaagtaaagaggcaaaacctacaagcattttgccttcagaagaagatgtagtgttctcctgcactartgatcccacccagaacacaaatgtggctctgtctcccgtgaaagcatcagatttgctttctgagctcagtatgcccatttcaataattgcaaagtgatgg

SEQ ID NO: 78551 - DNA, 201 bp, Homo sapiens
gggcactgggcactgggcactgggggcctggagaggaaggaggctcgggaggcggcttgagggggagggggaggtttctgcacggaaggtcacgatgtccygcagccctgtagcctggacctgataattagggcagacaatcccggccctgtgtgcaccagcggctctctccgggctggggccccaggcggaggacaggat

SEQ ID NO: 78552 - DNA, 201 bp, Homo sapiens
tgcctcagcctcttgagtagctgggactacaggtgtgcactaccatgtccatgcctggctattttttttttttctttttgcgttgtccaggccagtctcaractcctgacctgatcagcaggctttctgagcttgagtcctgtcctcgtgctggcttccttagttgtggtccatgttatgtgtccttgggagtttcagttg

SEQ ID NO: 78553 - DNA, 201 bp, Homo sapiens
gacacgtgaccccgcagagcgcgaaaggaaagaaagcgtcccccacctaggggtccgggtcgggatctcgggcgggagtagggacctcctgtttctggggwctaggggaaggaggctccgggcagatggcgccgcaagggcggagctgcacagggcgccacagcctgggtgcggggctccgccaggtccgagcgctgacct

SEQ ID NO: 78554 - DNA, 201 bp, Homo sapiens
tctgctgtctggccctgtaacctgtttccttctttctctaagttcccaccctctctgtccaatccacattatggcagctggtatcctccccgttctcttcwctcaggcagtcacgaacgtcatctccaggaagtttcattttgcttccccttgcggcccctgccctttgtacccaaaacaaagagaggcagtcgactgtcc

SEQ ID NO: 78555 - DNA, 201 bp, Homo sapiens
cggatttctttgattctgagccccgtgttttccacgtgtgacatttctgaaatcaggacaggtctcagaatcaatggcacctccaatatgggagtcttccytttagtgtctgaaaatggcttttaggtgagaaaataaagtgataaggagagaatggtaagaggattgggcccctttcagcagttagccaggcttgtatgc

SEQ ID NO: 78556 - DNA, 201 bp, Homo sapiens
gccccagccacataccaggaaatgagcttgacaaagtggtcgttgagggcaatgccagccccagcgtcaaaggtggaggagtgggtgtcgctgttgaagtmagaggagaccacctggtgctcagtgtagcccaggatgcccttgagggggccctccgacgcctgcttcaccaccttcttgatgtcatcatatttggcaggt

SEQ ID NO: 78557 - DNA, 201 bp, Homo sapiens
ctagtgttggcctgttggcctcccgtccacggctcctccccttctctttgctttccttccctttttcccctagccacccctaactccagagaaagacaagsaacaaaagtctcggtgttgcgtcacagaggtggcgcagcttctgagggcctggggttgcagagcagttagtgagcagcttctggggtggaggctctgcag

SEQ ID NO: 78558 - DNA, 201 bp, Homo sapiens
ctcccctcatcacagggctcggcctcagacccggaaaggtccagggtccggcctccaattggagcctgtcattggcttcccctcggcccgccccctgacckctgccccgctgccgagccgcctgattggtcggctctgtcccgccggcgccgcattggctcttctggctcgccttccatccctgctcctgcaccggtctgc

SEQ ID NO: 78559 - DNA, 201 bp, Homo sapiens
ggcagtttaaaaactggcaaggaacagaagggttgtgggggcagatttttatctaaagtcagggccatgatttgtgcatttgaccctgtgtaagttacacygcaacaagaaagtgaatttttaaaaatcacaaaaatactgcagatagacataaagccaaggccctagagtcagggtgctggaggctcagcagcttctctc

SEQ ID NO: 78560 - DNA, 201 bp, Homo sapiens
ccgttgactccgaccttcaccttccccatggtgtctgagcgatgtggctcggctgcgcggagggagagaacagtgagcgcctagtggccccggccgacacmcacgcctcccctcccctcccccaccaggcctccatgcccagcccgcgccgcatcacgtcctccgcccgcccctgcaatgcggaggccgcccgggcccacc

SEQ ID NO: 78561 - DNA, 201 bp, Homo sapiens
ccgggcagatggcgccgcaagggcggagctgcacagggcgccacagcctgggtgcggggctccgccaggtccgagcgctgaccttgagctctccttgcggrgaacagctaccctgcccccatacgactgcaaagacccggagcccgcaaggctcgtagacgcggttcgggggcggtcgcagcccagggccccccagccacc

SEQ ID NO: 78562 - DNA, 201 bp, Homo sapiens
tggtcgttgagggcaatgccagccccagcgtcaaaggtggaggagtgggtgtcgctgttgaagtcagaggagaccacctggtgctcagtgtagcccaggaygcccttgagggggccctccgacgcctgcttcaccaccttcttgatgtcatcatatttggcaggtttttctagacggcaggtcaggtccaccactgacacg

SEQ ID NO: 78563 - DNA, 201 bp, Homo sapiens
agggcaatgccagccccagcgtcaaaggtggaggagtgggtgtcgctgttgaagtcagaggagaccacctggtgctcagtgtagcccaggatgcccttgarggggccctccgacgcctgcttcaccaccttcttgatgtcatcatatttggcaggtttttctagacggcaggtcaggtccaccactgacacgttggcagtg

SEQ ID NO: 78564 - DNA, 201 bp, Homo sapiens
tgagcggctcaagagtgttgtgggcaacttgcatcggctgggagtcaccaacaccattatcagccactatgatgggcgccagttccccaaggtgagactcragctgtgtgtcttctgaggcttcttccggttgaccttctcccttcctgacctcaatgtttagactcgaccctagtaaatattgccctgctggttgcagaa

SEQ ID NO: 78565 - DNA, 201 bp, Homo sapiens
ctcccccttgcacccgaggccctcgcagcagggagctcagcgaggcagagggtggggctgcacagaggggaacatcagctgcagctctgcaccaggccggyccctggggactggggcgctcctccctcaggctttctccctcagtcttggcttctccagggctctggggtgtctggagctaggcttggccctaccattctg

SEQ ID NO: 78566 - DNA, 201 bp, Homo sapiens
tggaatagaatatgcactgcctgccatggctgatgagacatgacaaagctggctctgggaagcatgccctacctaggaccctgccctgtggcccagggtgycgtccggcccacttgcagtcttaatctctgaattctgggccctggaacaggctgtgtctagttctcatttgccgtactcaccgggcccctttacatactc

SEQ ID NO: 78567 - DNA, 201 bp, Homo sapiens
ccaccttggcctcccaaagtgctggggttacaggcgtgcgcgctctaccgaggtatgtacttttgtctccactaggtaagcacacgtgcaaagtgaggccsgggagtaactgcccaaagcaactgagccgttcagtggcagagccaggggtctggacctaggtcccagctacacgccttgcccctacccaagttcccctaa

SEQ ID NO: 78568 - DNA, 201 bp, Homo sapiens
gactataggcatgtgccatgaagcctggctgatttttgtaattttagtagagacggagtttcaccatgttggccaggctggtctcaaactcctgacctcargtgatacacccaccttggcctcccaaagtgctggggttacaggcgtgcgcgctctaccgaggtatgtacttttgtctccactaggtaagcacacgtgcaa

SEQ ID NO: 78569 - DNA, 201 bp, Homo sapiens
ccagctggctggccaggcattcctgtgccctgctcctccccatccagggaaccagaactggggtctgaggcctgagccagagaggtggggacagggagccrtgggggcagggaaggactctgtacctaagctctctccgcccttcccatgtctgtcaggtgggaagaggagtacacggtgcggatccagctgcaagaccgt

SEQ ID NO: 78570 - DNA, 201 bp, Homo sapiens
tgtccaggccagtctcaaactcctgacctgatcagcaggctttctgagcttgagtcctgtcctcgtgctggcttccttagttgtggtccatgttatgtgtycttgggagtttcagttgtcctgaaatcatcgttctgccacccagaaccagcctgctctgcccctgcaggagttaactacgcgctcagcagtggcacaggc

SEQ ID NO: 78571 - DNA, 201 bp, Homo sapiens
ggctggccaggcattcctgtgccctgctcctccccatccagggaaccagaactggggtctgaggcctgagccagagaggtggggacagggagccatggggrcagggaaggactctgtacctaagctctctccgcccttcccatgtctgtcaggtgggaagaggagtacacggtgcggatccagctgcaagaccgtgtaaat

SEQ ID NO: 78572 - DNA, 201 bp, Homo sapiens
ctacgcgctcagcagtggcacaggcacagttctggaatacatccataaccacaggaacaactgctgttctcaggagcattttttttttaaactgaaggagygtttgtccttggtccagctgtccaggacaggaaggagttattccttggggactgattagctcatcgctctgcagcacgctgctgtgtagagagccttagc

SEQ ID NO: 78573 - DNA, 201 bp, Homo sapiens
cagaggagaccacctggtgctcagtgtagcccaggatgcccttgagggggccctccgacgcctgcttcaccaccttcttgatgtcatcatatttggcaggkttttctagacggcaggtcaggtccaccactgacacgttggcagtggggacacggaaggccatgccagtgagcttcccgttcagctcagggatgaccttgc

SEQ ID NO: 78574 - DNA, 201 bp, Homo sapiens
ggcactggccatgccctccagggcttccgtttggccagggagcagtggcccgagccgccccatgcccagcatattcacacagtgctgtggggaggccaccrctacccaggaagaggggtgcagtcagctcagggagactccacagaagaggcaccggtgcaatgtggtgggaaggatgaggaccttgccaggcctaattcg

SEQ ID NO: 78575 - DNA, 201 bp, Homo sapiens
cagctgtccaggacaggaaggagttattccttggggactgattagctcatcgctctgcagcacgctgctgtgtagagagccttagctggattcggatggtrcgtgatactggcagtgactcttcttcctccctagattccctgccctcattctggtctctttatagcaacactgtaactcctgtcttctgcctggaaggcc

SEQ ID NO: 78576 - DNA, 201 bp, Homo sapiens
aagtggtcgttgagggcaatgccagccccagcgtcaaaggtggaggagtgggtgtcgctgttgaagtcagaggagaccacctggtgctcagtgtagcccargatgcccttgagggggccctccgacgcctgcttcaccaccttcttgatgtcatcatatttggcaggtttttctagacggcaggtcaggtccaccactgac

SEQ ID NO: 78577 - DNA, 201 bp, Homo sapiens
ccgaggcgggaagatcacgaggtcaggagatcgagaccatcctggctaacacggtgaaaccccgtctctacgaaaaatacaaaaaaaaaaaattagctggscgtggtggcaggcacctgtagtcccagctactcgggaggctgaggcaggagaatggcgtgaacccgggaggcggagcttgcagtgagccgagatcgcacc

SEQ ID NO: 78578 - DNA, 201 bp, Homo sapiens
aggcagtcgactgtccctggcactgagtttgtgctgcctgggccctgcctctccgcctgcctcagagtgtgggctgcagaatgggcccggggagggagacyggatttctttgattctgagccccgtgttttccacgtgtgacatttctgaaatcaggacaggtctcagaatcaatggcacctccaatatgggagtcttcct

SEQ ID NO: 78579 - DNA, 201 bp, Homo sapiens
ttagctcatcgctctgcagcacgctgctgtgtagagagccttagctggattcggatggtgcgtgatactggcagtgactcttcttcctccctagattcccygccctcattctggtctctttatagcaacactgtaactcctgtcttctgcctggaaggcctgggatggcttgagcgctacactgggaggtagctaaaggcc

SEQ ID NO: 78580 - DNA, 201 bp, Homo sapiens
cctgcctcagagtgtgggctgcagaatgggcccggggagggagaccggatttctttgattctgagccccgtgttttccacgtgtgacatttctgaaatcargacaggtctcagaatcaatggcacctccaatatgggagtcttccttttagtgtctgaaaatggcttttaggtgagaaaataaagtgataaggagagaatg

SEQ ID NO: 78581 - DNA, 201 bp, Homo sapiens
tgtcttcttggccccttcctaaccacctttcttgtgttgaagtttctctcttggtgcagttcccctcccttctcgggttgacagaagtgatgagctcacargaacaggatttgagatgtgctgctacgccagctagactgcagggccctggaatgccgggcgggtcctaagcagcacgttgccctggcttccatctctgtg

SEQ ID NO: 78582 - DNA, 201 bp, Homo sapiens
ctcagagtgtgggctgcagaatgggcccggggagggagaccggatttctttgattctgagccccgtgttttccacgtgtgacatttctgaaatcaggacasgtctcagaatcaatggcacctccaatatgggagtcttccttttagtgtctgaaaatggcttttaggtgagaaaataaagtgataaggagagaatggtaag

SEQ ID NO: 78583 - DNA, 201 bp, Homo sapiens
ctacctaggaccctgccctgtggcccagggtgtcgtccggcccacttgcagtcttaatctctgaattctgggccctggaacaggctgtgtctagttctcayttgccgtactcaccgggcccctttacatactctactttctctttccctctgggtttgagtgctagtaaccccaggctcgtgtgtccactgctgtcatgct

SEQ ID NO: 78584 - DNA, 201 bp, Homo sapiens
acaaagacccaagcttcctccagcttccaggatagcagtcagccagctggaaaagccgaagggatcagggagccaaaggtgactgggaagctaaagcaacratcacctaaattacagtcctccaagaaagttgctttcctcaggcagaatgcccctcccaagggcacagacacacaaacaccggctgtgttatccccatcc

SEQ ID NO: 78585 - DNA, 201 bp, Homo sapiens
tacctagatgaatcctgcttgaagaccttaggggctggccacgatgtcctcagataagacacgagggcacagaaagcaatagagcacgtgctcaagacctyacagctgcggaggccaagctggaattgcccgctgcagctcagctccaggctgagctccactaaccagtcagcgtcagagcccagtgcgagccctgacttc

SEQ ID NO: 78586 - DNA, 201 bp, Homo sapiens
taggaccctgccctgtggcccagggtgtcgtccggcccacttgcagtcttaatctctgaattctgggccctggaacaggctgtgtctagttctcatttgcygtactcaccgggcccctttacatactctactttctctttccctctgggtttgagtgctagtaaccccaggctcgtgtgtccactgctgtcatgctgctgt

SEQ ID NO: 78587 - DNA, 201 bp, Homo sapiens
cgaacaggaggagcagagagcgaagcgggaggctgcgggctcaatttatagaaaccgggggcgcggcggcaggcggtgactcggaccccgcctcccgccasgctcagccagtcccagcccaaggtcttgaggcctgagctacgtgcgcccgtaaaaccgctagtagccgggccctactttctccccgcttttttttttccg

SEQ ID NO: 78588 - DNA, 201 bp, Homo sapiens
gggtgtcgtccggcccacttgcagtcttaatctctgaattctgggccctggaacaggctgtgtctagttctcatttgccgtactcaccgggcccctttacrtactctactttctctttccctctgggtttgagtgctagtaaccccaggctcgtgtgtccactgctgtcatgctgctgtgggacttccggcctctgagcca

SEQ ID NO: 78589 - DNA, 201 bp, Homo sapiens
cgtccttgtctggagaactgggcgcctcctcactgttccctgggctccctggacagaacctgtcggagctggacaccaagatccaggagaaagccatgaargtggatatggacatctgccgccgcatcgacatcaccgccaagctctgcgatgtggctcagcagcgcaactgcgaggacatgatccagatgttccaggtga

SEQ ID NO: 78590 - DNA, 201 bp, Homo sapiens
cgaacatgggggcatcagcagagggggcagagatgatgacccttttggctcccccctgcaaatgagcctacagcagagaagcagacagttatgaacccggstcctgcctttgcagggctgagtcagcttcccctcccgcgggccctcctgcactcaccccagccttctccatggtggtgaagacgccagtggactccacga

SEQ ID NO: 78591 - DNA, 201 bp, Homo sapiens
aggggagattcagtgtggtgggggactgagtgtggcagggactccccagcagtgagggtctctctcttcctcttgtgctcttgctggggctggtggtccargggtcttactccttggaggccatgtgggccatgaggtccaccaccctgttgctgtagccaaattcgttgtcatacctagaagatgaaaagagttgtcagg

SEQ ID NO: 78592 - DNA, 201 bp, Homo sapiens
tgccccagaccctagaataagacaggacaagtaactggttgagcacagggtactttattgatggtacatgacaaggtgcggctccctaggcccctcccctyttcaaggggtctacatggcaactgtgaggaggggagattcagtgtggtgggggactgagtgtggcagggactccccagcagtgagggtctctctcttcct

SEQ ID NO: 78593 - DNA, 201 bp, Homo sapiens
tgtggcagggactccccagcagtgagggtctctctcttcctcttgtgctcttgctggggctggtggtccaggggtcttactccttggaggccatgtgggcmatgaggtccaccaccctgttgctgtagccaaattcgttgtcatacctagaagatgaaaagagttgtcagggccctttttctgagccagccaccagagggc

SEQ ID NO: 78594 - DNA, 201 bp, Homo sapiens
attggcttcccctcggcccgccccctgacctctgccccgctgccgagccgcctgattggtcggctctgtcccgccggcgccgcattggctcttctggctcrccttccatccctgctcctgcaccggtctgcatctcccagcagaaggcgcagccatgaatccgttattcggccccaacctcttcctcctgcagcaggagca

SEQ ID NO: 78595 - DNA, 201 bp, Homo sapiens
gtgaggcccgggagtaactgcccaaagcaactgagccgttcagtggcagagccaggggtctggacctaggtcccagctacacgccttgcccctacccaagytcccctaaggacgatgatggaaataagtcaccctgacacatctcagttcatcttcctcaaaactatgcgaggtgggcatttttaccgatttttaaacatt

SEQ ID NO: 78596 - DNA, 201 bp, Homo sapiens
tcgccatcccgcggccccgccctcgcttccggtacttctcacgggctgccagagggtgaggcagcaggaggaggagtgccgtccgtcttcaggattcctgmctgccccaaggttgacaactggtgtttttttctagaaagtctcctgctttcactgcggtcccgcttagcgacccgccgccgccgccaagcgaggctgagg

SEQ ID NO: 78597 - DNA, 201 bp, Homo sapiens
atcggtgctggttcccaggactggactgtgggcagcaggacactagggagtcaaggacggggacccttacacgcttggatgaaacaggaggactttgggarcgactgagatggggaattggagccggagcccagcaccgctcgcggctgcacgcggcctgccccctcccctttctttctttcaaaggctgagaggcgggaa

SEQ ID NO: 78598 - DNA, 201 bp, Homo sapiens
ctggggttacaggcgtgcgcgctctaccgaggtatgtacttttgtctccactaggtaagcacacgtgcaaagtgaggcccgggagtaactgcccaaagcamctgagccgttcagtggcagagccaggggtctggacctaggtcccagctacacgccttgcccctacccaagttcccctaaggacgatgatggaaataagtc

SEQ ID NO: 78599 - DNA, 201 bp, Homo sapiens
ggtttgcagccctgacccccgctgtgtgtctggcccttggtgactgtccgtgtttctgttcctgtcattgtaactgtgacttttctctctgtctgcccccmcttcctactggttcatgcttctcccccattcccaccctctctgcccggcctcccgctcccgccctttctcctcatgcacccggcctcgtctctgtagtct

SEQ ID NO: 78600 - DNA, 201 bp, Homo sapiens
gtcaggagatcgagaccatcctggctaacacggtgaaaccccgtctctacgaaaaatacaaaaaaaaaaaattagctggccgtggtggcaggcacctgtastcccagctactcgggaggctgaggcaggagaatggcgtgaacccgggaggcggagcttgcagtgagccgagatcgcaccactgcactccagcctgggcga

SEQ ID NO: 78601 - DNA, 201 bp, Homo sapiens
caggaaggggccaccaccagaggggccattttgcggtggaaatgtccttttccaactacccatgactcagcttctcccggcttggcaccatgccacagccmccacacctctgcggggaggggacacaagaggacctccataaacccacttctttgatttaccagagaataatctaggaaaagcatcacccggaggagaaat

SEQ ID NO: 78602 - DNA, 201 bp, Homo sapiens
ttcccgacgctctgactttgggagaggcatggagccttctctgcgtctcagcctctcttcaggcccacatgggagattcatacgtagtccccccttatctkcagggcatgtgttccaagacccacagtggatgcctgaaaccaaagatagcactgacctcctgatagcttgggtccagttgctgtcaactggaacgtgttt

SEQ ID NO: 78603 - DNA, 201 bp, Homo sapiens
cacaagcccagcttccctcccctctgccccagaccctagaataagacaggacaagtaactggttgagcacagggtactttattgatggtacatgacaaggkgcggctccctaggcccctcccctcttcaaggggtctacatggcaactgtgaggaggggagattcagtgtggtgggggactgagtgtggcagggactcccc

SEQ ID NO: 78604 - DNA, 201 bp, Homo sapiens
cggggccgtgaggtgagccggcgctgcaggaaggggccaccaccagaggggccattttgcggtggaaatgtccttttccaactacccatgactcagcttcycccggcttggcaccatgccacagccaccacacctctgcggggaggggacacaagaggacctccataaacccacttctttgatttaccagagaataatcta

SEQ ID NO: 78605 - DNA, 201 bp, Homo sapiens
caaaactggcacaaatttctttttccttctttacaatttcacggatagaagattcattcttactgtagagcttaccaacctcagcatcggattctttttcwtattaagttgaaaacttttaccttttcacttaaagggagcatattttggcttctctttcacatatccaaattgccagcatcactactcttgtgctttggg

SEQ ID NO: 78606 - DNA, 201 bp, Homo sapiens
attttttagtagagatggggtttcaccgtgttagccaggatgatctcgatctcctgacctcatgatccgcccacctcggcctcccaaagtgctgggattayaggcgtgagccaccgcgcccggcagagagagtgagattttatcaggccactcagaacagcgtgcaatttaaaacttaggaattgtttatttctggaatat

SEQ ID NO: 78607 - DNA, 201 bp, Homo sapiens
ataaggagagagtgactttattcttttcatttatttatttatttatttatttttttgagacgtagtctcgctgtgtcgcccaggctggagtgcagtggcgygatctcagctcactgcaagctccacctcccaggttcacgccattctcctgcctcagcctccagagtagctgggactacaggcgcctgccactacgcccgg

SEQ ID NO: 78608 - DNA, 201 bp, Homo sapiens
cctcggccttccaaagtgctgggattacaggcgtgagccaccgcgcccggccttgactttattcttattgctgtcacattggaggtgtttgagaaggaagycgagaaattattttcctatatactcattctcccaacacacatcaaactgtcctgctcctgcatcaaacctggttttcttggccaggtagatgaggtttcc

SEQ ID NO: 78609 - DNA, 201 bp, Homo sapiens
ggaatttaggtaatctgctcttaggcactgacctaattgtgtggagctcctgcccaggaaatggcaattctcatattttaatatgagaatattaaaatatrgtgataaggcccattttctgacaccatctgtttaattttaaccccaggaaattctgaaacagccacacctacaaatgtagacttgcctcaggtcatcccc

SEQ ID NO: 78610 - DNA, 201 bp, Homo sapiens
tgcctgacctgattcttgtctccctcttttggatggtggatttaaggtttgtgttttcactgtgccttcaaccaactaggggcctttgtgcggccatcttygtgagaagagatctcgggctgccatctctccctagtcttccctggacctcaagtgcccagtgtaaaacatgatctgaaagaacgaaaataatatcttaaa

SEQ ID NO: 78611 - DNA, 201 bp, Homo sapiens
gaatttaggtaatctgctcttaggcactgacctaattgtgtggagctcctgcccaggaaatggcaattctcatattttaatatgagaatattaaaatatgrtgataaggcccattttctgacaccatctgtttaattttaaccccaggaaattctgaaacagccacacctacaaatgtagacttgcctcaggtcatcccca

SEQ ID NO: 78612 - DNA, 201 bp, Homo sapiens
aagaacgaaaataatatcttaaatggaatcatgccttttaagctatttttggctgggcgtggtggctctcgcctgtaatcccagcactttgggaggccaaygcgggcagatcacttgaggtcaggagtgtgagaccagcctggccaccaacatgtgaaaccccgtctctactaaaaatacaaaaagtagccaggcattgtg

SEQ ID NO: 78613 - DNA, 201 bp, Homo sapiens
gaggctgaggcaggagaattgctggaatctgggaggtggaggctgcagtgagctgagattgtgccactgcaccacagcctgggtgacagagcaagattccmtctcaggaaaaaaaaaaaaaaaagtattttcaaatcatctgactcctcctctctcccagtgcaatgactttaggcagcagtccccaacctttttggtacc

SEQ ID NO: 78614 - DNA, 201 bp, Homo sapiens
cagaccctgcactttttaagagccagtctctggccccagccacataccaggaaatgagcttgacaaagtggtcgttgagggcaatgccagccccagcgtcraaggtggaggagtgggtgtcgctgttgaagtcagaggagaccacctggtgctcagtgtagcccaggatgcccttgagggggccctccgacgcctgcttca

SEQ ID NO: 78615 - DNA, 201 bp, Homo sapiens
agacaggacaagtaactggttgagcacagggtactttattgatggtacatgacaaggtgcggctccctaggcccctcccctcttcaaggggtctacatggmaactgtgaggaggggagattcagtgtggtgggggactgagtgtggcagggactccccagcagtgagggtctctctcttcctcttgtgctcttgctggggc

SEQ ID NO: 78616 - DNA, 201 bp, Homo sapiens
taaagatgtgcttcctccgtgtctgtcatacactgagaccaacaggctacagtgtccctgattcttggaaaagcctggagaagctggggagatgcggttcmcaatgcctcggtataggaggctgtgttgagctgacattcaaatggattctttaataataatgaaactggcgagtatttattgtgcactttggtgtcactg

SEQ ID NO: 78617 - DNA, 201 bp, Homo sapiens
tcagcaaagattgagccactgcattccagcctgggtgacagagcaagactctgtcacacacacacacacacacacacacacacacacacacacacacacacacacaaagatgttacttgcaaaaggtggcggggggagggggttctgctactacaaaccaaaaatgaaaatgattatcattatattttatttttctaggta

SEQ ID NO: 78618 - DNA, 201 bp, Homo sapiens
ggtgtgagcgctctgtatggccctctccttcccacagtcctggctggaggcttcggaagcccactgggccctatggaatggagacacacagggcatttgasccccagcctcccagaaggggcaggaagtgtgggaaagagatgtcattggtgtgaagcccacagctgcgcctagcatgtctgtagagggaaccagtgactt

SEQ ID NO: 78619 - DNA, 201 bp, Homo sapiens
tgttggtttaaaggacacagtgggaacagcggggaggccagtctgctagatgggagagacacttaagttgtcacctctgcccaccggcttgaagcacttgrgtgtggtgaggaacttgaagccgttcagaaggaagtgacagagatgctaatgttcaggcagcagcctttgctatggtgctcccgtgacggcactgtagag

SEQ ID NO: 78620 - DNA, 201 bp, Homo sapiens
gtgaaggtgtgagcgctctgtatggccctctccttcccacagtcctggctggaggcttcggaagcccactgggccctatggaatggagacacacagggcayttgagccccagcctcccagaaggggcaggaagtgtgggaaagagatgtcattggtgtgaagcccacagctgcgcctagcatgtctgtagagggaaccagt

SEQ ID NO: 78621 - DNA, 201 bp, Homo sapiens
gcctgtgatcccagctccttgggaggccaaggtgggaggatcacttgatcccaggaggttgaggctgcagtgagctgtgattgcactactgcctccagccygggtgacggagcaagactctcaaaaaaacaagtgaaaagaataaaccctgtgctggccacccacgtggggtggaccgggagtcagtggccttctctgaat

SEQ ID NO: 78622 - DNA, 201 bp, Homo sapiens
catcagttatccagtctgtgcagtaaagagggtgctggggcccagaccccagccctgaaccctgctgcatggactcctggcaactgtccttaggctctctygaggcccagcttcctgttggggagaacagtgcccacccgatttgtgggtgaaggtgtgagcgctctgtatggccctctccttcccacagtcctggctgga

SEQ ID NO: 78623 - DNA, 201 bp, Homo sapiens
gtccctgcggtgggtgtgtttcggcctggcctgggcaggcgcttgtgctgccagggcgccgggcccggggaggccggggtctcgggtggccgccggcccakgcgctggacggcagcaggatggggaaggcgaaggtccccgcctccaagcgcgccccgagcagccccgtggctaagccgggtcctgtcaagacgctcactc

SEQ ID NO: 78624 - DNA, 201 bp, Homo sapiens
catttgctgactagggtcacacacacattctgcgttcctggaaagcccccactctcacttaactctgggatggtttcacagctatctgttcctgtttatgycgccagaatcaacccatcgactgtgacctgcatcgaccaatctgaactcagcaagtattaaccaatcagaactaagcaagtgtgccttcctcatttgcat

SEQ ID NO: 78625 - DNA, 201 bp, Homo sapiens
ctagggcaacacatctctacccatttttgtgggggcagttttgtttttatttccatttgggaaattgtcaagtaaatcatgaggttgaataggcagaaccrcgctgccaggcggctctaaaagtttctcagtgcctacactcaacatatgctctcctccagccatgagccgactttgcagactgtgtggagcactttattc

SEQ ID NO: 78626 - DNA, 201 bp, Homo sapiens
cacccctgttcggggggtacaagtggggttggtggtggggtggtccccagaagcaggcaaggctgcctctggagcccagggcctagggcaacacatctctrcccatttttgtgggggcagttttgtttttatttccatttgggaaattgtcaagtaaatcatgaggttgaataggcagaaccacgctgccaggcggctcta

SEQ ID NO: 78627 - DNA, 201 bp, Homo sapiens
gctggaattacaggcatgacccactgcacctggccttctaaaaaatatttttaaaaaattagctggtcccacttggctcgggccacccttggtctaatcasccctgttcggggggtacaagtggggttggtggtggggtggtccccagaagcaggcaaggctgcctctggagcccagggcctagggcaacacatctctacc

SEQ ID NO: 78628 - DNA, 201 bp, Homo sapiens
ccaaggcgggaaaggctcgagagtccaggacgcaggcgagcgacctagcccggctctcactagccccaccgcccagtgcccccagctcagctgccctaccrggtgctacacacacagcggccccccagttcccttccggcgttcgcatctctcatccccatcccggatcttggggaggtcctcggcttgccccagtcaaac

SEQ ID NO: 78629 - DNA, 201 bp, Homo sapiens
tacgctggtctcagggagtggggtctgctggggatgcttagccgtggagggcggggcttcttcaaggaagaggatgctttcctctccctgaggtgaatgargcaagcacctcccagggtcctgctaagaaccaggaccacacagagcttgtcacgtgggtgcaaatgagtgaggggcagagagcttttctctgctgacact

SEQ ID NO: 78630 - DNA, 201 bp, Homo sapiens
tgacatttaaccttagcccaagagacagattccccaggcaggtgttacgtgcctgtgtgagcttcctagtacggagggcaaggggttctgtgtttccatcwtacaggcattctgtctgtctgtttcctaagtgttcaataatgaacgtgttaccttcataattaaaatgttagcactcattacacttgggtggtgggttat

SEQ ID NO: 78631 - DNA, 201 bp, Homo sapiens
aacaagagggacgtgtccattcagtggggccaggaatggcttttctaaggaaatgacatttaaccttagcccaagagacagattccccaggcaggtgttaygtgcctgtgtgagcttcctagtacggagggcaaggggttctgtgtttccatcttacaggcattctgtctgtctgtttcctaagtgttcaataatgaacgt

SEQ ID NO: 78632 - DNA, 201 bp, Homo sapiens
taagtgtggtcaggataaatctagtgaggagaaggtattgggcgcctggaacaagagggacgtgtccattcagtggggccaggaatggcttttctaaggamatgacatttaaccttagcccaagagacagattccccaggcaggtgttacgtgcctgtgtgagcttcctagtacggagggcaaggggttctgtgtttccat

SEQ ID NO: 78633 - DNA, 201 bp, Homo sapiens
gacggccatgggcacgcctggccacgctttaccgactgctgaccccctgggccaggtgaggttggggcctgtgggccgccagtccatacggtgctgtcacygcccatcttcggtgacaccctggggtgaggtgctcagcaccttcctctcgaggagccacattttcctcctttgtgttaggggacataacaagctctgctg

SEQ ID NO: 78634 - DNA, 201 bp, Homo sapiens
tctctcagctccaacctcttccatcaggacagtgaaatgaactcagcactgccctcctaccagccctcttcagaggacacaacccatcctccctgagggtsactccagaggacctcgtgtccagctcctcgcttcatagctgggaaaactggcaggatcatcaggaacttgtccagggccacggagcaggcaaaaggcagg

SEQ ID NO: 78635 - DNA, 201 bp, Homo sapiens
ttactgtccatgtgtgtttgggcccggatggtcagggtggggagcagggacggccatgggcacgcctggccacgctttaccgactgctgaccccctgggcmaggtgaggttggggcctgtgggccgccagtccatacggtgctgtcactgcccatcttcggtgacaccctggggtgaggtgctcagcaccttcctctcgag

SEQ ID NO: 78636 - DNA, 201 bp, Homo sapiens
tggtgcaccccagctgggggcttccacctggagggaggcctggtttgctgaaggcgctgctgtcactcaccaggctggaggtgaagcgctccttgatctcytggagcagggccttcatactactggacaccagctccggcaggatctcctctgcaggtggagcaggaaggtcctgaggccagagtccttcctgtgcccctt

SEQ ID NO: 78637 - DNA, 201 bp, Homo sapiens
caaaaaaaaaaaaaaaagtaactaaatactttttgtttcaaaaaaaatcatcaaagctaattcaactcttttaacaacccatgtctctcataggaggctcratctctcagctccaacctcttccatcaggacagtgaaatgaactcagcactgccctcctaccagccctcttcagaggacacaacccatcctccctgaggg

SEQ ID NO: 78638 - DNA, 201 bp, Homo sapiens
tgagaaggtcctccttcctcttgactttgtggtctgaaacctggtcttactgtccatgtgtgtttgggcccggatggtcagggtggggagcagggacggcyatgggcacgcctggccacgctttaccgactgctgaccccctgggccaggtgaggttggggcctgtgggccgccagtccatacggtgctgtcactgcccat

SEQ ID NO: 78639 - DNA, 201 bp, Homo sapiens
caaaagtactgcattctcgttatttggagaaaaagttgccaaataattacaaagggtccccccacccccgcagccctccagccctgccctgcccggccctrctgagcagctggctctgcctctgtggagcagtcaccccctgccaacgtggcctcagtgctttgggccctttttgcccatctgcttggtccttgtgcccct

SEQ ID NO: 78640 - DNA, 201 bp, Homo sapiens
caggagttcaagaccagcctgactaacatggtgaaacccgtctctactaaaaatacaaaaattagccaggcgtggtggtgggtgcctgtagtcccagctaytcaggaggctgaggcaggagaatcgcttgaacctgggaggtggaggttgcattgagccgagagtgcgccactgcactcgcctgggtgacgagcaaaactc

SEQ ID NO: 78641 - DNA, 201 bp, Homo sapiens
ccacccctcccagccccaggggcccagggcgcccacccagctcacccagcagggacagcagccagaagactccgcagctggcttccgccatttccccatcygcagggtaggtggccaacacctggctgatgaggtccgggaccttctccaagggggccttgttcacaatgatacctggaacgaggacagggatggaagggg

SEQ ID NO: 78642 - DNA, 201 bp, Homo sapiens
acaggaaacaagtttatcctggcagatgccctgtggcccatgttcaggttacgcttgcctaaccatcaccctggccctgggagcttgcctttgccttcttyctggcgtcccgaggaaaatcccgcctggggcagcccctggttcttcagatggaaagtgcaaattcagacaccaccaccgtgggaaacaagttcaaagaca

SEQ ID NO: 78643 - DNA, 201 bp, Homo sapiens
gctgtgccatgaggcccacccctcccagccccaggggcccagggcgcccacccagctcacccagcagggacagcagccagaagactccgcagctggcttcygccatttccccatccgcagggtaggtggccaacacctggctgatgaggtccgggaccttctccaagggggccttgttcacaatgatacctggaacgagga

SEQ ID NO: 78644 - DNA, 201 bp, Homo sapiens
tgatgcagcctgcagaaaggggccgggctgccttgtgcctgctgtgccatgaggcccacccctcccagccccaggggcccagggcgcccacccagctcacmcagcagggacagcagccagaagactccgcagctggcttccgccatttccccatccgcagggtaggtggccaacacctggctgatgaggtccgggaccttc

SEQ ID NO: 78645 - DNA, 201 bp, Homo sapiens
tatttttagtagaggtggggtttcgccatgttggccaagctggtctcaaactcctgacctcaggtgagctgactgcctcggcctcccaaagtgctgggatyacaggcatgagccaccaagcccagacactctggtgtctcttgattacaatcaacaaccttcccttgacccacactgtcctcctgccatagccctgtttct

SEQ ID NO: 78646 - DNA, 201 bp, Homo sapiens
cctccaggaagccttcctgcctctgttgtccttgggcactgcagtcccatttgacctgcaatcctaggtgcctgctctgggccaagtcgtgtgcactcaayggagccctgaacaggaggatgtgggactggccccagaggagtctgtccatctcgtgggccaccagtcccaatagctgccatcccactaccaggctgggtc

SEQ ID NO: 78647 - DNA, 201 bp, Homo sapiens
gtttgaggctcccctgggaactagagccaggaacagccagtggcactgacaaggggacggagtccaaggcgttattgggccacctgacagctggacagaaraggggcagacacaccgaggatgcgatttaaaataaatgcagatgtttacttggaatggagcctgtggaggctcagtgttgactctcatctagaatggtct

SEQ ID NO: 78648 - DNA, 201 bp, Homo sapiens
ccagcaggagggcccagagcaggcccaggccgctggcgcagacgtccctgcttttgagggagctgttgaggtgctccaggatgtgctccagcagcccagcrttctgcagctcctctgacagtgactctgactctgtgggtgagccagaatgagggccccagggcccctccctccaggaagccttcctgcctctgttgtcct

SEQ ID NO: 78649 - DNA, 201 bp, Homo sapiens
tccctcttgaggcttattgtcaagtgcagtagacagactgtaaactgcagctgttgattaagtgtggtcaggataaatctagtgaggagaaggtattgggygcctggaacaagagggacgtgtccattcagtggggccaggaatggcttttctaaggaaatgacatttaaccttagcccaagagacagattccccaggcag

SEQ ID NO: 78650 - DNA, 201 bp, Homo sapiens
gggctgccagccccggtgggacagcaggaggagggcccctcaccgtccagcaggagggcccagagcaggcccaggccgctggcgcagacgtccctgctttygagggagctgttgaggtgctccaggatgtgctccagcagcccagcattctgcagctcctctgacagtgactctgactctgtgggtgagccagaatgaggg

SEQ ID NO: 78651 - DNA, 201 bp, Homo sapiens
cactggaggtcaggagttcaagacagcctggccaacgtggcgaaaccccaggtctactaaaaatacaaaaattggcagagagtggtggcgtgcacctatartcccagctactcaggaggctgaggcaggagaatcgcttgaacccaggaggcagaagtaagggaggagaccacccctcatattgtcttatgcccaatttct

SEQ ID NO: 78652 - DNA, 201 bp, Homo sapiens
caggtctactaaaaatacaaaaattggcagagagtggtggcgtgcacctataatcccagctactcaggaggctgaggcaggagaatcgcttgaacccaggmggcagaagtaagggaggagaccacccctcatattgtcttatgcccaatttctgcttccaaataaagaagtaaaaactaaaaggcagaaataaaatccaca

SEQ ID NO: 78653 - DNA, 201 bp, Homo sapiens
tgtaaactgcagctgttgattaagtgtggtcaggataaatctagtgaggagaaggtattgggcgcctggaacaagagggacgtgtccattcagtggggccrggaatggcttttctaaggaaatgacatttaaccttagcccaagagacagattccccaggcaggtgttacgtgcctgtgtgagcttcctagtacggagggc

SEQ ID NO: 78654 - DNA, 201 bp, Homo sapiens
tctcaaaaaaacaagtgaaaagaataaaccctgtgctggccacccacgtggggtggaccgggagtcagtggccttctctgaatggttcagctggaggtgaygtgttcataagttacagctggcttcatgttgcctgggtgttcaggacacagtcgctgatggctgaggaatgagccatttgggggcctccctgtgttgtgc

SEQ ID NO: 78655 - DNA, 201 bp, Homo sapiens
atcacttgatcccaggaggttgaggctgcagtgagctgtgattgcactactgcctccagcccgggtgacggagcaagactctcaaaaaaacaagtgaaaasaataaaccctgtgctggccacccacgtggggtggaccgggagtcagtggccttctctgaatggttcagctggaggtgacgtgttcataagttacagctgg

SEQ ID NO: 78656 - DNA, 201 bp, Homo sapiens
gtggtagtcatggtggcatcataaggagattgtgaggttggcactcttggctcagtgcctggtgattacttcaaccctgtgatggagccaggtgtggtggytgttgcctgtgatcccagctccttgggaggccaaggtgggaggatcacttgatcccaggaggttgaggctgcagtgagctgtgattgcactactgcctcc

SEQ ID NO: 78657 - DNA, 201 bp, Homo sapiens
gtgctgaagccagaaagacccaagtatgaggcctgtccctgcttctcgccagttgggtggtttggggcaagtttctgacgtcctctgtgccttgtggtagkcatggtggcatcataaggagattgtgaggttggcactcttggctcagtgcctggtgattacttcaaccctgtgatggagccaggtgtggtggctgttgcc

SEQ ID NO: 78658 - DNA, 201 bp, Homo sapiens
aaagagacctcgcctcaagtgaagggagaggagatgccggcaggaaaagaccaggaggccagcaggggctctgttccttcaggttccaagatggacaggarggcgccagtacctcgcaccaaggccagtggaacagagcacaataagaaaggaaccaaggaaaggacaaatggtgatattgttccagaacgaggggacatc

SEQ ID NO: 78659 - DNA, 201 bp, Homo sapiens
cagtgcacaatgaactaatacagatggggtttcactttgttgcccaggctggtcttcaactcctgacctcaagcaatcctcccacctcagcctccccgagygcttcttgaacctcctaatactctgcacagtatctcagtgcagacattcctgtcttaacacacaggaccagtcaaattcccgtgggcagccccagggttc

SEQ ID NO: 78660 - DNA, 201 bp, Homo sapiens
gccatgtgctctatgccatgcgtgttgcaatccccacaataagactgtgaggtggacacttccatcatcgctattgtacagatgaggaaataggctggaaragtttaaatagatcatctaagattgcggctgggaaccaggtggctgactctggagtccatgcttttaaggctgtgttgtacctgctgtctccctagtgac

SEQ ID NO: 78661 - DNA, 201 bp, Homo sapiens
attggtgtgaagcccacagctgcgcctagcatgtctgtagagggaaccagtgacttcaagagtggaagcttgtcatcaagatggaaaaggatgcgaccagyatttggggtggccaaatgaagacggccaaatgccaccatgtatctcaggaggaggcccagcactgtcctgtccaacccacctataccccaaaccaaccct

SEQ ID NO: 78662 - DNA, 201 bp, Homo sapiens
ccgagcccgtgacggactataggacagcggtcagtgggattcggcctgagaacctcaagcagggtatgtcatccacagctcaggaacttagaagggaaagyagtaactggattcgttttctcccttttgttcccttttctgtctgagaccactcactgcagctggttttgatgcgtcttgtctccttttggggcgatgggt

SEQ ID NO: 78663 - DNA, 201 bp, Homo sapiens
tactgagaaggtcctccttcctcttgactttgtggtctgaaacctggtcttactgtccatgtgtgtttgggcccggatggtcagggtggggagcagggackgccatgggcacgcctggccacgctttaccgactgctgaccccctgggccaggtgaggttggggcctgtgggccgccagtccatacggtgctgtcactgcc

SEQ ID NO: 78664 - DNA, 201 bp, Homo sapiens
gaagattaggtagtacagaggtcaagaccatgagcccggagttgccaggcaccagctagtgtcttggccaggcccaggatgctctctgaaggactgtgctktgggccgagcgtcggttgtgctgtgctcagcgctgggcccagcctgtctagctgagtaacaggcagggtttgtgttgtggggaattggagacactgtttg

SEQ ID NO: 78665 - DNA, 201 bp, Homo sapiens
ggaactagagccaggaacagccagtggcactgacaaggggacggagtccaaggcgttattgggccacctgacagctggacagaaaaggggcagacacaccraggatgcgatttaaaataaatgcagatgtttacttggaatggagcctgtggaggctcagtgttgactctcatctagaatggtctggaaggactgctctgt

SEQ ID NO: 78666 - DNA, 201 bp, Homo sapiens
gggtcagagcgagggcagcgtcagcctcagcctcgtgaaagagcaggccttcggcgggtacgctggtctcagggagtggggtctgctggggatgcttagcygtggagggcggggcttcttcaaggaagaggatgctttcctctccctgaggtgaatgaggcaagcacctcccagggtcctgctaagaaccaggaccacaca

SEQ ID NO: 78667 - DNA, 201 bp, Homo sapiens
gggcggaccagtaggctggcatgacctgaacaggaccatgcaagaacagaggaggcagcccccccagagccaaaggggtcgttgtcactctggggaagatyaggtagtacagaggtcaagaccatgagcccggagttgccaggcaccagctagtgtcttggccaggcccaggatgctctctgaaggactgtgctgtgggcc

SEQ ID NO: 78668 - DNA, 201 bp, Homo sapiens
gcctgtaatcccagctactcgggaggctgaggcagaagaatcacttgaacccgggaggtggaggttgcggtgagccgagattgcgccattgcactccagcytgggcgacaagagcataacttcgtctcaaaaaaaaaaaaaaaattagctgggcatggtggcgtgcacctgtagttccagctacccaggaggctgaggcag

SEQ ID NO: 78669 - DNA, 201 bp, Homo sapiens
tggctctgcctctgtggagcagtcaccccctgccaacgtggcctcagtgctttgggccctttttgcccatctgcttggtccttgtgcccctgtgcccagcrcccaacctgccatcaccctgcactcagagacctaaaaaggcagcgtgtttgttgcttctcctctttgggtttccctttcttctcctgggaggggtgtctg

SEQ ID NO: 78670 - DNA, 201 bp, Homo sapiens
taaataaaagtaaaaagtagtttttttaaaaaagaaatgtgatccccagtggtggagatggggcccataggaggtattgggtcatgggggtagatccctcwtgaatgacttggtgccctcccctcagtaacgagtaagttctcactctgctggttcatttgagagctggttgtttaaaaagagcctagcaccttttttgct

SEQ ID NO: 78671 - DNA, 201 bp, Homo sapiens
acaaaagtactgcattctcgttatttggagaaaaagttgccaaataattacaaagggtccccccacccccgcagccctccagccctgccctgcccggcccygctgagcagctggctctgcctctgtggagcagtcaccccctgccaacgtggcctcagtgctttgggccctttttgcccatctgcttggtccttgtgcccc

SEQ ID NO: 78672 - DNA, 201 bp, Homo sapiens
tgctgctccttgatgcagcctgcagaaaggggccgggctgccttgtgcctgctgtgccatgaggcccacccctcccagccccaggggcccagggcgcccayccagctcacccagcagggacagcagccagaagactccgcagctggcttccgccatttccccatccgcagggtaggtggccaacacctggctgatgaggtc

SEQ ID NO: 78673 - DNA, 201 bp, Homo sapiens
ggtggaggttgcattgagccgagagtgcgccactgcactcgcctgggtgacgagcaaaactccatctcaaaaaaaaaaaaaaaagtaactaaatactttttgtttcaaaaaaaatcatcaaagctaattcaactcttttaacaacccatgtctctcataggaggctcaatctctcagctccaacctcttccatcaggacag

SEQ ID NO: 78674 - DNA, 201 bp, Homo sapiens
agatgtaactgatgggggctgattcttgcccccacctctaggtggcagcctcgtcctgtccccaggctcacctgacaccttcaccaggctggccagtcccyggtaggcattgttcaccagcagggctctgtcctggcacagccggatgctttgcaggagcagcgccaccacttgttcaaactgctgctccttgatgcagcc

SEQ ID NO: 78675 - DNA, 201 bp, Homo sapiens
aggtggaggttgcattgagccgagagtgcgccactgcactcgcctgggtgacgagcaaaactccatctcaaaaaaaaaaaaaaaagtaactaaatactttttgtttcaaaaaaaatcatcaaagctaattcaactcttttaacaacccatgtctctcataggaggctcaatctctcagctccaacctcttccatcaggaca

SEQ ID NO: 78676 - DNA, 201 bp, Homo sapiens
ttcccacctggaaccagacatgagtcacctgacacagacatgggggaggtggggcttgggcacctacttatcctacgaggctattggtcaaaaaaaaaaaatggtagagcggagttacggaattttggttaaattctaaatatgcacatttaacgaatttaacacttaacacaaaagtactgcattctcgttatttggaga

SEQ ID NO: 78677 - DNA, 201 bp, Homo sapiens
tcgcttgaacctgggaggtggaggttgcattgagccgagagtgcgccactgcactcgcctgggtgacgagcaaaactccatctcaaaaaaaaaaaaaaaagtaactaaatactttttgtttcaaaaaaaatcatcaaagctaattcaactcttttaacaacccatgtctctcataggaggctcaatctctcagctccaacc

SEQ ID NO: 78678 - DNA, 201 bp, Homo sapiens
atcgcttgaacctgggaggtggaggttgcattgagccgagagtgcgccactgcactcgcctgggtgacgagcaaaactccatctcaaaaaaaaaaaaaaaagtaactaaatactttttgtttcaaaaaaaatcatcaaagctaattcaactcttttaacaacccatgtctctcataggaggctcaatctctcagctccaac

SEQ ID NO: 78679 - DNA, 201 bp, Homo sapiens
cctctgaaacagggtcactgactaagggcctggtaccactgtcgtatctgctctagagggtgccaagggcagagccgttcttcatccttttttttttttttagacagggtcttgctctgtcacccaggctggagtgcaatggcataatcttggctcactgtaactgccacctcccaggctcaggcaatccttccaccttag

SEQ ID NO: 78680 - DNA, 201 bp, Homo sapiens
aatgaaaatgattatcattatattttatttttctaggtactatttcttgatcatccaaaaaagaagattcgggacacacagaaatataaacctttcaagartcaagtaaaggtacttagaatgagtgtgactcaagatactgtatttctgttttgctggtcacttcattgtttctggtcactggtggctgacttgttggtt

SEQ ID NO: 78681 - DNA, 201 bp, Homo sapiens
ctgggcttgagggacccagaccaggtgtctgcagtcagctcctgagacacagctggccggcacaacaggtgttacatcaggggtttcctgtggccgtttgractttgagcatttatctaaattaaattggcccagggttggctggtgggtcacccagcagaggcttctccccatagcacgaggatgtgttgcctgggcacg

SEQ ID NO: 78682 - DNA, 201 bp, Homo sapiens
tggtgggcgtgggccctaagggggaggagagcatggccgcccgtgtgtccatcgtgaaccagtatgggaagtgcgtttatgacaagtacgtcaaaccaacygagcccgtgacggactataggacagcggtcagtgggattcggcctgagaacctcaagcagggtatgtcatccacagctcaggaacttagaagggaaagta

SEQ ID NO: 78683 - DNA, 201 bp, Homo sapiens
aagatagcgaggaaacagttgggtcagagcgagggcagcgtcagcctcagcctcgtgaaagagcaggccttcggcgggtacgctggtctcagggagtgggrtctgctggggatgcttagccgtggagggcggggcttcttcaaggaagaggatgctttcctctccctgaggtgaatgaggcaagcacctcccagggtcctg

SEQ ID NO: 78684 - DNA, 201 bp, Homo sapiens
gatggtgggcgtgggccctaagggggaggagagcatggccgcccgtgtgtccatcgtgaaccagtatgggaagtgcgtttatgacaagtacgtcaaaccarccgagcccgtgacggactataggacagcggtcagtgggattcggcctgagaacctcaagcagggtatgtcatccacagctcaggaacttagaagggaaag

SEQ ID NO: 78685 - DNA, 201 bp, Homo sapiens
tactaattgagctcctaaaaatgtgcactctgccatgtgctctatgccatgcgtgttgcaatccccacaataagactgtgaggtggacacttccatcatckctattgtacagatgaggaaataggctggaaaagtttaaatagatcatctaagattgcggctgggaaccaggtggctgactctggagtccatgcttttaag

SEQ ID NO: 78686 - DNA, 201 bp, Homo sapiens
tagcagacatgtgatggggttctagcgacacttacggtcttgaagtaaatactaattgagctcctaaaaatgtgcactctgccatgtgctctatgccatgygtgttgcaatccccacaataagactgtgaggtggacacttccatcatcgctattgtacagatgaggaaataggctggaaaagtttaaatagatcatctaa

SEQ ID NO: 78687 - DNA, 201 bp, Homo sapiens
ggctctcactagccccaccgcccagtgcccccagctcagctgccctaccgggtgctacacacacagcggccccccagttcccttccggcgttcgcatctcycatccccatcccggatcttggggaggtcctcggcttgccccagtcaaactcgaggtcgatgaccccggatgccgctggctaaggcggcggcccaagtccc

SEQ ID NO: 78688 - DNA, 201 bp, Homo sapiens
acgatttccaaattacatctccagcactgacccttccctaagcttaggaatcttatatcctgctgctgattagacgtctctccttggtgactgacggcccrttcaaactcagcaagtgtgaaaaggagctcatggctccacccccatacttcaccctgctccccgcagacatttattgagatgataaatggccacacccaa

SEQ ID NO: 78689 - DNA, 201 bp, Homo sapiens
tgacaatctcagtgccatatctggttcccatctctctgtcctcgtccttctcagcctctcagcagcatctgatgtggtttattctccccctggattctctratgccactcacatccgcttctcctcccactgcactgactgctccccctcagcctcctctgctgcttcgcccctggagagcccccagcacctgctatctgg

SEQ ID NO: 78690 - DNA, 201 bp, Homo sapiens
ctccaaaccactcttttacacccacagagccgcacaagctgatgaccagcagggggattcaccttgtctttccacccctcaaagtgcagcctctctcctcytctgcgatcagggaggacacacctacacttcctgccaggccctggctctggatcccttcccagctctctcctcctgcatcgttagtttctgcccctctgc

SEQ ID NO: 78691 - DNA, 201 bp, Homo sapiens
acagctctccggatgtgcacgcccacccccttagaggaggcctaagccatctaatctggagaagggacactggaccagaaacccacagacgggggttcacraggaatgccaggacctcggctgactccctctccggggtccccgctcccatctgacagatgagaggctgtgccaaagacatcgtggttctggctcaactct

SEQ ID NO: 78692 - DNA, 201 bp, Homo sapiens
gcaaatgagcccacctgctggaaatgggagggtccccagcagcccaggagaaagccacaggcaaggattccggccacacagaggggagggcatcttgcccrggggtgacgctggtgcatcctcaggagagccagcccgaggagtggagcggagtgagagggggccttggtgactgggaatctggtcagtatggaatgggac

SEQ ID NO: 78693 - DNA, 201 bp, Homo sapiens
ttcaccttacaccatgatgggaagcttccttcggcctcaccagaagcagatgctggcaccatgcttcttgtacaacctgcaaaaccatgagctacataaaygttttttctttataaattaccaaacacaggtattcctttatagcagtgcacaatgaactaatacagatggggtttcactttgttgcccaggctggtcttc

SEQ ID NO: 78694 - DNA, 201 bp, Homo sapiens
ccggtttccagccggttgtggagagacgagcgcttccggggactggagcgtgcgtgctgaggtatgcgcaacgcgtgcggggtctcttccggagtcttttmctggacggggtccctgcggtgggtgtgtttcggcctggcctgggcaggcgcttgtgctgccagggcgccgggcccggggaggccggggtctcgggtggcc

SEQ ID NO: 78695 - DNA, 201 bp, Homo sapiens
gaaccaggtggctgactctggagtccatgcttttaaggctgtgttgtacctgctgtctccctagtgacctgcacttctgtagaggttgcctgctctctccyagacactcttccacgtgcgtcactcatacattcttaccacatcccttggagctcccttggagctacctcctgttaggatcatagctcactgctgcctggg

SEQ ID NO: 78696 - DNA, 201 bp, Homo sapiens
aggaccacacagagcttgtcacgtgggtgcaaatgagtgaggggcagagagcttttctctgctgacacttagtccatggatccctggggctctgacctggwgccctgtggcctgccgtgtttattaaactacagcctttggttacccttcagcctgacaagagccttagccttggactgtgagatggtgggcgtgggccct

SEQ ID NO: 78697 - DNA, 201 bp, Homo sapiens
ggaccagacacagtggcttatgcctgtaatcgcagctttttgggaggctgaggctggaggattgcttgaggccgggagttagagaccagcctgagtaacayaggggagaccccatctctataaaaaattttaaaattagccaggtgtggtggcgtgtgcctgttgtcccagctactcaggagactggggtaggaggatcag

SEQ ID NO: 78698 - DNA, 201 bp, Homo sapiens
gccgagaagtggggttgagcccaccttccatgtgctccttccctgtcagttatagggggagcggggcacccctgaccgctgggctctagggagtgtgaggygagaaggggttctcaccataggaagccaggtggaccagcagcatgcccacgttctccaccacctccgggtcgtccctgtggagctggtaggtctccttga

SEQ ID NO: 78699 - DNA, 201 bp, Homo sapiens
gaagtaaatactaattgagctcctaaaaatgtgcactctgccatgtgctctatgccatgcgtgttgcaatccccacaataagactgtgaggtggacacttycatcatcgctattgtacagatgaggaaataggctggaaaagtttaaatagatcatctaagattgcggctgggaaccaggtggctgactctggagtccatg

SEQ ID NO: 78700 - DNA, 201 bp, Homo sapiens
gctccggcaggatctcctctgcaggtggagcaggaaggtcctgaggccagagtccttcctgtgccccttgccagaagccccagaaggatgagagtgggtcrcattcccccttgggcttggcatgcacagagccaccttgcagttccggagccccaagcgtcaccctcagccaggacaacccctggtgctcagaagatgcca

SEQ ID NO: 78701 - DNA, 201 bp, Homo sapiens
cagggccttcatactactggacaccagctccggcaggatctcctctgcaggtggagcaggaaggtcctgaggccagagtccttcctgtgccccttgccagragccccagaaggatgagagtgggtcacattcccccttgggcttggcatgcacagagccaccttgcagttccggagccccaagcgtcaccctcagccagga

SEQ ID NO: 78702 - DNA, 201 bp, Homo sapiens
agcgctccttgatctcctggagcagggccttcatactactggacaccagctccggcaggatctcctctgcaggtggagcaggaaggtcctgaggccagagyccttcctgtgccccttgccagaagccccagaaggatgagagtgggtcacattcccccttgggcttggcatgcacagagccaccttgcagttccggagccc

SEQ ID NO: 78703 - DNA, 201 bp, Homo sapiens
aagcgctccttgatctcctggagcagggccttcatactactggacaccagctccggcaggatctcctctgcaggtggagcaggaaggtcctgaggccagartccttcctgtgccccttgccagaagccccagaaggatgagagtgggtcacattcccccttgggcttggcatgcacagagccaccttgcagttccggagcc

SEQ ID NO: 78704 - DNA, 201 bp, Homo sapiens
tggttgctggttaactgttgactgtttttctcctacttccttgatttcaagattttgtttttattgtctctgactgttgggcatcagcttaagtcagtgcrataaatttccttctggagttgaaattcatatcagtgccttgtttccatgtgtgtgtgacacacttggattccctacaagatgttacttgcagggcagccg

SEQ ID NO: 78705 - DNA, 201 bp, Homo sapiens
gtgctcccgtgacggcactgtagagatcccttgaatccattgaagatgctggaggtgttcatgcttgtttacagagggtgaaactgaggtgagaacccccygggcagtgtcctcacagaaaggtcttctgtgtgctcctgctgtaccccctcagagactgctgccgtggggactcgtccttccctcctgactctgactcca

SEQ ID NO: 78706 - DNA, 201 bp, Homo sapiens
tgtggggtatctgtcttctcccccgcatcagggctgagctgcttccccacccagtgggctgggagaggtggctgcctccagcctcaagagcactttttccrcgcaagaaaccagttcctggaaggaggaagcaggcaagtcagttttcgtggacagtccccgggtccaggagcagttactcatgtgactcaatccagcagt

SEQ ID NO: 78707 - DNA, 201 bp, Homo sapiens
catggaaaggaaggacagggagagggcacacgtggagggaggggcctgtggggtatctgtcttctcccccgcatcagggctgagctgcttccccacccagkgggctgggagaggtggctgcctccagcctcaagagcactttttccgcgcaagaaaccagttcctggaaggaggaagcaggcaagtcagttttcgtggaca

SEQ ID NO: 78708 - DNA, 201 bp, Homo sapiens
cgaggcccagcttcctgttggggagaacagtgcccacccgatttgtgggtgaaggtgtgagcgctctgtatggccctctccttcccacagtcctggctgghggcttcggaagcccactgggccctatggaatggagacacacagggcatttgagccccagcctcccagaaggggcaggaagtgtgggaaagagatgtcatt

SEQ ID NO: 78709 - DNA, 201 bp, Homo sapiens
cttccccccaccccaagggaaacagtggcccatggaaaggaaggacagggagagggcacacgtggagggaggggcctgtggggtatctgtcttctcccccrcatcagggctgagctgcttccccacccagtgggctgggagaggtggctgcctccagcctcaagagcactttttccgcgcaagaaaccagttcctggaagg

SEQ ID NO: 78710 - DNA, 201 bp, Homo sapiens
aattaagtatcccactggccagtcacagcctcttgccagaaatgattaaggcagaaactggccttgggcctctttattagtcacctaagaggagtgtgagrtgcgcattctggtgctggatgacccttccccccaccccaagggaaacagtggcccatggaaaggaaggacagggagagggcacacgtggagggaggggcc

SEQ ID NO: 78711 - DNA, 201 bp, Homo sapiens
agatgtttacttggaatggagcctgtggaggctcagtgttgactctcatctagaatggtctggaaggactgctctgtccaggggcgaggtctatagagackgcagaattaagtatcccactggccagtcacagcctcttgccagaaatgattaaggcagaaactggccttgggcctctttattagtcacctaagaggagtg

SEQ ID NO: 78712 - DNA, 201 bp, Homo sapiens
tatggtgctcccgtgacggcactgtagagatcccttgaatccattgaagatgctggaggtgttcatgcttgtttacagagggtgaaactgaggtgagaacyccccgggcagtgtcctcacagaaaggtcttctgtgtgctcctgctgtaccccctcagagactgctgccgtggggactcgtccttccctcctgactctgac

SEQ ID NO: 78713 - DNA, 201 bp, Homo sapiens
caatcctaggtgcctgctctgggccaagtcgtgtgcactcaatggagccctgaacaggaggatgtgggactggccccagaggagtctgtccatctcgtggrccaccagtcccaatagctgccatcccactaccaggctgggtctgacctctgtagcttcccatccagggggcctgaccctgcctcctgggctcacagagcc

SEQ ID NO: 78714 - DNA, 201 bp, Homo sapiens
ataggggtgtatcaccagcccatcatgctataaatggcagctggtggctaccaccctaagtgccatgagcacctctccactgagaggcaaactgtaggtcrcttgggtgaggttcagtagccaaccgctccctgcttggtggggtgaccctctttgggccgagcctgcagaggcccccacccgcctcttccccctttgcag

SEQ ID NO: 78715 - DNA, 201 bp, Homo sapiens
tcagaaggaagtgacagagatgctaatgttcaggcagcagcctttgctatggtgctcccgtgacggcactgtagagatcccttgaatccattgaagatgcyggaggtgttcatgcttgtttacagagggtgaaactgaggtgagaaccccccgggcagtgtcctcacagaaaggtcttctgtgtgctcctgctgtaccccc

SEQ ID NO: 78716 - DNA, 201 bp, Homo sapiens
tcacccaggctggagtgcaatggcataatcttggctcactgtaactgccacctcccaggctcaggcaatccttccaccttagcctctgaagtagctgggaytgcaggcatatgccaccacccctggctaatttttttatttttatttttttagagatagggtcttgctgtgttgccctggctattctcaaactcctgggtt

SEQ ID NO: 78717 - DNA, 201 bp, Homo sapiens
agagcgagtacgtgtgtatttacaggagaacagggtgggggtcactttgagtttatgggcaaatgcctggatgttggtttaaaggacacagtgggaacagyggggaggccagtctgctagatgggagagacacttaagttgtcacctctgcccaccggcttgaagcacttgggtgtggtgaggaacttgaagccgttcaga

SEQ ID NO: 78718 - DNA, 201 bp, Homo sapiens
gagggtgccaagggcagagccgttcttcatccttttttttttttttagacagggtcttgctctgtcacccaggctggagtgcaatggcataatcttggctsactgtaactgccacctcccaggctcaggcaatccttccaccttagcctctgaagtagctgggactgcaggcatatgccaccacccctggctaattttttt

SEQ ID NO: 78719 - DNA, 201 bp, Homo sapiens
tgtaatcccagctactcgggaggctgaggcaggagaatcacttgaaacctggggtcggaggttgcagtcagcaaagattgagccactgcattccagcctgsgtgacagagcaagactctgtcacacacacacacacacacacacacacacacacacacacacacacacacacaaagatgttacttgcaaaaggtggcgggg

SEQ ID NO: 78720 - DNA, 201 bp, Homo sapiens
gcactggtcagtgtgcctctggcctagaccacaaagaaccaggtcacaaagtgggccttgccctcctgttgcccctgaccactagcccacctgcctctggyccccatcagccattagtcaagttgccaatggccctactgggaagggggctcgcaccggagaaggtcacagacatgggcctgtgggcaatggggacaggcc

SEQ ID NO: 78721 - DNA, 201 bp, Homo sapiens
ctcactgcaacctccgcctcctgggttcaagcgattctcctgcctcagcctcccgagtagctgggattacaggcatatgccaccacacccgactaattttktattttaagtagagacagggtttctccacattggtcaggctggtcttgaactcccgaactcaggtgatccgcctgcctccgcctcccaaagtgctggaat

SEQ ID NO: 78722 - DNA, 201 bp, Homo sapiens
cattgtggggttgactgtgggctgcggctatgcctcgtcacctgctgggatgtttcatgtcgtctagattcaggatgcccaggcagcaatgaggctgtacrtcatggtgaagaaggagtgggagagcatggcccgagacaggcgccccctgctgactgctccagaccactgcagtgacgacgcctagcagtcctgccctgc

SEQ ID NO: 78723 - DNA, 201 bp, Homo sapiens
gcagggcgggcggcacaggggagactcattttgggccagatcgggggcatatagacccgaccagggcccccagaggctggtaggagcctgcagggccctakgtgggtgaatagaagggggaaggacaatgaggattagcgctaggtccatggagtgcatgccatgtctgccacgggtgtcctgctctgtgctgcccacagc

SEQ ID NO: 78724 - DNA, 201 bp, Homo sapiens
acggagcaggcaaaaggcaggcctgggtgggatccgcgtctccaagctcctggcctgtgccctctctgccatccaggatggggtctgatgggcacaggatrgcatggactctccagtggttagatgccaaccaggtggtgggggcagagctaggccaccaggagtgtctcctggcctggccctggcatccaccttggccta

SEQ ID NO: 78725 - DNA, 201 bp, Homo sapiens
cttgaacccgggaggtggaggttgcggtgagccgagattgcgccattgcactccagcctgggcgacaagagcataacttcgtctcaaaaaaaaaaaaaaaattagctgggcatggtggcgtgcacctgtagttccagctacccaggaggctgaggcaggagaatcgcttgaacccgggaggtggagattgtggtgagccga

SEQ ID NO: 78726 - DNA, 201 bp, Homo sapiens
gacccagagcaggcctccatgaatccctgtggcctaatggagtgaaggaccggaagggagccctgcccggccaggccacgcatcctggtccctgggagccrgtcaggcagcactgaacacaatttcaacattgcatggaactccaaacttccaacagtgaaactagaaaggtggccgcgcgcggtggctcatgcctataat

SEQ ID NO: 78727 - DNA, 201 bp, Homo sapiens
ttggcccagggttggctggtgggtcacccagcagaggcttctccccatagcacgaggatgtgttgcctgggcacggtgactgcggttattcctggaggtcrgcagacatgccaaccttgggctatttgagctggagaagctatgtgatgctagccggtggctttctgggctaggccccagtttgaggctcccctgggaact

SEQ ID NO: 78728 - DNA, 201 bp, Homo sapiens
atcgcgccactgcactccagcctgggcgacagagcgagactccatctcaaacaacaacaacgaaagaacacactggtctgtgtagcaagacagggagaaaraagattcctgtgtagaagtgaaaagcagatagcagacatgtgatggggttctagcgacacttacggtcttgaagtaaatactaattgagctcctaaaaat

SEQ ID NO: 78729 - DNA, 201 bp, Homo sapiens
gcagggagccttggcttccgggtggtgcaccagcgctgctcaagccagaggaagacgcctggggttagccccacagctcaggcatggggccagacacacaaggctcacaggctgggggatagcatctccactttgcatgaaggaaaccgaggtctgccttgttctgacccagagcaggcctccatgaatccctgtggccta

SEQ ID NO: 78730 - DNA, 201 bp, Homo sapiens
agcaaagattgagccactgcattccagcctgggtgacagagcaagactctgtcacacacacacacacacacacacacacacacacacacacacacacacamacaaagatgttacttgcaaaaggtggcggggggagggggttctgctactacaaaccaaaaatgaaaatgattatcattatattttatttttctaggtact

SEQ ID NO: 78731 - DNA, 201 bp, Homo sapiens
agcttacaatcatagtggaaggggaagaaaacatatccttcttcacatggtggcatcaaggagaaggctgagcaaaaaggggaaaagccccttataaaaayatcagatcttatgagaactcactcactatcaggagcacagcatgagggtaatcacccccatgattaaattaccttccaccaggtccctcctatgacacat

SEQ ID NO: 78732 - DNA, 201 bp, Homo sapiens
tccataaaatgaattataaattaatactgaaaatccaatttaaatttaggaccgcaggttttacttagcttcatcaactttacattggaatcactgccacrcagaaaattccagttcccagtggcatcaacataattgttaatttgctttatccctcaatgtacatatatccaaaaggcatatattgcagaagaattataa

SEQ ID NO: 78733 - DNA, 201 bp, Homo sapiens
caaccattccccgctcaacccctgcccaccctggtccatggaaaagttgtcattcatgaaatcagtctctgtgtcaaaacggttggggacagctgatgtastttatatggaataacaaatctgaataatatgactctgtcgtggaaactttaaagacctataagagagtggtctgaacagaacttgggaaatctgaagcga

SEQ ID NO: 78734 - DNA, 201 bp, Homo sapiens
cacactatcaaacttgtctccagggagctctgccaattttaccccacacttgaaaaaagaatcccaattttttgtcacctccacaacacagggaaataatrgtcccagaatgtttaaaatttgatatgaaaaatttctaaaactcctagtggttttttcacttttcttagtaataaattaaacttttgtatatatttattg

SEQ ID NO: 78735 - DNA, 201 bp, Homo sapiens
acaaaaaattagctgggtgtggtggcacatgcctgtagtcccaactgctcgggaggctgaggaaggagaatcacttgaacccgggaggcagaggttgcagygagccgagactgggccactgcactccagcctaggggagagagcgatactccgtctcaaaaaaaaaaaaatgaaattccaaagtgcagctatttaaattat

SEQ ID NO: 78736 - DNA, 201 bp, Homo sapiens
cctccgcctcctgcctcagcttcccgagtagctgggattaccgtacccagctaatttttgtagttttagtagagacggagtttcaccacattggccaggcyggtctcaaactcctgacctcaggtgatccacctgccttggcctcccaaagtgctgggattacaggtgtgagccactgcacctggcctagtgatagtcctg

SEQ ID NO: 78737 - DNA, 201 bp, Homo sapiens
ataacttaaaaacacgcatctgctgtatttagcaaataaatctatacatcacaggtgcagtggaagcaaacatgaaatttgaaacattttctctttaaaawcttcatttaaaaaatactgtattgttttccaattccagatcaccttttttttgttgttgttgttgttgtttttttgagatggaatttcgctcttgttacc

SEQ ID NO: 78738 - DNA, 201 bp, Homo sapiens
ctcagtaagtgttagtcttttcttccttctatcctattgtagacctaaaggggaactggaagagcctaaggtgggcacaaatgtgtcaggcatagaggatracttaaaaacacgcatctgctgtatttagcaaataaatctatacatcacaggtgcagtggaagcaaacatgaaatttgaaacattttctctttaaaatct

SEQ ID NO: 78739 - DNA, 201 bp, Homo sapiens
cttgtttgttaaatggaggtgataacagtatcttctctgtagcgtattatgatgattaaatgagttaatatacaaaaaacatttaaaataaggtatggtamataataagtgctaagtaggtgttcattattattgttacctagagattttttaataagcatataaaattaagaacaaatggtttgtcttaaagaaaaactt

SEQ ID NO: 78740 - DNA, 201 bp, Homo sapiens
aaatagatgtgcatttgtatcctggccccatcttgtagcaagtgtgtggcctgagtgagttgtttaacctgtctgagatttagcattctcatctgagcctraggaaaatagtcatctcccttgcatgtacatagtctaatacctggaactcagtaagtgttagtcttttcttccttctatcctattgtagacctaaagggg

SEQ ID NO: 78741 - DNA, 201 bp, Homo sapiens
ccatttttccattttggctgtctaattacattttaaaagtaaagctgctcagtgtgcttctgggtgtggtcgatagatgctgtcttgtgctattgagtgaragaatatgaatattgcaacacttctggaatgcagtttgtcagcatgcatctgtcaggtttcaatgtagtcttcaactcaatcactgtactgccatcgagt

SEQ ID NO: 78742 - DNA, 201 bp, Homo sapiens
cactgaggactgataatttaatcctgcagtgaaaatcactttatcccaccaaattttaagaacgaaatcaactaagaaggaaggggatacaaaagggatarttttcaatgatagagatgaagaaatgaaggtagagggaaatgtacacacagaaatctaataaaccaatcctaggctgacaggcagcaagttcagcttggt

SEQ ID NO: 78743 - DNA, 201 bp, Homo sapiens
tgtgtgtgtatacacatatgtgttctaacttaggtgtgtaaccctttgtagtttgatgtgggatctatcagtgaacagactttacacctgaaaatttcccrttagaacagtaattctttaatttttaggagtacattgctaataatcaaatgccactgaggactgataatttaatcctgcagtgaaaatcactttatccca

SEQ ID NO: 78744 - DNA, 201 bp, Homo sapiens
aaaggcatacttgagactgggtaatttataaaggaaagagactttattgattcacagttctgtatggctggggaggcctcaggaagcttacaatcatagtrgaaggggaagaaaacatatccttcttcacatggtggcatcaaggagaaggctgagcaaaaaggggaaaagccccttataaaaacatcagatcttatgaga

SEQ ID NO: 78745 - DNA, 201 bp, Homo sapiens
taaaggagcacatattgtatagcctatgcattttattatattaactctaaaacaggaaaataaatgaactgttaatgactcaccagggttttgcatgtcarttgaagctgacacccacatatacacatgtatcacaccttctatgttgaagtattagtataaaatagagattgtattgcaaccagaaaacatgaagttggt

SEQ ID NO: 78746 - DNA, 201 bp, Homo sapiens
ataaaggagcacatattgtatagcctatgcattttattatattaactctaaaacaggaaaataaatgaactgttaatgactcaccagggttttgcatgtcrattgaagctgacacccacatatacacatgtatcacaccttctatgttgaagtattagtataaaatagagattgtattgcaaccagaaaacatgaagttgg

SEQ ID NO: 78747 - DNA, 201 bp, Homo sapiens
aacacagtcatatgtgtttatagaagctttttaagacaagcgaaaacctgaaaacctagaaataagccaatatccaacagacatttgtttaataaaccaawtccccaacatgcatccttttataaaatggataaattgcgaaatggtaacacgattagatactacattacaatgagaaaagaacacatcactgctacagca

SEQ ID NO: 78748 - DNA, 201 bp, Homo sapiens
atgcagccagttgtgcaaagttgccaagctcccagctgcctgccctgaagagcacttttcatgaatgtttcactctagggagacatgacaatgttctacaygtaggattcactgaacctagttgagtttaaatgacaaaatgctatgattgtccaaactcaagacagtttcaaacacagactttattccaaagggcattgg

SEQ ID NO: 78749 - DNA, 201 bp, Homo sapiens
taacaatcatatatattatatataacatcatattaaaaacactgggtggctgatgtgtattttgggctagtttaaattataattataatggacatattttrtaattatagtggccataccctaggtggacgcattatgcagaaatgtattgccaagatctaagctggaaaagaaggtccatgagaaggccattgagggtat

SEQ ID NO: 78750 - DNA, 201 bp, Homo sapiens
aaacagccatgcagccagttgtgcaaagttgccaagctcccagctgcctgccctgaagagcacttttcatgaatgtttcactctagggagacatgacaatkttctacatgtaggattcactgaacctagttgagtttaaatgacaaaatgctatgattgtccaaactcaagacagtttcaaacacagactttattccaaag

SEQ ID NO: 78751 - DNA, 201 bp, Homo sapiens
taaaaattttacatacacacatccacatttgcagaatggtgtgcaaataccagctaatttttgtatactgagatcttaatatgtttcatattgaaactcaragttaacttgtcagtttgctgagccatctcctgataactttgtctcttggtagatattgaatattttttttaaagtggtgctttttataaggttacatca

SEQ ID NO: 78752 - DNA, 201 bp, Homo sapiens
gcccctctgtctcatgatgccaagcagagaatgaaaacagaactcattcacctgctctcacagtcatattccatcccatgtggaaatcggggggcctgagrcttggagatacagatgctgagagtgaggctcatggggaggccatcaggacaacccctgcacccagcactgcacccagagcagccagaggggagtttgcag

SEQ ID NO: 78753 - DNA, 201 bp, Homo sapiens
gctagagtatctgttacatttatcagaatatctctttttctggaaatgaattcattatttaatataaccttaatctgttaaattcacacataaaacttaartacattaaaaattttacatacacacatccacatttgcagaatggtgtgcaaataccagctaatttttgtatactgagatcttaatatgtttcatattgaa

SEQ ID NO: 78754 - DNA, 201 bp, Homo sapiens
ttgctagagtatctgttacatttatcagaatatctctttttctggaaatgaattcattatttaatataaccttaatctgttaaattcacacataaaacttmagtacattaaaaattttacatacacacatccacatttgcagaatggtgtgcaaataccagctaatttttgtatactgagatcttaatatgtttcatattg

SEQ ID NO: 78755 - DNA, 201 bp, Homo sapiens; identical to SEQ ID NO: 52684

SEQ ID NO: 78756 - DNA, 201 bp, Homo sapiens
ttatattcttctatgcctattttattaatacttgctagagtatctgttacatttatcagaatatctctttttctggaaatgaattcattatttaatataamcttaatctgttaaattcacacataaaacttaagtacattaaaaattttacatacacacatccacatttgcagaatggtgtgcaaataccagctaattttt

SEQ ID NO: 78757 - DNA, 201 bp, Homo sapiens
ttttgttggggggatatatactcagcagtgggatttctgaattatatggtagttctgttttttaattatttaaggaatcttaatactattttccataatggctgtactaatttacattcctaccaacagtatataagagtttccctttctccctgtttgtaccagcatttgttatttttttatctttttgataattgccat

SEQ ID NO: 78758 - DNA, 201 bp, Homo sapiens
gagagaggtgtggagagacagggtagcagataggagatgctaagaaaaatgaggtgtcccagagtggatattggagactgatcactatgagagtaaagtgwtgaggagagaagcagctttgacaatggccttgaaaataaatgggattctacatggaagcaggttgttttagacacccaggagcatagaagatacagacat

SEQ ID NO: 78759 - DNA, 201 bp, Homo sapiens
attaagactttgtgatgtaaattgcaattgttttccagttttttttctttgcttttagattttaaaagaattaatccattctttcaatacagatatggacwcatttttcactttaaatcttcaatccatttggaatttactatggtgtttagtctgagaaatggatccattgcattgttttcatatgtctgtgtatttatc

SEQ ID NO: 78760 - DNA, 201 bp, Homo sapiens
gttgtaggtttgttgcatcatgatgacattactcttgaatacttccgcatgcatctccagtaaatagatgcttatcttcaaaatcacgattgccaacatttaacaaaattaacaatcattttctaacactaaaattgtctattttgggccatcttcaggtggattcctaagttcttttgactccactgtagtatttttgat

SEQ ID NO: 78761 - DNA, 201 bp, Homo sapiens
ttctgagaattggttactatattaaggattataaaaatcttctaggttgtttttttaaaaatctgtgtgccagaagatttttaaaccttcataagataggmacacttttgtttgaaagctttggctgaatctgttttattctgttttccagagaagccatttgaagcagaatccaaaccatgaattgtagagaattaccct

SEQ ID NO: 78762 - DNA, 201 bp, Homo sapiens
agccaatacccttacattttcattctttagtcatgtgtttttgaaattaccaaagtcacttgagctaaggctgatgagtaatggtgataaccaagttgatwtttttaaaaatcaaaaggaagttgtgatgttaaagttacatttgttttctgcagtgagttgcaaaccagttactgacttttcaagttgtttctcttgatt

SEQ ID NO: 78763 - DNA, 201 bp, Homo sapiens
tatattagacagcttaaaaaaattagagtgagacagaatatacaaaaaagagactggctagaccaaggagctcaagtaggcttcatagtagatgtcaaatrccaattttaatttattagcagtgattgcctagagttttttttttttatttgagaaggattctgagacttcattctttagcgttccatgattgaatagcaa

SEQ ID NO: 78764 - DNA, 201 bp, Homo sapiens
tttaatgagtaacatttttagattttctctgaagtctttagaacaaacatttaaaatctggtgtcaaattattctggatactgatgcttaaaaaaaaaaaacaaatgtttgattattaccatcattcatgtattaatctaatatttattggatactattcctgtgccaagttgtgaactgggcatcaaagatataacagtg

SEQ ID NO: 78765 - DNA, 201 bp, Homo sapiens
gggatcactctttattctctggccaggttattttgtctgtgagttttgttattctttttttgttatgctatttttcttctgctaatgtgttgtctgtaacyttttccaagttgttgcatgcatctgctttgcttttaaaaatagattggatgaagctagaagagagagtggtatcatgttttaattacccaattaggagca

SEQ ID NO: 78766 - DNA, 201 bp, Homo sapiens
aacatactttccaagatatcatgcgttaaaaagcatttcaaaagtagattgtgcagatgtgccaatggatcagatgatcacctagattcaaaattatgtakattttatggatgtaattcattcaataattcagcaaataacaaagaaacaagcagacataaagtgaaaatatgacagttagtgataagtgctatgaataga

SEQ ID NO: 78767 - DNA, 201 bp, Homo sapiens
ccttatacttaaaggtgaccagaagtcctcaagtttccagataattactaatttaaaggaagtcagtctaattcattgcacttgattttgttttgcatgtrtgtgtttgcaggaaaaaaaccttcacagagttcaaaacccaaaatgtctatgaaattatacttcagtagccccccttccagcctggtcctggatctatga

SEQ ID NO: 78768 - DNA, 201 bp, Homo sapiens
tctttccctgtacattatgtgtttctgtgaattacttttagagaaaggtcagtttctcagggtgggacccataaacaagggcaactgggcagagccagggrttcaggtgactgtttggaccctctggaagggctttttactgtgctgccttgggagacagagtggtcagcttggaactgaccttaagcctaggtcacccaa

SEQ ID NO: 78769 - DNA, 201 bp, Homo sapiens
tgtgaactcgggaggcggagcttgcagtgagtcgggatcgcgccgctgcgctccagcctgggcgacaaagcaagactccgtctcaaaaaaaaaaaaaaaaragagagaaaaagaaccccgagctggaagccaaatgatctggaatcatgtctcctagacctgccagtttttatctgctactatgtcgacccgctggctcta

SEQ ID NO: 78770 - DNA, 201 bp, Homo sapiens; identical to SEQ ID NO: 52686

SEQ ID NO: 78771 - DNA, 201 bp, Homo sapiens; identical to SEQ ID NO: 52687

SEQ ID NO: 78772 - DNA, 201 bp, Homo sapiens; identical to SEQ ID NO: 52688

SEQ ID NO: 78773 - DNA, 201 bp, Homo sapiens
aacatgtatgaaatagagttgtgactcaagcaagggtttttgaagtagtgttctctctctctctctgtctctcgctgtttctctctctctgcatgtgtgtraaagagagagatgaaagaatattgatgaaagcagctacagtgctcatattgccccatgctctacttcccagcatatattaataatgataatcatgccaac

SEQ ID NO: 78774 - DNA, 201 bp, Homo sapiens
ctatttaaattatgagcattggtgcaccaaggatatttagctaaacaattgaccacagggctaagtattctaagcctgttgactgatcatgacttcacccragagcaaggaggctaattcagtagataattgattggaaaggaaaatgaagagtctctgatcttttctatagcttgaaaaaattagtttggctttataaaa

SEQ ID NO: 78775 - DNA, 201 bp, Homo sapiens
aattttttcattcttcaaaactgtgtaggaattgagagtccacttagttggggttgtgaccacaccactagttcaaatatgatggtcaaaatcttcattcyggtgctcctctacttggctaaataaacctttctttttggcaggaaatgaaaatctgtatgaataaacctcacatgagtcagctctctcttatatatgaaa

SEQ ID NO: 78776 - DNA, 201 bp, Homo sapiens; identical to SEQ ID NO: 52689

SEQ ID NO: 78777 - DNA, 201 bp, Homo sapiens
ctccagctattatggtcaatgtgtctctatctcctttagttctgtcaatttttgtcttacatagtttggagctatcttatatgcatacacggatttatgcycgttgaattaacacttttatcattatgaaatatctctctttatctatcataacacttcctctctcaatgtgtagctctgtcatatgaaataatcacacaa

SEQ ID NO: 78778 - DNA, 201 bp, Homo sapiens
caaactcagggctgatctggatttccaatgatataatttgagtgttagtagacagcatcctttgctgaagatgtacttcacactgccccttctcaagtctyccatgtaagtttctgggggaaaaaatggatccagagaaaggtagtcagtagcagttttccccctcacaccgaaattgcctcctgccctttgtctttgaat

SEQ ID NO: 78779 - DNA, 201 bp, Homo sapiens
tgacattactcttgaatacttccgcatgcatctccagtaaatagatgcttatcttcaaaatcacgattgccaacatttaacaaaattaacaatcattttckaacactaaaattgtctattttgggccatcttcaggtggattcctaagttcttttgactccactgtagtatttttgatcatttcctaattttgttgttgtg

SEQ ID NO: 78780 - DNA, 201 bp, Homo sapiens
cccatgacagtttttaaagttcttgctcttctgaatcaagcggaggcagagcagggtttgcacatcaatgaatcaatctctttaataaaaataaaggaaaatattgtaactggttactaaagggaagatgggtgatatttgcaaagtttctgtagcattataaaatacctttacacttttattccatagaaattatactca

SEQ ID NO: 78781 - DNA, 201 bp, Homo sapiens
tttcagagccaaacacatttgcttccctcacctcatctcctttttgactctgacctttctgtctccctctgatgaggaccttgagacagcattgtgcccasctagataatccagggtgatccccctatctcaagatccttaatttaatcacacctagaggttccttttgccatgtaacatattgtattcacaggaactcag

SEQ ID NO: 78782 - DNA, 201 bp, Homo sapiens
aacatgaaatttgaaacattttctctttaaaatcttcatttaaaaaatactgtattgttttccaattccagatcaccttttttttgttgttgttgttgttktttttttgagatggaatttcgctcttgttacccaggctggagtgcaatggcgcgatctccactcactgcaacctccgcctcctgcctcagcttcccgagt

SEQ ID NO: 78783 - DNA, 201 bp, Homo sapiens
caagattcacttttgctccagctccccaaaagttcctcatctccatctgagaccacctcagcctggactttattgtccataacattatcagcattttggtyaaagccatttaacaagtctttaggaagttccaaacttttccatattttcttatcttcttcaaactgttccaactgttccaaactgccctccaaactgttc

SEQ ID NO: 78784 - DNA, 201 bp, Homo sapiens
ccaaaatagtctccttcaactccatgtctcatatccaggtcacgctgctgcaagaggtaggatcccatggccttgggcagctatgctcctgtggctttgcmgggtacatctttcttcctggtttctttcatgggctggtgttgagtttctgggctttttcaagtgcatggtgcaagctgtcagtgaatctatcatcctggg

SEQ ID NO: 78785 - DNA, 201 bp, Homo sapiens; identical to SEQ ID NO: 52695

SEQ ID NO: 78786 - DNA, 201 bp, Homo sapiens; identical to SEQ ID NO: 52698

SEQ ID NO: 78787 - DNA, 201 bp, Homo sapiens; identical to SEQ ID NO: 52702

SEQ ID NO: 78788 - DNA, 201 bp, Homo sapiens; identical to SEQ ID NO: 52704

SEQ ID NO: 78789 - DNA, 201 bp, Homo sapiens; identical to SEQ ID NO: 52706

SEQ ID NO: 78790 - DNA, 201 bp, Homo sapiens; identical to SEQ ID NO: 52708

SEQ ID NO: 78791 - DNA, 201 bp, Homo sapiens; identical to SEQ ID NO: 52709

SEQ ID NO: 78792 - DNA, 201 bp, Homo sapiens; identical to SEQ ID NO: 52710

SEQ ID NO: 78793 - DNA, 201 bp, Homo sapiens
acttttaccaggaaaaaacgtaaggctcaactgctctgctttgctgaatgaagaggatgtaatttattggatgttcggggaagaaaatggatcggatcctratatacatgaagagaaagaaatgagaattatgtatgtatgtgtaatatatatgtcatgatatataccatataacaatcatatatattatatataacatca

SEQ ID NO: 78794 - DNA, 201 bp, Homo sapiens
taatttcctttataattttcctttatgtttgaatatagagaataaaaacattaccattagttttcaaattcctttttttgaatactttactctgtcaattstcaagtcccctaaaccttttaaaacctgaatttaaaatatattgtaataaaattagcatatttatattaaaagaattgcttaaaataaggaatttgaaag

SEQ ID NO: 78795 - DNA, 201 bp, Homo sapiens
tccagctattatggtcaatgtgtctctatctcctttagttctgtcaatttttgtcttacatagtttggagctatcttatatgcatacacggatttatgctygttgaattaacacttttatcattatgaaatatctctctttatctatcataacacttcctctctcaatgtgtagctctgtcatatgaaataatcacacaag

SEQ ID NO: 78796 - DNA, 201 bp, Homo sapiens
aaaaaggaaagaaatgaataccctaagactcagggaaacccgtttttttctttttaaatgcttaggttctagaagcatggacagccatgtagaaatgtgaytggacaaaagggtatgacctaatgctaatggactgagtggggaaacccagcaagacctgtccagattcttcttggcctctctgttatatttccttttcct

SEQ ID NO: 78797 - DNA, 201 bp, Homo sapiens; identical to SEQ ID NO: 52722

SEQ ID NO: 78798 - DNA, 201 bp, Homo sapiens; identical to SEQ ID NO: 9885

SEQ ID NO: 78799 - DNA, 201 bp, Homo sapiens; identical to SEQ ID NO: 9886

SEQ ID NO: 78800 - DNA, 201 bp, Homo sapiens; identical to SEQ ID NO: 9888

SEQ ID NO: 78801 - DNA, 201 bp, Homo sapiens
ttctcctgttcttgctcacatatctgcccactgcattctcaactgctcactctggcactgcactttctgagagggctcagggaggtgtgggagctgcaggwgcactcctgagtctcactgtactccactcaaccaggcattctgcttgctgagcacctgcaagtcccagaagggatgttctggacattgcttgggaatgcc

SEQ ID NO: 78802 - DNA, 201 bp, Homo sapiens; identical to SEQ ID NO: 52731

SEQ ID NO: 78803 - DNA, 201 bp, Homo sapiens
atggaagcaagagattgaggcaggatgtcagagagaggtgtggagagacagggtagcagataggagatgctaagaaaaatgaggtgtcccagagtggataytggagactgatcactatgagagtaaagtgttgaggagagaagcagctttgacaatggccttgaaaataaatgggattctacatggaagcaggttgtttta

SEQ ID NO: 78804 - DNA, 201 bp, Homo sapiens
aaagtgcacccgagagtcactggagggtagattatgagaaagacccattaatgctgaacttgaagtaccacaagtgccgaaagaggggaacgagcacctaycctgggtagatgatggtcagatatatttccaaagccagagaatctgggtcaattgagaaagagggaaagtgacagatatgcaaatttggattgatattat

SEQ ID NO: 78805 - DNA, 201 bp, Homo sapiens
taagcatttatatgagagctgtcctcttggaagtaagcatgtaagcagatcacacactttctataatgattttcttgaatcaaaccacttttaaaattcayctttagaaactcacaaaccaaggcacaaaatagccaatacccttacattttcattctttagtcatgtgtttttgaaattaccaaagtcacttgagctaag

SEQ ID NO: 78806 - DNA, 201 bp, Homo sapiens
ggctgccaaatagagctgttgatcttgccacaaccagaaagaaatctgtgcaaccaggaagctcttgctgcagctgccagctccagaaacagataggctgragtctaagttgactgagagccatctaatatggaattgttgattgagaaggccaattgtgcacctaactgagactgccaggagcagcagctttgagtggca

SEQ ID NO: 78807 - DNA, 201 bp, Homo sapiens
aacaaataggcattcaagttcagtgcagggtgaaagagcacaattgatggagcacatccgcccactgtggcctctgctgagatacagagagttagaacctycggcatctgctaggagcccccggcctgtgttgaggcaaatgactcgccagttgggtttgctggggctctcagcgaggagcagaaaggagacagttgtcca

SEQ ID NO: 78808 - DNA, 201 bp, Homo sapiens
gacgaaccggaagtcttgcctgttctttccgagtcttaatcttcagaaacagtgaacgccaaaaagaactcaagatattctggggactgagcatatgaacytgttcataacaaaggctgtgactcgaaataattaactttgtcaaaatcctgctcacaatttgaagatgaaacttgtcattaggttggcgggaatgagact

SEQ ID NO: 78809 - DNA, 201 bp, Homo sapiens
tgtggactagttaatcctcactagtaactcttactagaaataaacacgggttaattattactagaaaatgcatgggtttttattgtgttgatattggtgaygaaatttaagtagaaaataggaaaattgaaaagggaaaaataacaggaaagcggtgatccccatcagatcatagctatgaaattcaatgttttttttatt

SEQ ID NO: 78810 - DNA, 201 bp, Homo sapiens
aaaaaatgaatgagctagcccccagagagctatcccattttccttaaaaacaaatgaataaggtcctttaagcaagaaataaccacgtaagtcaacaatcratagtgagaaaacaaactaatgagcttccaatagtctcttctcttgggctctgttctttgtgcttcacggttctctgaaactttggggaaagggagaggg

SEQ ID NO: 78811 - DNA, 201 bp, Homo sapiens
cagcctgcctcagcagggtaccaggctcagggtccttgtgtgtgctcattcattcattgcctcctgaacttggcaagcaggccattgatagccctgatctstgggctcttaaagtttttcagtgctcacctgatggagggccccagggtcgccatccctttcctccaccaaagtagcacagcccagggccttcagcccagt

SEQ ID NO: 78812 - DNA, 201 bp, Homo sapiens
ctgctcgggaggctgaggaaggagaatcacttgaacccgggaggcagaggttgcagcgagccgagactgggccactgcactccagcctaggggagagagcratactccgtctcaaaaaaaaaaaaatgaaattccaaagtgcagctatttaaattatgagcattggtgcaccaaggatatttagctaaacaattgaccaca

SEQ ID NO: 78813 - DNA, 201 bp, Homo sapiens
cctctctgcctcagattcctcatcatgaaatgggacagtaatggttcatccctcgtagggttggctgacaatgactgagtgagtgtgtgtacagctctagratggctctagggacagtaagagttctgctgtaatgaccatctcccactgctaggttcccaaacctcacctgcagcacaagctattcttctcccataattg

SEQ ID NO: 78814 - DNA, 201 bp, Homo sapiens
tcttgctaaccttgcttcttcacctaatgcattaggagaccaaaaaaagttaccttgtcattttggtttttgtttttatttattttactttactaatcttytgaagaatcttgtacttcacgtccccacattactgtggttgaaggggaacctttctatctgaaacattgctcgtgttcacttgcacatgagattgaaaca

SEQ ID NO: 78815 - DNA, 201 bp, Homo sapiens
gctgtaggaatatccattattaaaagggtgcttgttatgggccagggatagtgccaagtactggagttgaatcatgtcatataatcctcacaacagctctrtgagactgtggccttgggtgagttaatttccttagttcctctctgcctcagattcctcatcatgaaatgggacagtaatggttcatccctcgtagggttg

SEQ ID NO: 78816 - DNA, 201 bp, Homo sapiens
aaataaggaatttgaaagcaattaatagttgaaaagctaatttttcataggtaagagcaaagctatattgtatgtaatataaacccatatttgatgaaatygtcttcccagtttgttgcaatccattacatcataagaaaattatgccctttaaaaaagtgtgctcatttaattgtcttacatgttgatgcctgttttgtc

SEQ ID NO: 78817 - DNA, 201 bp, Homo sapiens
acgtttattgtagtccatgctttaagagtactggccagaaagggaagaaataatgcaggcaacatcacagctgccttcaagcattttaaacatgtgaattmccctctcaagggtaacgaacagagcctactgctaaattattttgccctcttacaggactccagaaggcaaatggcatgcttcaaaagtattgagaattga

SEQ ID NO: 78818 - DNA, 201 bp, Homo sapiens
gacatttaaaaccctctgttctagctatttttaaatctataataccatcttgttaaccataggcaccctatgtgcaatgaaacaccaaaatttacccctcytaactgtacttttgtacctataggccaatttctccctatccttctgcttcctagcctctggtaaccactatcctaactctctacttctatgtgttcaact

SEQ ID NO: 78819 - DNA, 201 bp, Homo sapiens
ctggatgtttttgttgtaggtttgttgcatcatgatgacattactcttgaatacttccgcatgcatctccagtaaatagatgcttatcttcaaaatcacgattgccaacatttaacaaaattaacaatcattttctaacactaaaattgtctattttgggccatcttcaggtggattcctaagttcttttgactccactgt

SEQ ID NO: 78820 - DNA, 201 bp, Homo sapiens; identical to SEQ ID NO: 52769

SEQ ID NO: 78821 - DNA, 201 bp, Homo sapiens
tgtcctttgttcagcaactcaaatatgcagtaatctgaaaggtcagataatcaccacatccttttctttcctactcttcctatgacatgaaatacattctwtgttatggaacaaaataagtttatctctctctgcttattttcttagtgaccttaatgaaaggagattactttgataggatttccttttaggggatcctta

SEQ ID NO: 78822 - DNA, 201 bp, Homo sapiens
tttcttttagaagcacttctagagtgagtcctgatcattatcaaccatgctgttgagagcagagtgagctaccactgtgaaaccttggtagcacttctgtrgttttgcaccaaatcaggtcatttttgtttgtttttatacataggaactcccaggcatcagaaaaaaattaaataactcttttgataaaaatcagtacat

SEQ ID NO: 78823 - DNA, 201 bp, Homo sapiens
ttacatcataagaaaattatgccctttaaaaaagtgtgctcatttaattgtcttacatgttgatgcctgttttgtcactgacacagtgacaaccctagtgraagcactagctcttacttaactagtagatagttatatttgatagcagtttaagaaaagtttgagggggaacctacttactgattgataactggttttatt

SEQ ID NO: 78824 - DNA, 201 bp, Homo sapiens
gatacagacatattcaaatatagcataattagtaagcagtatttactgcagatgtgtgtgtatacacatatgtgttctaacttaggtgtgtaaccctttgyagtttgatgtgggatctatcagtgaacagactttacacctgaaaatttcccgttagaacagtaattctttaatttttaggagtacattgctaataatcaa

SEQ ID NO: 78825 - DNA, 201 bp, Homo sapiens
gagacagcattgtgcccacctagataatccagggtgatccccctatctcaagatccttaatttaatcacacctagaggttccttttgccatgtaacatatygtattcacaggaactcaggagtaggatgtgggaaacttcagggtctattattctgcctgccacagcccagaacctgggaaacccataactgaattttaaa

SEQ ID NO: 78826 - DNA, 201 bp, Homo sapiens
aaaccacttttaaaattcatctttagaaactcacaaaccaaggcacaaaatagccaatacccttacattttcattctttagtcatgtgtttttgaaattascaaagtcacttgagctaaggctgatgagtaatggtgataaccaagttgatttttttaaaaatcaaaaggaagttgtgatgttaaagttacatttgttttc

SEQ ID NO: 78827 - DNA, 201 bp, Homo sapiens
ttcagaggctgcagggcctcagcctcaggatgcatttaatgtatcctggccacagttgcagccaacggttcttgaaagctcggtaaggccctgcaacgcasagcctgcttatgtggatctatttatgggaacttcttaaaaggaccccagaatagctctttatctttcacaagagacacaaattctaattgagttaattat

SEQ ID NO: 78828 - DNA, 201 bp, Homo sapiens
cttcagaggctgcagggcctcagcctcaggatgcatttaatgtatcctggccacagttgcagccaacggttcttgaaagctcggtaaggccctgcaacgcmgagcctgcttatgtggatctatttatgggaacttcttaaaaggaccccagaatagctctttatctttcacaagagacacaaattctaattgagttaatta

SEQ ID NO: 78829 - DNA, 201 bp, Homo sapiens
ctttccgagtcttaatcttcagaaacagtgaacgccaaaaagaactcaagatattctggggactgagcatatgaacctgttcataacaaaggctgtgactmgaaataattaactttgtcaaaatcctgctcacaatttgaagatgaaacttgtcattaggttggcgggaatgagactaaagattgcgctgtgggctgtggt

SEQ ID NO: 78830 - DNA, 201 bp, Homo sapiens
ctttctataatgattttcttgaatcaaaccacttttaaaattcatctttagaaactcacaaaccaaggcacaaaatagccaatacccttacattttcattytttagtcatgtgtttttgaaattaccaaagtcacttgagctaaggctgatgagtaatggtgataaccaagttgatttttttaaaaatcaaaaggaagttg

SEQ ID NO: 78831 - DNA, 201 bp, Homo sapiens
ataaaacagctttcttttccatggttcagatgcccttaaactgtgaagtctattttagagaatcagcacaactacctttctagggcacgtgaagaaacacytcttacatgtctgtcatgtcctagaagcatttactcattagagctatatcttctcaaagcagtgagaagccttaggccccacgtattccaaacccaggaa

SEQ ID NO: 78832 - DNA, 201 bp, Homo sapiens
gcacacttttgtttgaaagctttggctgaatctgttttattctgttttccagagaagccatttgaagcagaatccaaaccatgaattgtagagaattaccsttgaccctttgggtgcttatatctgtaagcactgcaggtaagtgattatacatactctcaaacatatttcatgagtaattgaggaagaatgtcaaagttt

SEQ ID NO: 78833 - DNA, 201 bp, Homo sapiens
acgtgatgcaaaataaccgatgccctacaaaaagggcgcatctttaagagttttaatgccagtgcttaattcgaatgaggggattttaagtgtctgaagasgcattttctagggaccagtgggtgactgagtaactgaaatgctgctttcactccctaacaccatggatctggttgtgcataggatgtgggaggaggggct

SEQ ID NO: 78834 - DNA, 201 bp, Homo sapiens
ggagcatggtctttgttatttaggagacattttcaccttcttgggggtctttctgagcatagaaattgtgatggtggtagaattaaatgatatgagtaaamcagggtgagattttctttccactcctggaatgaggacacctttgggctcttggccttctaaggaacttaaagacttaagttcctttagtgcccagatcta

SEQ ID NO: 78835 - DNA, 201 bp, Homo sapiens
aaaatagattggatgaagctagaagagagagtggtatcatgttttaattacccaattaggagcatggtctttgttatttaggagacattttcaccttcttrggggtctttctgagcatagaaattgtgatggtggtagaattaaatgatatgagtaaaccagggtgagattttctttccactcctggaatgaggacacctt

SEQ ID NO: 78836 - DNA, 201 bp, Homo sapiens
gtaataaaattagcatatttatattaaaagaattgcttaaaataaggaatttgaaagcaattaatagttgaaaagctaatttttcataggtaagagcaaasctatattgtatgtaatataaacccatatttgatgaaatcgtcttcccagtttgttgcaatccattacatcataagaaaattatgccctttaaaaaagtgt

SEQ ID NO: 78837 - DNA, 201 bp, Homo sapiens
agttttcaaattcctttttttgaatactttactctgtcaattctcaagtcccctaaaccttttaaaacctgaatttaaaatatattgtaataaaattagcrtatttatattaaaagaattgcttaaaataaggaatttgaaagcaattaatagttgaaaagctaatttttcataggtaagagcaaagctatattgtatgta

SEQ ID NO: 78838 - DNA, 201 bp, Homo sapiens; identical to SEQ ID NO: 52787

SEQ ID NO: 78839 - DNA, 201 bp, Homo sapiens
ctccagactaaaggcaggaatgtggagtcactcagtggaatgtgtcagcacgtgggttggcaactactgcattagtgttagcagtaaaaatggacaagcaygtgatgatggacaacactggtaagatttcttgattattttcttttcctttttccctttcttttctagcagacatggctgatatcccaggccacgtcttca

SEQ ID NO: 78840 - DNA, 201 bp, Homo sapiens
ttagtagagacggggtttcaccgtgttagccaggatggtctcgatctcctgacctcgtgatccccctgccttggtctcccaaagtactgggattacaggcrtaagccactgcaccaggctggaaaatgtgtttctttgcctttgctttctccagcttctagagaccacttgcatttcttggcttgtgccacttcatttcag

SEQ ID NO: 78841 - DNA, 201 bp, Homo sapiens
tgcctcagcagggtaccaggctcagggtccttgtgtgtgctcattcattcattgcctcctgaacttggcaagcaggccattgatagccctgatctgtgggmtcttaaagtttttcagtgctcacctgatggagggccccagggtcgccatccctttcctccaccaaagtagcacagcccagggccttcagcccagtagctg

SEQ ID NO: 78842 - DNA, 201 bp, Homo sapiens
gcggtggctcacgcctgtaatcccagcactttgagagtccgagacgggcagatcacgaggtcaggagatcgagaccatcctggctaacagagtgaaacccygtctctactaaaaatacaaaaaattagccgggcgtggtggtaggcgcctgtagtcccagctactcgggaggctgaggcaggagaatggcgtgtgaactcg

SEQ ID NO: 78843 - DNA, 201 bp, Homo sapiens; identical to SEQ ID NO: 52810

SEQ ID NO: 78844 - DNA, 201 bp, Homo sapiens
ttagaaaaagtatggccaagagggaattcaagttcatattaagcaaagagagaaaaagagagcacttggctgctttaactttacattttaaaatgtttatwatgaaacatttgaaacatatggagaagtagaaggaaatatgcaacaaatattcatatatctacaatccagactcaaagattgttaacattttcccatatt

SEQ ID NO: 78845 - DNA, 201 bp, Homo sapiens
ggcctctgctgagatacagagagttagaacctccggcatctgctaggagcccccggcctgtgttgaggcaaatgactcgccagttgggtttgctggggctytcagcgaggagcagaaaggagacagttgtccaaagagaggacattagcaaaatcagtgccccaaaccaagttgaatcatagctgtaaatactcagaggaa

SEQ ID NO: 78846 - DNA, 201 bp, Homo sapiens
ggcaggggcctgcggaggggaagcgggctgtctaggactggctctgaggaggaaaagagagtgagagggatgctcaggattccttataagccattaaaaamaaataggcattcaagttcagtgcagggtgaaagagcacaattgatggagcacatccgcccactgtggcctctgctgagatacagagagttagaacctccg

SEQ ID NO: 78847 - DNA, 201 bp, Homo sapiens
gaatatagagtcatcattgtattctaaagttatttgaaattattcctcttattgtggttttgtcagttaaacatatttatttgttttgttctgatttttakgaattgatttttaaaattttattttgttttataatagggcaaaacatttttcaaaatgatgttggtttatccttctatatttttatataagtaaatattc

SEQ ID NO: 78848 - DNA, 201 bp, Homo sapiens
ccagagggcgaaagatatctctccattgtgcatctgcctcttttgacgttggaagacacatgtcttactccccaaagggagcccagcactgggagccttcytgatgatctcaaaaataatagctattcaagaaaatcaccaagtgactgtgaaaccgtcagttcggaaggctggttagaacatgtgggagcaacatgaatg

SEQ ID NO: 78849 - DNA, 201 bp, Homo sapiens
gctacagagcagggaagggaagcagatctagggaggaaggcagttttgatttgaggaggtttgcacatgtagagaagcatactggagaagcatatccagarggcgaaagatatctctccattgtgcatctgcctcttttgacgttggaagacacatgtcttactccccaaagggagcccagcactgggagccttcttgatg

SEQ ID NO: 78850 - DNA, 201 bp, Homo sapiens; identical to SEQ ID NO: 52814

SEQ ID NO: 78851 - DNA, 201 bp, Homo sapiens; identical to SEQ ID NO: 52815

SEQ ID NO: 78852 - DNA, 201 bp, Homo sapiens
acccaggagcatagaagatacagacatattcaaatatagcataattagtaagcagtatttactgcagatgtgtgtgtatacacatatgtgttctaacttargtgtgtaaccctttgtagtttgatgtgggatctatcagtgaacagactttacacctgaaaatttcccgttagaacagtaattctttaatttttaggagta

SEQ ID NO: 78853 - DNA, 201 bp, Homo sapiens
catttccaacaagcattatggtaatcaacaaagcctctaatggtaaaccatgattagatatccaaagcttctagctgcctgaggaggggggtggtgtggastttcaattatcaacctcccacctctggagagtgtgtaattcacattaagtttcttcaaatggtaatacttccagagagcacatgtccatccaaacacagt

SEQ ID NO: 78854 - DNA, 201 bp, Homo sapiens
ttggcataaggcagcatggtgtggcagttaagagatgggctgtgcagcccatcctgagctccagtcctgagtttgctacttacttctgtggcctctggaamcttatccaacctcttggtgcttcagtttcctcatctgtgaaattagaatttataataattgcacctacctcccaggggtaactaaatgaataaatataat

SEQ ID NO: 78855 - DNA, 201 bp, Homo sapiens
gttgcagccaacggttcttgaaagctcggtaaggccctgcaacgcagagcctgcttatgtggatctatttatgggaacttcttaaaaggaccccagaatarctctttatctttcacaagagacacaaattctaattgagttaattatctgggcctttcactttggatgctctgaaacatttgttgattttgtgtgaatgtt

SEQ ID NO: 78856 - DNA, 201 bp, Homo sapiens
acatggtggcatcaaggagaaggctgagcaaaaaggggaaaagccccttataaaaacatcagatcttatgagaactcactcactatcaggagcacagcatragggtaatcacccccatgattaaattaccttccaccaggtccctcctatgacacatggggcttatgggaactacaattcaagatgatttgggttggggta

SEQ ID NO: 78857 - DNA, 201 bp, Homo sapiens
tctggttgtgcataggatgtgggaggaggggctggcagggccgccttcagaggctgcagggcctcagcctcaggatgcatttaatgtatcctggccacagytgcagccaacggttcttgaaagctcggtaaggccctgcaacgcagagcctgcttatgtggatctatttatgggaacttcttaaaaggaccccagaatagc

SEQ ID NO: 78858 - DNA, 201 bp, Homo sapiens
aatcccatattcagcaagtgtgaagctggacgtgatgcaaaataaccgatgccctacaaaaagggcgcatctttaagagttttaatgccagtgcttaattygaatgaggggattttaagtgtctgaagaggcattttctagggaccagtgggtgactgagtaactgaaatgctgctttcactccctaacaccatggatctg

SEQ ID NO: 78859 - DNA, 201 bp, Homo sapiens
ttttttaataagcatataaaattaagaacaaatggtttgtcttaaagaaaaacttattagtgaggttaggagttaatataaaataagactgtgcaaaatgrcttttatctcatgttccccctttcagttatcttaaattaataggggttatcttgcattttcagctgttgttgatgaaatccactcactgatagagaaaag

SEQ ID NO: 78860 - DNA, 201 bp, Homo sapiens
cgttattttctaggggcctttcttgaaaacagatttattcttaattcataaataaaaataatgtttgaatattcagctgtaattaggtttggttaaacctstatttgagaacagtgagaggtctagaacaggggttggcagtttaccagccacgggttccatcacacctgcaacccttattgaaacacagccacgcacatt

SEQ ID NO: 78861 - DNA, 201 bp, Homo sapiens
tgagattttctttccactcctggaatgaggacacctttgggctcttggccttctaaggaacttaaagacttaagttcctttagtgcccagatctatggctyatatatctctgtattcttctgtggtgtcaagcagtgggatcttaaagtagatgcttaaaaacacattggctaattggttgcttggttagcatgggaggtt

SEQ ID NO: 78862 - DNA, 201 bp, Homo sapiens
ttttccaagttgttgcatgcatctgctttgcttttaaaaatagattggatgaagctagaagagagagtggtatcatgttttaattacccaattaggagcawggtctttgttatttaggagacattttcaccttcttgggggtctttctgagcatagaaattgtgatggtggtagaattaaatgatatgagtaaaccagggt

SEQ ID NO: 78863 - DNA, 201 bp, Homo sapiens
agatttttataggtttagttttcacatttagaactttaaattgaacaacataaaattagcaaggttagtgaatttagctttgagcctgcatgtgcacgtgygagtttgctatggggagagatgatgctgtaacaaacggggaaatctgtatttgatattttctgaatggtctctgtttgcataggccagtgtttgtcttca

SEQ ID NO: 78864 - DNA, 201 bp, Homo sapiens
tctgagatttttataggtttagttttcacatttagaactttaaattgaacaacataaaattagcaaggttagtgaatttagctttgagcctgcatgtgcaygtgtgagtttgctatggggagagatgatgctgtaacaaacggggaaatctgtatttgatattttctgaatggtctctgtttgcataggccagtgtttgtc

SEQ ID NO: 78865 - DNA, 201 bp, Homo sapiens
aaatggaaattaaatgtcatcagaagaaataaacacagctgtttcactgaaagacaagtaactagtaaaattgtggaagttaaaaaattttttcagataayctgtgaaaacagttactatcaaacactggtcaacagcacatcattgtataaggtaatgcttttataatattttaactttaagacttgatggaaaagataa

SEQ ID NO: 78866 - DNA, 201 bp, Homo sapiens
atgaagtgagtaaccctttcttttcaaaatgtatttcacagccctcttgtcctttgttcagcaactcaaatatgcagtaatctgaaaggtcagataatcascacatccttttctttcctactcttcctatgacatgaaatacattctatgttatggaacaaaataagtttatctctctctgcttattttcttagtgacctt

SEQ ID NO: 78867 - DNA, 201 bp, Homo sapiens
gcaactcaaatatgcagtaatctgaaaggtcagataatcaccacatccttttctttcctactcttcctatgacatgaaatacattctatgttatggaacaraataagtttatctctctctgcttattttcttagtgaccttaatgaaaggagattactttgataggatttccttttaggggatccttaccaatgacaagtg

SEQ ID NO: 78868 - DNA, 201 bp, Homo sapiens
ctgtggacaaaaatgagtggttttcataaccaggatgggctgggcctgcagcaggaaagtgtggtcacagctttgggtcagttggcctcagtgttaacccyagccttggagctcctggatggcaggtgcagtgtgttgttgattgtttcagtgttcccagagcagtgtcctgcacatggagtgtcatcagtcctctagcat

SEQ ID NO: 78869 - DNA, 201 bp, Homo sapiens
tcaaaaatcagaactttagttgccaacttttaccaggaaaaaacgtaaggctcaactgctctgctttgctgaatgaagaggatgtaatttattggatgttyggggaagaaaatggatcggatcctaatatacatgaagagaaagaaatgagaattatgtatgtatgtgtaatatatatgtcatgatatataccatataaca

SEQ ID NO: 78870 - DNA, 201 bp, Homo sapiens
ataatgcaggcaacatcacagctgccttcaagcattttaaacatgtgaattcccctctcaagggtaacgaacagagcctactgctaaattattttgccctyttacaggactccagaaggcaaatggcatgcttcaaaagtattgagaattgaaaatattggtgaaagcaatctaaatgttttatataattgcactgtggcc

SEQ ID NO: 78871 - DNA, 201 bp, Homo sapiens
tgtgcctagtgactgtgtgtgtcatttatagagttgacttggttctattttatagacatttaacgagaagagatgaaacattaacaggtaacacatataaygctggaatttcttaccttatgttctcattaagaaatcagataaataggcattaatcttcatcttattgtgatgatattgtagaattaatctgtgggagag

SEQ ID NO: 78872 - DNA, 201 bp, Homo sapiens
gttctctaaatatccgtgtacacatttttattctttaaaaatctgagtagaaatatcactactccagactaaaggcaggaatgtggagtcactcagtggartgtgtcagcacgtgggttggcaactactgcattagtgttagcagtaaaaatggacaagcacgtgatgatggacaacactggtaagatttcttgattattt

SEQ ID NO: 78873 - DNA, 201 bp, Homo sapiens
tgtaagtgaagcagttagtatcttcattttacagatgaaggtaccaaggtttaagggcattcacgatttttcctacaatacaaaataattgatggagcccrgctgcaaacccagacaaatgtcaatccagtgctctctctcttctctcaaaactatgcacctcaacccacttgctaatatttctgtgagtccctatgtgtt

SEQ ID NO: 78874 - DNA, 201 bp, Homo sapiens
tgtattaactactttttgtgtaatatttcatttaatcttccccaaaggagcagccttgtaagtgaagcagttagtatcttcattttacagatgaaggtacmaaggtttaagggcattcacgatttttcctacaatacaaaataattgatggagcccagctgcaaacccagacaaatgtcaatccagtgctctctctcttct

SEQ ID NO: 78875 - DNA, 201 bp, Homo sapiens
gagccccagaccctgagtctgctcagagttcactattaaacaacattagctgcttgcctgaatcctaaagatagtagaaagatatggaaagataatttttraaaattgcaccaagatggcaaaagttttaagcacgtttatgctcattgacctagagatgcccccaccattacaatctattttaagaaagaattagaaata

SEQ ID NO: 78876 - DNA, 201 bp, Homo sapiens
cagcacgggaggcacagacaccaaaagcttcatcttggtgagaaaaggtgagaaagatttatttttggaagttttgaaacttagctcattgctactgagaracatttcaaagatggccactttctcattttccacaccagaacccagctcctgagaggggaaatcagtcacctcatgtcacaggcattcagtggggcccct

SEQ ID NO: 78877 - DNA, 201 bp, Homo sapiens
ccagtcttctgctcttagaatttatgttacaaagaagtcttatgcatgcatatttcatgctttttccttagaatatttttgggatattagacataggattkctgggtcagagggtaatacatatgtaattttgctccatattgcctaattcatcttcataggggttgtaacattttgtattcttatcatcaatgtcttgga

SEQ ID NO: 78878 - DNA, 201 bp, Homo sapiens
catgcttcaaaagtattgagaattgaaaatattggtgaaagcaatctaaatgttttatataattgcactgtggccagcacgggaggcacagacaccaaaarcttcatcttggtgagaaaaggtgagaaagatttatttttggaagttttgaaacttagctcattgctactgagagacatttcaaagatggccactttctca

SEQ ID NO: 78879 - DNA, 201 bp, Homo sapiens
tatgtatgtatgtgtaatatatatgtcatgatatataccatataacaatcatatatattatatataacatcatattaaaaacactgggtggctgatgtgtrttttgggctagtttaaattataattataatggacatattttataattatagtggccataccctaggtggacgcattatgcagaaatgtattgccaagatc

SEQ ID NO: 78880 - DNA, 201 bp, Homo sapiens
tcctaatatacatgaagagaaagaaatgagaattatgtatgtatgtgtaatatatatgtcatgatatataccatataacaatcatatatattatatataayatcatattaaaaacactgggtggctgatgtgtattttgggctagtttaaattataattataatggacatattttataattatagtggccataccctaggt

SEQ ID NO: 78881 - DNA, 201 bp, Homo sapiens
agaggatgtaatttattggatgttcggggaagaaaatggatcggatcctaatatacatgaagagaaagaaatgagaattatgtatgtatgtgtaatatatrtgtcatgatatataccatataacaatcatatatattatatataacatcatattaaaaacactgggtggctgatgtgtattttgggctagtttaaattata

SEQ ID NO: 78882 - DNA, 201 bp, Homo sapiens
actttaaatcttcaatccatttggaatttactatggtgtttagtctgagaaatggatccattgcattgttttcatatgtctgtgtatttatcacaacaccwcttcttaaaaagttcatttttttacccactaacataagatgcccatttaatgtctattcaatttccatatcctattagacctagttctggaccatctatt

SEQ ID NO: 78883 - DNA, 201 bp, Homo sapiens
taggggacataatagagccttccaagcgtaaatatgattcattattgaatgacactggatacacatttcatatttactgaataacattacaaaactaagaraagagtgccattttttgaatgttgccacttttaacctgacttaaaagtggcaacattttaaagttcaagagacagtggaactgcctgtggtctgtagact

SEQ ID NO: 78884 - DNA, 201 bp, Homo sapiens
ccctagcaaagattctacatgagggttccacccctgcagcaaacttttgcctggacatccagcatttccatacatcctctgaaacctaggcgtaggttccyaaacctcaattcttgacttttgtgcacctgcagcctcaacaccatgtggaaggtgccaaggtttggggcttgcaccctctgaagccacagcctgacctgg

SEQ ID NO: 78885 - DNA, 201 bp, Homo sapiens; identical to SEQ ID NO: 52690

SEQ ID NO: 78886 - DNA, 201 bp, Homo sapiens
atatataatttgttttttcaatgattctatactcattacttacgacattcacttaagtttgtacttaaataaaattttatttacacatgaattaaaagagycaatcttacctcctagatggaaaaacatatgatgcttttgtgtcttacctaaaagaatgccgacctgaaaatggagaggagcacacctttgctgtggaga

SEQ ID NO: 78887 - DNA, 201 bp, Homo sapiens
gttcattattattgttacctagagattttttaataagcatataaaattaagaacaaatggtttgtcttaaagaaaaacttattagtgaggttaggagttartataaaataagactgtgcaaaatgacttttatctcatgttccccctttcagttatcttaaattaataggggttatcttgcattttcagctgttgttgatg

SEQ ID NO: 78888 - DNA, 201 bp, Homo sapiens
ttaaaaatgcccttggcataaggcagcatggtgtggcagttaagagatgggctgtgcagcccatcctgagctccagtcctgagtttgctacttacttctgkggcctctggaaccttatccaacctcttggtgcttcagtttcctcatctgtgaaattagaatttataataattgcacctacctcccaggggtaactaaatg

SEQ ID NO: 78889 - DNA, 201 bp, Homo sapiens
ttgagtgtaaattgctttggaaatcagaaaaactttaaaaagaaagaaacttaagagttacggaaaagcaaaaatattgatgttaaacataacaattaaaracccttaaaattcttacatgtgagacatttaatatttatattcttctatgcctattttattaatacttgctagagtatctgttacatttatcagaatatc

SEQ ID NO: 78890 - DNA, 201 bp, Homo sapiens
gggtttcaccatgttagtcaggatggtctcagtctcctgacctcatgatccgcccatctcggcctcccaaagtgctgggattacaggcatgagccactgtkcccggccaaacatcttaattatgtgacaacatttataaaaagtacaagaaaacatgttaaaatattatacatgttgagattattttcttctttcagtctt

SEQ ID NO: 78891 - DNA, 201 bp, Homo sapiens
ttattttgtttgttagagtttaagcgtgtgtgtgtgtgtgtatgttatgccccaagatcattttctcctctttgcatttggttgttttatcatctcacagkctgagtaaaacgactatgcatggaacactgtagaagaaaaattatattaaaaaaaaactggtgttatgattttcatccaggcattttgtctcaggagttg

SEQ ID NO: 78892 - DNA, 201 bp, Homo sapiens; identical to SEQ ID NO: 52692

SEQ ID NO: 78893 - DNA, 201 bp, Homo sapiens; identical to SEQ ID NO: 9880

SEQ ID NO: 78894 - DNA, 201 bp, Homo sapiens
agactctgttgtatcagagaaataaattattagggatttcttccagaagaaaaacttcattgccttgaaattttattaattttatatggctgaaagttctragaattggttactatattaaggattataaaaatcttctaggttgtttttttaaaaatctgtgtgccagaagatttttaaaccttcataagataggcacac

SEQ ID NO: 78895 - DNA, 201 bp, Homo sapiens
gctttaggttaacatacattgattatattgttttgaaacttttaagaaacctgagtttcaaaaatcagaactttagttgccaacttttaccaggaaaaaamgtaaggctcaactgctctgctttgctgaatgaagaggatgtaatttattggatgttcggggaagaaaatggatcggatcctaatatacatgaagagaaag

SEQ ID NO: 78896 - DNA, 201 bp, Homo sapiens; identical to SEQ ID NO: 52694

SEQ ID NO: 78897 - DNA, 201 bp, Homo sapiens; identical to SEQ ID NO: 9882

SEQ ID NO: 78898 - DNA, 201 bp, Homo sapiens
atttaaagcaaggcatatttattctctttctgggatggagcaccacgttttgctttaggttaacatacattgattatattgttttgaaacttttaagaaamctgagtttcaaaaatcagaactttagttgccaacttttaccaggaaaaaacgtaaggctcaactgctctgctttgctgaatgaagaggatgtaatttatt

SEQ ID NO: 78899 - DNA, 201 bp, Homo sapiens; identical to SEQ ID NO: 52697

SEQ ID NO: 78900 - DNA, 201 bp, Homo sapiens; identical to SEQ ID NO: 9883

SEQ ID NO: 78901 - DNA, 201 bp, Homo sapiens
ttttacgctgtccgagcgcttagcagtaattctgcaagcctgtgcagctgccgagagcttcactggattttcttgtttctatgagactctttctgttaatyacaaaccaaagcaaattctgccatggaatgaaatggccacctatcttagctcaccctagaaaggatccttcttaagtacgcttgtagttcaaaaatttct

SEQ ID NO: 78902 - DNA, 201 bp, Homo sapiens
atgtgtttgatgcaggcctcttctctaatgagacttgctctcctgattaccatgagactgcaagtgatatcatacagcctttacatccttttacgctgtcygagcgcttagcagtaattctgcaagcctgtgcagctgccgagagcttcactggattttcttgtttctatgagactctttctgttaattacaaaccaaagc

SEQ ID NO: 78903 - DNA, 201 bp, Homo sapiens; identical to SEQ ID NO: 52700

SEQ ID NO: 78904 - DNA, 201 bp, Homo sapiens; identical to SEQ ID NO: 52701

SEQ ID NO: 78905 - DNA, 201 bp, Homo sapiens; identical to SEQ ID NO: 52703

SEQ ID NO: 78906 - DNA, 201 bp, Homo sapiens
ttttcttctactcagtggggcttaacttgtatcttttgttctagtttgttgacctgaagagttagataattaattttaattatcctctggtagtatatacmttcaaactccaagtttccctgtaaacactactttagctgtttctcatattttcattctattcagtttaaaccattacttaaaatttcccttatgatttct

SEQ ID NO: 78907 - DNA, 201 bp, Homo sapiens; identical to SEQ ID NO: 52705

SEQ ID NO: 78908 - DNA, 201 bp, Homo sapiens
cttgaggtcaggagtttgagaccaacctgaccagcacggtgaaaccccatctctactaaaaatacaaaaattagccaggcatggtggcatgcacctgtagkcccagctactcaggagactgaggcaggagaatctcttgaacccaggaggcaaggttgtaatgagctgaaatcacaccactgcactccagcctgggcaacg

SEQ ID NO: 78909 - DNA, 201 bp, Homo sapiens; identical to SEQ ID NO: 52707

SEQ ID NO: 78910 - DNA, 201 bp, Homo sapiens
aactctctctatggtcatttctaaatatgaaaatttaggccgggcatggtggctcacgcctgtaatcccagcactttgggaggccgaggcaggtgaatcasttgaggtcaggagtttgagaccaacctgaccagcacggtgaaaccccatctctactaaaaatacaaaaattagccaggcatggtggcatgcacctgtagt

SEQ ID NO: 78911 - DNA, 201 bp, Homo sapiens
tctttaactctctctatggtcatttctaaatatgaaaatttaggccgggcatggtggctcacgcctgtaatcccagcactttgggaggccgaggcaggtgwatcacttgaggtcaggagtttgagaccaacctgaccagcacggtgaaaccccatctctactaaaaatacaaaaattagccaggcatggtggcatgcacct

SEQ ID NO: 78912 - DNA, 201 bp, Homo sapiens
tctttgttacatgaaatgagcatattatcatagatgcttgtcataaagaagctcaaggcaacactaatacatttgtcttttcttttgtcacttctagatcrcagtaatatagttccggttcttcttggaccaaagcttaaccatgttgcagtggaattaggtatatttcaatatacatatattctgcatttataagtaggg

SEQ ID NO: 78913 - DNA, 201 bp, Homo sapiens
ctgtaaatccatcactggccagctgaggaggacagatggagagaatcgagacagggcagaaaggctcttcccagtgattttgcatggtttgactcttgcaygtttgatcatctgagagtcaggctgcagtggatgggcatcttcctctgccttttagttgaattgagcagaagctgcagatctgagtgagagaaaaccaga

SEQ ID NO: 78914 - DNA, 201 bp, Homo sapiens
aatctggaatctgtgttcttaccttctgcagggcttgtcgcctgtggtcttccacccctgtgtgattgcctgtgctgtggtccactcacttgtgagggagyggggctcaaatctttgttggaccatcacctggccaggctttcctggggcctgctcaccaccggatcacctctcctttcttagaacagggcaggactgtcc

SEQ ID NO: 78915 - DNA, 201 bp, Homo sapiens
cacatgtagagaagcatactggagaagcatatccagagggcgaaagatatctctccattgtgcatctgcctcttttgacgttggaagacacatgtcttacyccccaaagggagcccagcactgggagccttcttgatgatctcaaaaataatagctattcaagaaaatcaccaagtgactgtgaaaccgtcagttcggaag

SEQ ID NO: 78916 - DNA, 201 bp, Homo sapiens; identical to SEQ ID NO: 52713

SEQ ID NO: 78917 - DNA, 201 bp, Homo sapiens; identical to SEQ ID NO: 52714

SEQ ID NO: 78918 - DNA, 201 bp, Homo sapiens
agaactccgaatgctaggttgcagtaggatcaaagttcaatgcagatcttagttccactgggacacagtcaatgtaaaggaggggtctggagtgtaggagrctgtcacttcatctctccatttccctaaagtaaactcatatgggcagccacagacacacgcgaacacatgcatacacacctatgcctcagtgacacatgt

SEQ ID NO: 78919 - DNA, 201 bp, Homo sapiens; identical to SEQ ID NO: 52716

SEQ ID NO: 78920 - DNA, 201 bp, Homo sapiens; identical to SEQ ID NO: 52718

SEQ ID NO: 78921 - DNA, 201 bp, Homo sapiens; identical to SEQ ID NO: 52720

SEQ ID NO: 78922 - DNA, 201 bp, Homo sapiens
tttcaaaacacaatcatgcccttctaacagtcccccaaagtcttcactcattccagcattaactctaaaatccaagtccaaagtctcatctgagacaaggmaggtcccttcctatgagtcagtaaattcaagagcaatttagttacttcctagatacaatgggagtacaggcattgagtaaatacaccccttccaaatggg

SEQ ID NO: 78923 - DNA, 201 bp, Homo sapiens
atcctgcaagggaacggtgggcacatagagtgagggatttgcttttctcaacctgtcttggccctgcaacctgtaaatccatcactggccagctgaggagkacagatggagagaatcgagacagggcagaaaggctcttcccagtgattttgcatggtttgactcttgcacgtttgatcatctgagagtcaggctgcagtg

SEQ ID NO: 78924 - DNA, 201 bp, Homo sapiens; identical to SEQ ID NO: 52723

SEQ ID NO: 78925 - DNA, 201 bp, Homo sapiens
ctgcagggctggggaggcctcaggaaacttacaaaagggggaaaagccccttacaaaaccatcagatctcatgagaactcactcactatcatgagaacagmatgagggtgactgcccccatgattaaattcaagatgaggtttggatggggacacagccaaaccatatcagaatacttctatcacatcacttcctctttat

SEQ ID NO: 78926 - DNA, 201 bp, Homo sapiens
gctgccttaagcaagagcctgttgggtgatgacttacttcccaagcatcaccagatggggactgagggggcagaatttatgtgcagtacttccagtcgggrtcagaagccactcaggagcagaagtagaacttggcctacaggcatgaacttaacagcagggccagggccaaggtgaggttcctggggcacaatattgaag

SEQ ID NO: 78927 - DNA, 201 bp, Homo sapiens
aggtgtgatacctctcctccccatcctaagggtcatggcaatgttcccataacaaaagacagattaacaaggggcaagcaagttttatgtgacatgggagscttcagaaatgaagaccctggggccgggtgtggtggctcatgctggtaatcctagcactttgggaggccgaggcggatggatcacctgaggccaggagtt

SEQ ID NO: 78928 - DNA, 201 bp, Homo sapiens; identical to SEQ ID NO: 52728

SEQ ID NO: 78929 - DNA, 201 bp, Homo sapiens
agctgggtgtggtggcacatgcctgtagtcccaactgctcgggaggctgaggaaggagaatcacttgaacccgggaggcagaggttgcagcgagccgagaytgggccactgcactccagcctaggggagagagcgatactccgtctcaaaaaaaaaaaaatgaaattccaaagtgcagctatttaaattatgagcattggt

SEQ ID NO: 78930 - DNA, 201 bp, Homo sapiens; identical to SEQ ID NO: 52730

SEQ ID NO: 78931 - DNA, 201 bp, Homo sapiens
tctctcctaccacattctcaagctgtgaattttccaaactcttatgctctgtcacctcttgaatgatttgctctttagaaatttcttcttccagataatcrtctctcaagttcaaagttccatagatctctaggacaagggcaaaatgcaactaatctctttgctaaacataacaagattcacttttgctccagctcccca

SEQ ID NO: 78932 - DNA, 201 bp, Homo sapiens
ctacaggcacccgccaccactcccggctaatttttatattttttttagtagagacggggtttcaccgtgttagccaggatggtctcgatctcctgacctcrtgatccccctgccttggtctcccaaagtactgggattacaggcataagccactgcaccaggctggaaaatgtgtttctttgcctttgctttctccagctt

SEQ ID NO: 78933 - DNA, 201 bp, Homo sapiens
agcaacatctttcttcttcactacaaccatatagctatatacacccacatgttgccacagtaacaaattatcccaagtttagtgtcttcggtaaaatcaargttttgccagaattgctttacttctggaggctgtaggggaaaatgcgtttcttttatttttttatttattttatatttttgagatggagtcttgctctgt

SEQ ID NO: 78934 - DNA, 201 bp, Homo sapiens
cctttgctttagcaacatctttcttcttcactacaaccatatagctatatacacccacatgttgccacagtaacaaattatcccaagtttagtgtcttcgstaaaatcaaggttttgccagaattgctttacttctggaggctgtaggggaaaatgcgtttcttttatttttttatttattttatatttttgagatggagt

SEQ ID NO: 78935 - DNA, 201 bp, Homo sapiens
tgagtagatataataaggaaatacatatacatccataaaatgaattataaattaatactgaaaatccaatttaaatttaggaccgcaggttttacttagcytcatcaactttacattggaatcactgccacacagaaaattccagttcccagtggcatcaacataattgttaatttgctttatccctcaatgtacatatat

SEQ ID NO: 78936 - DNA, 201 bp, Homo sapiens
gcttatccagtctggatttttttccccatcatcctgagaaactggaaactgtaacacttgtgtgggtggcttgttcaacaaaatctgtgggctcacatttrctacagcctttgctttagcaacatctttcttcttcactacaaccatatagctatatacacccacatgttgccacagtaacaaattatcccaagtttagtg

SEQ ID NO: 78937 - DNA, 201 bp, Homo sapiens; identical to SEQ ID NO: 52740

SEQ ID NO: 78938 - DNA, 201 bp, Homo sapiens
aaaatgacagctcctttcgtgatttgaagacaggttgcttatccagtctggatttttttccccatcatcctgagaaactggaaactgtaacacttgtgtgrgtggcttgttcaacaaaatctgtgggctcacatttgctacagcctttgctttagcaacatctttcttcttcactacaaccatatagctatatacacccac

SEQ ID NO: 78939 - DNA, 201 bp, Homo sapiens; identical to SEQ ID NO: 52743

SEQ ID NO: 78940 - DNA, 201 bp, Homo sapiens
tatcccttctcgtagcttccaaccactgattttgatttgccttcaagaatttcacagattaaatctggctccttcttaaaatgacagctcctttcgtgatktgaagacaggttgcttatccagtctggatttttttccccatcatcctgagaaactggaaactgtaacacttgtgtgggtggcttgttcaacaaaatctgt

SEQ ID NO: 78941 - DNA, 201 bp, Homo sapiens; identical to SEQ ID NO: 52745

SEQ ID NO: 78942 - DNA, 201 bp, Homo sapiens
ccaaatatcccttctcgtagcttccaaccactgattttgatttgccttcaagaatttcacagattaaatctggctccttcttaaaatgacagctcctttcrtgatttgaagacaggttgcttatccagtctggatttttttccccatcatcctgagaaactggaaactgtaacacttgtgtgggtggcttgttcaacaaaa

SEQ ID NO: 78943 - DNA, 201 bp, Homo sapiens
cgccatccctttcctccaccaaagtagcacagcccagggccttcagcccagtagctgctcagaaatggctgtgactggagccagaaagctgtgatttccakttgtcactactcattcactgttcattcccaggctccaccatcaactccctggatatgtagagaaaggtcaagatctgcaagagagagagaaagggagaga

SEQ ID NO: 78944 - DNA, 201 bp, Homo sapiens
tatagcataattagtaagcagtatttactgcagatgtgtgtgtatacacatatgtgttctaacttaggtgtgtaaccctttgtagtttgatgtgggatctrtcagtgaacagactttacacctgaaaatttcccgttagaacagtaattctttaatttttaggagtacattgctaataatcaaatgccactgaggactgat

SEQ ID NO: 78945 - DNA, 201 bp, Homo sapiens; identical to SEQ ID NO: 52746

SEQ ID NO: 78946 - DNA, 201 bp, Homo sapiens
taaaggaaataacattttttattctatccaagataaaagaataggcagagttaataataaaatgtgtgtggaggtagtgggggaggtttcaaaccatagamccagtctaatttgattatgcacagttggtactttccattcatacttgtttctttggcctttacattattgattattatctcttggaaattccaccaaata

SEQ ID NO: 78947 - DNA, 201 bp, Homo sapiens
aaccaaaaaagagtgagattgtcagtgtaagaatgtgatttaatgtttgtagtgcttacaattttgtgtaccaactggatgactaaaaagagtaaaataayttaattaatagctcatattttatgtgtgaaaacatgttagtgaacatatataatcaaaatagatttcattgctattgcatagtctctaatacatagaatg

SEQ ID NO: 78948 - DNA, 201 bp, Homo sapiens
atgcatatttcatgctttttccttagaatatttttgggatattagacataggattgctgggtcagagggtaatacatatgtaattttgctccatattgccyaattcatcttcataggggttgtaacattttgtattcttatcatcaatgtcttggagtgcttgtgccttagctttggcccatttctctacagagattttga

SEQ ID NO: 78949 - DNA, 201 bp, Homo sapiens
gggacacagtcaatgtaaaggaggggtctggagtgtaggagactgtcacttcatctctccatttccctaaagtaaactcatatgggcagccacagacacaygcgaacacatgcatacacacctatgcctcagtgacacatgttagtgagtgctggccatgtgctaggcatcgtgctggattttagtgatacagtgaagagc

SEQ ID NO: 78950 - DNA, 201 bp, Homo sapiens
ttgtaacattttgtattcttatcatcaatgtcttggagtgcttgtgccttagctttggcccatttctctacagagattttgatctctttcattatcattgkgggaaggtttttacgtggtagacatattaagactttgtgatgtaaattgcaattgttttccagttttttttctttgcttttagattttaaaagaattaat

SEQ ID NO: 78951 - DNA, 201 bp, Homo sapiens
tatatggctgaaagttctgagaattggttactatattaaggattataaaaatcttctaggttgtttttttaaaaatctgtgtgccagaagatttttaaacyttcataagataggcacacttttgtttgaaagctttggctgaatctgttttattctgttttccagagaagccatttgaagcagaatccaaaccatgaattg

SEQ ID NO: 78952 - DNA, 201 bp, Homo sapiens
ttcttatcatcaatgtcttggagtgcttgtgccttagctttggcccatttctctacagagattttgatctctttcattatcattgtgggaaggtttttacrtggtagacatattaagactttgtgatgtaaattgcaattgttttccagttttttttctttgcttttagattttaaaagaattaatccattctttcaatac

SEQ ID NO: 78953 - DNA, 201 bp, Homo sapiens
tttgatctctttcattatcattgtgggaaggtttttacgtggtagacatattaagactttgtgatgtaaattgcaattgttttccagttttttttctttgyttttagattttaaaagaattaatccattctttcaatacagatatggacacatttttcactttaaatcttcaatccatttggaatttactatggtgtttag

SEQ ID NO: 78954 - DNA, 201 bp, Homo sapiens
attgattcacagttctgtatggctggggaggcctcaggaagcttacaatcatagtggaaggggaagaaaacatatccttcttcacatggtggcatcaaggrgaaggctgagcaaaaaggggaaaagccccttataaaaacatcagatcttatgagaactcactcactatcaggagcacagcatgagggtaatcacccccat

SEQ ID NO: 78955 - DNA, 201 bp, Homo sapiens
tctaatcaggagaggcaataagctacataaaggtgtatgaaacagcatcatctgtgaggctgcaagagtgcagggggaggttggaggaaggacagatgcakgaggctccatttgacctgggtcttggagggggagcctcatgaaacagtgacctgctgggggaagggatctccactgggagagtgtaaggaacactgatgt

SEQ ID NO: 78956 - DNA, 201 bp, Homo sapiens
cagatgtgctggattgaagaaagtggctttattacaattagtattaattcctgtgacatgtatggaaatgtgtgtgagagagagagagatgtttgagtgtrcctatggatttgaatattgctgatgcatttctaatcagctcgctggcttctgatggagggtgtcaaaggtgtgggtggtctgctagctactcattctctg

SEQ ID NO: 78957 - DNA, 201 bp, Homo sapiens
gctctgggacctacctctgggtgtcagatgtgctggattgaagaaagtggctttattacaattagtattaattcctgtgacatgtatggaaatgtgtgtgwgagagagagagatgtttgagtgtacctatggatttgaatattgctgatgcatttctaatcagctcgctggcttctgatggagggtgtcaaaggtgtgggt

SEQ ID NO: 78958 - DNA, 201 bp, Homo sapiens
ttgaaaaaattagtttggctttataaaattttgacttatacataaataatttactgacgtgaggtacacatgtgggtgcttcacgggcacattctatgcayaatgggtctagccccagtggctgccagctctgagggagaagtctgtgggcagtaggttctccttgcttggtgtttgcagaaacagtgtccaatggtcaag

SEQ ID NO: 78959 - DNA, 201 bp, Homo sapiens
tcgggaggctgaggaaggagaatcacttgaacccgggaggcagaggttgcagcgagccgagactgggccactgcactccagcctaggggagagagcgataytccgtctcaaaaaaaaaaaaatgaaattccaaagtgcagctatttaaattatgagcattggtgcaccaaggatatttagctaaacaattgaccacagggc

SEQ ID NO: 78960 - DNA, 201 bp, Homo sapiens
ctgtagtcccaactgctcgggaggctgaggaaggagaatcacttgaacccgggaggcagaggttgcagcgagccgagactgggccactgcactccagcctrggggagagagcgatactccgtctcaaaaaaaaaaaaatgaaattccaaagtgcagctatttaaattatgagcattggtgcaccaaggatatttagctaaa

SEQ ID NO: 78961 - DNA, 201 bp, Homo sapiens
taaaaatacaaaaaattagctgggtgtggtggcacatgcctgtagtcccaactgctcgggaggctgaggaaggagaatcacttgaacccgggaggcagagkttgcagcgagccgagactgggccactgcactccagcctaggggagagagcgatactccgtctcaaaaaaaaaaaaatgaaattccaaagtgcagctattt

SEQ ID NO: 78962 - DNA, 201 bp, Homo sapiens
cccgtctctactaaaaatacaaaaaattagctgggtgtggtggcacatgcctgtagtcccaactgctcgggaggctgaggaaggagaatcacttgaacccrggaggcagaggttgcagcgagccgagactgggccactgcactccagcctaggggagagagcgatactccgtctcaaaaaaaaaaaaatgaaattccaaag

SEQ ID NO: 78963 - DNA, 201 bp, Homo sapiens
tgatcgagaccatgctggctaatatgatgaaaccccgtctctactaaaaatacaaaaaattagctgggtgtggtggcacatgcctgtagtcccaactgctygggaggctgaggaaggagaatcacttgaacccgggaggcagaggttgcagcgagccgagactgggccactgcactccagcctaggggagagagcgatact

SEQ ID NO: 78964 - DNA, 201 bp, Homo sapiens
cgttcgggtgcagtggctcacacctgtaatcccagcactttgtgaggctgaggtgggcggattattaggtcaggtgatcgagaccatgctggctaatatgrtgaaaccccgtctctactaaaaatacaaaaaattagctgggtgtggtggcacatgcctgtagtcccaactgctcgggaggctgaggaaggagaatcactt

SEQ ID NO: 78965 - DNA, 201 bp, Homo sapiens
cttggagggggagcctcatgaaacagtgacctgctgggggaagggatctccactgggagagtgtaaggaacactgatgtgctggtgggaggggagggatgmtggacccaggctgtgtgtgatggaggaacagaatcctgggacattaaaggtatttaattaaacctcacccagtgaagatattcatcataaggcacagcca

SEQ ID NO: 78966 - DNA, 201 bp, Homo sapiens
tctttttggcaggaaatgaaaatctgtatgaataaacctcacatgagtcagctctctcttatatatgaaatttgagtaaattgtggaatcttttgttgttkaatttacattttcactttacaagtatttagtgaagatatctatactcaataaactgtacttagcacaaggaggcagggaagcaaggaagtatgagatgaa

SEQ ID NO: 78967 - DNA, 201 bp, Homo sapiens
caattttgtgggttgcctgtttatttttttctgttttcttcagttggtataccttttacctgttgaattttaaaagctcttatacaccatggaatactatrcagccataaaaaagcatgagttcatgtcttttgtagggacatggatgaagctggaaaccatcattctcagaaaactaacacaggaatagaaaaccaaaca

SEQ ID NO: 78968 - DNA, 201 bp, Homo sapiens
gatagttttcaatgatagagatgaagaaatgaaggtagagggaaatgtacacacagaaatctaataaaccaatcctaggctgacaggcagcaagttcagcytggtgagcagcctcagaagtgggggctggtgtttatcccctggtgtctgtggacaaaaatgagtggttttcataaccaggatgggctgggcctgcagcag

SEQ ID NO: 78969 - DNA, 201 bp, Homo sapiens
tcattaaaccttaaagttccaaaatagtctccttcaactccatgtctcatatccaggtcacgctgctgcaagaggtaggatcccatggccttgggcagctrtgctcctgtggctttgcagggtacatctttcttcctggtttctttcatgggctggtgttgagtttctgggctttttcaagtgcatggtgcaagctgtcag

SEQ ID NO: 78970 - DNA, 201 bp, Homo sapiens
atttgcagaatggtgtgcaaataccagctaatttttgtatactgagatcttaatatgtttcatattgaaactcagagttaacttgtcagtttgctgagccrtctcctgataactttgtctcttggtagatattgaatattttttttaaagtggtgctttttataaggttacatcagtcttaatcagagtgacataaaggaa

SEQ ID NO: 78971 - DNA, 201 bp, Homo sapiens
tattttcttctttcagtcttcattttgtaaatctcctacattgagtgtaaattgctttggaaatcagaaaaactttaaaaagaaagaaacttaagagttayggaaaagcaaaaatattgatgttaaacataacaattaaaaacccttaaaattcttacatgtgagacatttaatatttatattcttctatgcctattttat

SEQ ID NO: 78972 - DNA, 201 bp, Homo sapiens
ccacttatattgggttttataccacttataaccagacttaatatggacaaatataaactccaaaacatgccttagaaacaatgccctctataacgaaactractttagaataattatctcaaacggcctgtgaaaatgaatgaatgaatgaatggctttttagaaatatgtgtagtaaaagaattagctttaaaactttca

SEQ ID NO: 78973 - DNA, 201 bp, Homo sapiens; identical to SEQ ID NO: 52771

SEQ ID NO: 78974 - DNA, 201 bp, Homo sapiens
tagcagtaattctgcaagcctgtgcagctgccgagagcttcactggattttcttgtttctatgagactctttctgttaattacaaaccaaagcaaattctkccatggaatgaaatggccacctatcttagctcaccctagaaaggatccttcttaagtacgcttgtagttcaaaaatttctctttattttctctgtacttt

SEQ ID NO: 78975 - DNA, 201 bp, Homo sapiens; identical to SEQ ID NO: 52773

SEQ ID NO: 78976 - DNA, 201 bp, Homo sapiens; identical to SEQ ID NO: 52774

SEQ ID NO: 78977 - DNA, 201 bp, Homo sapiens
actttggggaaaaggattctagtttttatgatctgcctttgggaagagggagtctggtttctgtgacttgctttggggagaatggaggcatgaagcaggarggtcagagagatcttgctttttgaggctgctttgaggccttccaatgtcgttgagtttaaagtactcagcctgccaaaacaccatactttgggactgttt

SEQ ID NO: 78978 - DNA, 201 bp, Homo sapiens
tgtaaattagtgaggcttggtgtgctgagttttaagaaattccgttcgggtgcagtggctcacacctgtaatcccagcactttgtgaggctgaggtgggcrgattattaggtcaggtgatcgagaccatgctggctaatatgatgaaaccccgtctctactaaaaatacaaaaaattagctgggtgtggtggcacatgcct

SEQ ID NO: 78979 - DNA, 201 bp, Homo sapiens
tggagaggagcacacctttgctgtggagattttgcccagggtgttggagaaacattttgggtataagttatgcatatttgaaagggatgtagtgcctggargaggtaagagggaatgccagatagaaaaatattcaagatagtttctttttaaaaaatgaatgagctagcccccagagagctatcccattttccttaaaaa

SEQ ID NO: 78980 - DNA, 201 bp, Homo sapiens
tttagaccacgctataggaattatatatacacatacatagcgtgtgtgagtgtagtgtgtgtatgcataaaaaacatacgcactcccatccacacacataygcaacacaaattgtgtagttcaggggtccccaatccccatgccactccccctcactaacattaccacctcctgtgagatccgcagctgcattagactctc

SEQ ID NO: 78981 - DNA, 201 bp, Homo sapiens
tataataaaaaaaaaagctcttttagaccacgctataggaattatatatacacatacatagcgtgtgtgagtgtagtgtgtgtatgcataaaaaacatacrcactcccatccacacacatacgcaacacaaattgtgtagttcaggggtccccaatccccatgccactccccctcactaacattaccacctcctgtgagat

SEQ ID NO: 78982 - DNA, 201 bp, Homo sapiens
agaacacatggacacagggaggggaacatcacacaccggggcctgttgtgtggggtgggagggtaggggatgtatagcattaggagaaatacctaatgtaratgacaaattgatgggttcagcaaaccaccatggcacgtgtatacctatgtaacaaacctgcacattctccacatataccccagaacttaaagtataata

SEQ ID NO: 78983 - DNA, 201 bp, Homo sapiens
taataaattaaacttttgtatatatttattgcatcttactgcaatcaggcaattttgtgggttgcctgtttatttttttctgttttcttcagttggtatascttttacctgttgaattttaaaagctcttatacaccatggaatactatgcagccataaaaaagcatgagttcatgtcttttgtagggacatggatgaagc

SEQ ID NO: 78984 - DNA, 201 bp, Homo sapiens
ctgatacatagtattaaaatatgttccacagtagtttccctggatttggtgttcaataaatgatcacagtttcttctcccacactcttccttcattttccytctctttcgataagttagtttttaggaatgctagtttaaggatttccattttctcctgtcacatgtacttaacatgtaaaactcaattgtatatgttttt

SEQ ID NO: 78985 - DNA, 201 bp, Homo sapiens
gttttcatttattaccccctgctcccatgacagtttttaaagttcttgctcttctgaatcaagcggaggcagagcagggtttgcacatcaatgaatcaatmtctttaataaaaataaaggaaaatattgtaactggttactaaagggaagatgggtgatatttgcaaagtttctgtagcattataaaatacctttacactt

SEQ ID NO: 78986 - DNA, 201 bp, Homo sapiens
gtgtgcatgtgtgtgtctctgtgtgtagactgcttaggttttcatttattaccccctgctcccatgacagtttttaaagttcttgctcttctgaatcaagmggaggcagagcagggtttgcacatcaatgaatcaatctctttaataaaaataaaggaaaatattgtaactggttactaaagggaagatgggtgatatttg

SEQ ID NO: 78987 - DNA, 201 bp, Homo sapiens
tgttgtttttttgagatggaatttcgctcttgttacccaggctggagtgcaatggcgcgatctccactcactgcaacctccgcctcctgcctcagcttccygagtagctgggattaccgtacccagctaatttttgtagttttagtagagacggagtttcaccacattggccaggctggtctcaaactcctgacctcaggt

SEQ ID NO: 78988 - DNA, 201 bp, Homo sapiens
attgttttccaattccagatcaccttttttttgttgttgttgttgttgtttttttgagatggaatttcgctcttgttacccaggctggagtgcaatggcgygatctccactcactgcaacctccgcctcctgcctcagcttcccgagtagctgggattaccgtacccagctaatttttgtagttttagtagagacggagtt

SEQ ID NO: 78989 - DNA, 201 bp, Homo sapiens
taactctaaaacaggaaaataaatgaactgttaatgactcaccagggttttgcatgtcaattgaagctgacacccacatatacacatgtatcacaccttckatgttgaagtattagtataaaatagagattgtattgcaaccagaaaacatgaagttggtgctccttaactcttgtgttttgtggtagattcgacatccat

SEQ ID NO: 78990 - DNA, 201 bp, Homo sapiens; identical to SEQ ID NO: 52788

SEQ ID NO: 78991 - DNA, 201 bp, Homo sapiens; identical to SEQ ID NO: 52789

SEQ ID NO: 78992 - DNA, 201 bp, Homo sapiens
tgtgtacacacacgtacgtacatatgtacatgcacaaatatttaatatgtcttagacacaccaaatatatgcatttaagatgtattaaatgtactttcctragaatacaaataagtgccctacgtcggcggctctcttcctgactgtatgttagagtcacctgcggagttctgaggactcaagatgcccagtctgtcctcc

SEQ ID NO: 78993 - DNA, 201 bp, Homo sapiens; identical to SEQ ID NO: 52790

SEQ ID NO: 78994 - DNA, 201 bp, Homo sapiens; identical to SEQ ID NO: 52791

SEQ ID NO: 78995 - DNA, 201 bp, Homo sapiens; identical to SEQ ID NO: 52792

SEQ ID NO: 78996 - DNA, 201 bp, Homo sapiens; identical to SEQ ID NO: 52793

SEQ ID NO: 78997 - DNA, 201 bp, Homo sapiens
aaaatgaatgagctagcccccagagagctatcccattttccttaaaaacaaatgaataaggtcctttaagcaagaaataaccacgtaagtcaacaatcgayagtgagaaaacaaactaatgagcttccaatagtctcttctcttgggctctgttctttgtgcttcacggttctctgaaactttggggaaagggagagggca

SEQ ID NO: 78998 - DNA, 201 bp, Homo sapiens; identical to SEQ ID NO: 52794

SEQ ID NO: 78999 - DNA, 201 bp, Homo sapiens
atttagcaaataaatctatacatcacaggtgcagtggaagcaaacatgaaatttgaaacattttctctttaaaatcttcatttaaaaaatactgtattgtkttccaattccagatcaccttttttttgttgttgttgttgttgtttttttgagatggaatttcgctcttgttacccaggctggagtgcaatggcgcgatct

SEQ ID NO: 79000 - DNA, 201 bp, Homo sapiens
gtatttagcaaataaatctatacatcacaggtgcagtggaagcaaacatgaaatttgaaacattttctctttaaaatcttcatttaaaaaatactgtattrttttccaattccagatcaccttttttttgttgttgttgttgttgtttttttgagatggaatttcgctcttgttacccaggctggagtgcaatggcgcgat

SEQ ID NO: 79001 - DNA, 201 bp, Homo sapiens
tgagtgagttgtttaacctgtctgagatttagcattctcatctgagcctaaggaaaatagtcatctcccttgcatgtacatagtctaatacctggaactcrgtaagtgttagtcttttcttccttctatcctattgtagacctaaaggggaactggaagagcctaaggtgggcacaaatgtgtcaggcatagaggataact

SEQ ID NO: 79002 - DNA, 201 bp, Homo sapiens
gcctgccacattctccagtcacggccaatcttttataaattcatgcccaaggtgaaggggccagattcattggattgtgaaagtgtagaattgtgcagagmacttctggcctctggggccaaatagatgtgcatttgtatcctggccccatcttgtagcaagtgtgtggcctgagtgagttgtttaacctgtctgagattt

SEQ ID NO: 79003 - DNA, 201 bp, Homo sapiens
taaaggaaaaagaacaacaaacaccgccccccccaccacaaacttccaactcctgattgaatgaaggcacaatttaaaggaataaagtattctggacaggsctgagagagcacgttgagaggaacagccaggcatctatgatcatcacttggagataacagaagcaaatggcattggccatctttctgatacgggtagtag

SEQ ID NO: 79004 - DNA, 201 bp, Homo sapiens
cagccaatcgcaacccacagctggcggcagtgagagagggcaacacggaagggctttgcattttactcatgaggtggccctagattgtgccagaatactcraaattgggttgcataacttccatgaaatgagcacagccaactgaaagcatcacccacacttaccgaacatgtttctttttagatgtacctacctacatat

SEQ ID NO: 79005 - DNA, 201 bp, Homo sapiens
gatggtgcagaggaagaacgccaaggttgctagatttcttgttttcttttctactgagactcctcagcagggtatattttgaggtaggtatggcagcaccrtgacttctgtggctttccctatgaagaagttgtaatgtgtaatattttcttctaagaggtgacacaattatcagtcttctagctatggttggttaagttc

SEQ ID NO: 79006 - DNA, 201 bp, Homo sapiens
tgatggtgcagaggaagaacgccaaggttgctagatttcttgttttcttttctactgagactcctcagcagggtatattttgaggtaggtatggcagcacygtgacttctgtggctttccctatgaagaagttgtaatgtgtaatattttcttctaagaggtgacacaattatcagtcttctagctatggttggttaagtt

SEQ ID NO: 79007 - DNA, 201 bp, Homo sapiens
taagttacataggcacacttttaaccatccccacacttaccagggaatgttagataggcagggtgaatgcaaggtgagtgagatttctgatggtgcagagsaagaacgccaaggttgctagatttcttgttttcttttctactgagactcctcagcagggtatattttgaggtaggtatggcagcaccgtgacttctgtgg

SEQ ID NO: 79008 - DNA, 201 bp, Homo sapiens
ttctatcacatcacttcctctttatgttgtggttaacaattttgagttaaaaccagactgctgctttgagaaacaaaccctgactatagagaaggcattcygtccatgtcctaagggaaatgtttcgttcagtttaaatactctcattctcaaaatgtggtaaaagtgcacccgagagtcactggagggtagattatgaga

SEQ ID NO: 79009 - DNA, 201 bp, Homo sapiens
gtaagcctgaaatttttaccaacatttttcatctttcaatgcatgcaattctgcaaagcaattgctttaaatcaacaataggttctaacccaaattgctgracagaatgctgtaagtagaactgaagaagattttgccagaagcagaaagtgttgtttggtgaccatgagtgctatggaggatgccaggctgggctgttaa

SEQ ID NO: 79010 - DNA, 201 bp, Homo sapiens
ctggacaggcctgagagagcacgttgagaggaacagccaggcatctatgatcatcacttggagataacagaagcaaatggcattggccatctttctgataygggtagtagagaatacagcctggcttaggaagcaacaatggaagcaagagattgaggcaggatgtcagagagaggtgtggagagacagggtagcagatag

SEQ ID NO: 79011 - DNA, 201 bp, Homo sapiens
tacagccttgtcataattagtgggaaccactctgtggaaagaaccccaagttgttaggaagagagaagtagagaaaaataattgagagagaatattttctyatattttcaacttagcatcatgatcttccagccatttaaacttcaggtaattgacagcaccattcccaaatggcctcaggagggctgtttctgtcagttc

SEQ ID NO: 79012 - DNA, 201 bp, Homo sapiens
agttttgtatttctccctttggataatctctttctaatttttagaggggtagaaaaccacagtgaatttcttagaaatgcagcttaagctacaaaagcagrgaggtctttctttatagttgggtgcacacacctttgatatcatctgttttgtcctctcaatggcctcctgtgttttacttctggatttcattggttttag

SEQ ID NO: 79013 - DNA, 201 bp, Homo sapiens
ggagtttgtctagataagtcttatgaatcaacatgtccaattgagtaatttctttcaaaagagaaaggaaagaaagaaaggaagaaattcacatatgctamatatgctaagccaggtatcatgctaggtcattgaaatatattgttgaattaaatcctccaagcaacactgaggcatgtattctcattttatgaattaaat

SEQ ID NO: 79014 - DNA, 201 bp, Homo sapiens
gcatggtttgactcttgcacgtttgatcatctgagagtcaggctgcagtggatgggcatcttcctctgccttttagttgaattgagcagaagctgcagatmtgagtgagagaaaaccagatacaaggtgctttcaacatctgtgacctttagttaatgcaaataggactcaagtgaacgtaaaccagtaactattggaatc

SEQ ID NO: 79015 - DNA, 201 bp, Homo sapiens
actgctctcagcatcctgcaagggaacggtgggcacatagagtgagggatttgcttttctcaacctgtcttggccctgcaacctgtaaatccatcactggycagctgaggaggacagatggagagaatcgagacagggcagaaaggctcttcccagtgattttgcatggtttgactcttgcacgtttgatcatctgagagt

SEQ ID NO: 79016 - DNA, 201 bp, Homo sapiens
cactgctctcagcatcctgcaagggaacggtgggcacatagagtgagggatttgcttttctcaacctgtcttggccctgcaacctgtaaatccatcactgkccagctgaggaggacagatggagagaatcgagacagggcagaaaggctcttcccagtgattttgcatggtttgactcttgcacgtttgatcatctgagag

SEQ ID NO: 79017 - DNA, 201 bp, Homo sapiens
aagatgtacttcacactgccccttctcaagtctcccatgtaagtttctgggggaaaaaatggatccagagaaaggtagtcagtagcagttttccccctcayaccgaaattgcctcctgccctttgtctttgaattcaagccggtgttgcttcttactgtcagacctgagagttagttctttccctggatacatctcagctc

SEQ ID NO: 79018 - DNA, 201 bp, Homo sapiens
cctgcagcacaagctattcttctcccataattgtccatcttatttttcttgtcttcttggagaatgtcaactgagtctctcaggactccactcaaatgtcrctcctccttcatgcccccatggcctcttgtttgtatttctgattgctgtcagaattgcaatacatgtgtgtctctgtcaataacttgaaaggtttctgga

SEQ ID NO: 79019 - DNA, 201 bp, Homo sapiens
ttattaaaaacagaactgtaaaaagctactactggagaacaataaaaacccaacgataaagaagaacgccgagtttgaagatcaggggtattactcctgcrtgcatttccttcatcataatggaaaactatttaatatcaccaaaaccttcaatataacaatagtggaaggtaagggaaatcttagaattgggaagaaaca

SEQ ID NO: 79020 - DNA, 201 bp, Homo sapiens
gtggaaactttaaagacctataagagagtggtctgaacagaacttgggaaatctgaagcgagtgatgataatatccttgaaatttttgtttgtgccttatkcttgaacactgtttacttgtgatttccaaagacagctcttatctgaaatgttttctaaacactcgaatcagtcctgagttgactttattctatttcccat

SEQ ID NO: 79021 - DNA, 201 bp, Homo sapiens; identical to SEQ ID NO: 52817

SEQ ID NO: 79022 - DNA, 201 bp, Homo sapiens; identical to SEQ ID NO: 52818

SEQ ID NO: 79023 - DNA, 201 bp, Homo sapiens
accatcagatctcatgagaactcactcactatcatgagaacagcatgagggtgactgcccccatgattaaattcaagatgaggtttggatggggacacagmcaaaccatatcagaatacttctatcacatcacttcctctttatgttgtggttaacaattttgagttaaaaccagactgctgctttgagaaacaaaccctg

SEQ ID NO: 79024 - DNA, 201 bp, Homo sapiens
ttatcagcattttggttaaagccatttaacaagtctttaggaagttccaaacttttccatattttcttatcttcttcaaactgttccaactgttccaaackgccctccaaactgttccaacctctgcctgtatgcagttccaaagtcacttccacattttgtgtatctttacagtagcaccccacttctggtaccaattta

SEQ ID NO: 79025 - DNA, 201 bp, Homo sapiens
ctaccacattctcaagctgtgaattttccaaactcttatgctctgtcacctcttgaatgatttgctctttagaaatttcttcttccagataatcgtctctsaagttcaaagttccatagatctctaggacaagggcaaaatgcaactaatctctttgctaaacataacaagattcacttttgctccagctccccaaaagtt

SEQ ID NO: 79026 - DNA, 201 bp, Homo sapiens
agtcctcatttcttatgcaaatttctgcaaccagctttaattccatgccccccattcccacgaacatggatttttctctcctaccacattctcaagctgtraattttccaaactcttatgctctgtcacctcttgaatgatttgctctttagaaatttcttcttccagataatcgtctctcaagttcaaagttccatagat

SEQ ID NO: 79027 - DNA, 201 bp, Homo sapiens
gggcaccaaatccctaggctgcacacagaaagggaccctgggcccatcccaggaaatcattttttcctcttaggcctctgggcctgtgatgggagggtctstcatgaagatctctgacataccctagaggcatttttccccttgtcttggcaattaacatttgagtcctcatttcttatgcaaatttctgcaaccagcttt

SEQ ID NO: 79028 - DNA, 201 bp, Homo sapiens
ggggtaggatgcagggcaccaaatccctaggctgcacacagaaagggaccctgggcccatcccaggaaatcattttttcctcttaggcctctgggcctgtkatgggagggtctctcatgaagatctctgacataccctagaggcatttttccccttgtcttggcaattaacatttgagtcctcatttcttatgcaaatttc

SEQ ID NO: 79029 - DNA, 201 bp, Homo sapiens
gacatccagcatttccatacatcctctgaaacctaggcgtaggttcctaaacctcaattcttgacttttgtgcacctgcagcctcaacaccatgtggaagstgccaaggtttggggcttgcaccctctgaagccacagcctgacctggtatcttggcctgttttagcaatggctggaggggtaggatgcagggcaccaaat

SEQ ID NO: 79030 - DNA, 201 bp, Homo sapiens
tgcaagctgtcagtgaatctatcatcctggggcctggaggatggtggctttcttctcttaactccactagctgtactccagtggggactctgtatgggagmcccaacaccacatttcccttccacactaccctagcaaagattctacatgagggttccacccctgcagcaaacttttgcctggacatccagcatttccata

SEQ ID NO: 79031 - DNA, 201 bp, Homo sapiens
aatttaatagggcagtcattaaaccttaaagttccaaaatagtctccttcaactccatgtctcatatccaggtcacgctgctgcaagaggtaggatcccayggccttgggcagctatgctcctgtggctttgcagggtacatctttcttcctggtttctttcatgggctggtgttgagtttctgggctttttcaagtgcat

SEQ ID NO: 79032 - DNA, 201 bp, Homo sapiens
ctgactgagtaaagaaggaacagccattctgtttagcacgagaaggggatgtttggtgttttgtgcgttgcaggtgcccttgtttttgtctgttcttagasaaaatcttcaagtggcattgctttgtcttggtgtgtcatgtctcagaataatcttatccgacgtaggtatctgtgggattgttgatgtccaggaggaaaa

SEQ ID NO: 79033 - DNA, 201 bp, Homo sapiens
aaagaccaccaggaacacaccataagctgaacaaattgggtttagtgttctttgaggcaaaggagaccacacaccatgagcgacggacggtaggttatagraaaaaacccattacagaatttgaacttcggttgcatgatttggggtaagactgaggaaccgggctttgctgtagatagaatgctgttagaaggtggggca

SEQ ID NO: 79034 - DNA, 201 bp, Homo sapiens
acggggcggggctccggctcggtccgactattgcccgcggtgggggagggggatggatcacgccacgcgccaaaggcgatcgcgactctccttctgcaggkagcctggaaggctctctctctttctctacgccacccttttcgtggcactgaaaagccccgtcctctcctcccagtcccgcctcctccgagcgttccccct

SEQ ID NO: 79035 - DNA, 201 bp, Homo sapiens
tgcgctgagggagggtgggcagcatgaagcactacataaagaaaaatcttctaaatgaaattagaacttctgaaatttgggcttgctatgtaaattctgtrtatgttgcatacagctttttatttcttggtaaaattttgtgattgtactgaaaattttccttattttcagactactgtactgcctattaaagttgatttc

SEQ ID NO: 79036 - DNA, 201 bp, Homo sapiens
cggccccacctacggggcggggctccggctcggtccgactattgcccgcggtgggggagggggatggatcacgccacgcgccaaaggcgatcgcgactctycttctgcaggtagcctggaaggctctctctctttctctacgccacccttttcgtggcactgaaaagccccgtcctctcctcccagtcccgcctcctccga

SEQ ID NO: 79037 - DNA, 201 bp, Homo sapiens
gtttgaagaaacagttgtgaataaaaattaatcaaaattagaggccaggcacagtggcttacacctgtaatgccagcactttgcgaggccgaggcgggcgratcatctgaggttgggagtttgacaccagactggccaacatggtaaaaccccttctctactaaaagaaaaatacaaaaaaaaaaaaaaaagtagccaggt

SEQ ID NO: 79038 - DNA, 201 bp, Homo sapiens
cccttgcctctaaatagcactttttggggttcaagaagtaatcagtatgcaaagcaatcttttatacaataattgaagtgttccctttttcataattactstacttcccagtaaccctaaggaagttgctaacttaaaaaactgcatcccacgttctgttaatttagtaaataaacaagtcaaagacttgtggaaaatagg

SEQ ID NO: 79039 - DNA, 201 bp, Homo sapiens
gttgacaaatgacagatcttttttttttccccctatcagttgatttttcttatttacagataacttctttaggggaagtaaaacagtcatctagaattcaytgagttttgtttcactttgacatttggggatctggtgggcagtcgaaccatggtgaactccacctccgtggaataaatggagattcagcgtgggtgttga

SEQ ID NO: 79040 - DNA, 201 bp, Homo sapiens
tccaaagactaagactcgcggcaggttctctttgagtcaatagcttgtcttcgtccatctgttgacaaatgacagatcttttttttttccccctatcagtwgatttttcttatttacagataacttctttaggggaagtaaaacagtcatctagaattcactgagttttgtttcactttgacatttggggatctggtgggc

SEQ ID NO: 79041 - DNA, 201 bp, Homo sapiens
ccgaacactgcagctgtctgaccttccaaagactaagactcgcggcaggttctctttgagtcaatagcttgtcttcgtccatctgttgacaaatgacagaycttttttttttccccctatcagttgatttttcttatttacagataacttctttaggggaagtaaaacagtcatctagaattcactgagttttgtttcact

SEQ ID NO: 79042 - DNA, 201 bp, Homo sapiens
cggcctctgagacatgaagacaccatctccatgtgaccgaacactgcagctgtctgaccttccaaagactaagactcgcggcaggttctctttgagtcaawagcttgtcttcgtccatctgttgacaaatgacagatcttttttttttccccctatcagttgatttttcttatttacagataacttctttaggggaagtaa

SEQ ID NO: 79043 - DNA, 201 bp, Homo sapiens
tcacaggaagcctgccttcagttcacgggccctgccatacttgcgttttgcctataccatctttgagcaagtcacaatctcgtgacttgtgtttgggtgtktgccttgtgatctgggtgcctgcagtttcccccactgtattggaaatgctttaaggatagggatagccaaagctccacggtttttactccataggacacc

SEQ ID NO: 79044 - DNA, 201 bp, Homo sapiens
ctcacaggaagcctgccttcagttcacgggccctgccatacttgcgttttgcctataccatctttgagcaagtcacaatctcgtgacttgtgtttgggtgkgtgccttgtgatctgggtgcctgcagtttcccccactgtattggaaatgctttaaggatagggatagccaaagctccacggtttttactccataggacac

SEQ ID NO: 79045 - DNA, 201 bp, Homo sapiens
ttccctacactgtagttttaaaaaaatgcaaaaagtttcctatcatcccaccactcgctaacaatcattccctgaacgttctgaatatgcccccctaattwtcccatttgttccttcttttcttggtccttctccacagctctccctaaagtaaacatgccgcctttaccctgccaggacaaatccctccggcctttagca

SEQ ID NO: 79046 - DNA, 201 bp, Homo sapiens
tatatttgccttttagggaaagaatttggccctatgttttatctttctctgttatctttgatcagtttgagcacaaaaggtgtgttcagcttaggactgaktttttattaaaaaatgtttttgtgtggctaaaactgtattttggaatacaagaaagaaattgatcactgaggcttgataggtcagaatattgtttatagc

SEQ ID NO: 79047 - DNA, 201 bp, Homo sapiens
tggttctggcatttttctttggccttcaagtaatttataaacgtcctatttttcatagtatctctagccactctccactgatttttttgtttcgttttctwaacttaaagagcaaaattgtgctgtactttccttttctggttctaatgctggataccactctgaagttgaataacaaacaggcaagaatttaaaaagggg

SEQ ID NO: 79048 - DNA, 201 bp, Homo sapiens
tgaaatattagagccaaattataacacctagcacttttacaaattgaattgaaactgaaaatccacttaatggtttaggattttagaagttttcttggaargaaaagacttattttaagaggcattgaaacgtataaaagagcaatatcagacttgatgttgtcttcacagattaactacttttgaaattgcttattccgt

SEQ ID NO: 79049 - DNA, 201 bp, Homo sapiens
tgctgcatcgggctgggagagaaagctcgcgggtcccaccgggcctcctacccaagtctcagcgcgcttttcaccgaggcctcaattctgggatttggcarctttgctgtgaaagcccaagtgggtaaccaacagcttggaggacccgagtggattcgattctctctcactcctcggccactcaactgctccttgtccctg

SEQ ID NO: 79050 - DNA, 201 bp, Homo sapiens
aagaaaagacttattttaagaggcattgaaacgtataaaagagcaatatcagacttgatgttgtcttcacagattaactacttttgaaattgcttattccrttggcaagcatttgttattttctgaaacttaattttctttgcttttcagtggacagaggactgcagaaaatcaacctatcctccttcaggaccaacgtga

SEQ ID NO: 79051 - DNA, 201 bp, Homo sapiens
gcgaagatgaaacgtaatggcttagtaattaattgccaaagtaaacttgtaaactcatttttatgcatcagcttctcatactagttaacagcgtatgtcarcattgttgacattacctattgaatcagctttagcaatgattttcacgcagttgccagaaatctcatagaccccatctggcctaggaatttattgcacttc

SEQ ID NO: 79052 - DNA, 201 bp, Homo sapiens
aatccaactgcttatgaaaagtactaatagaacttgttaacctttctaaccttcacgattaactgtgaaatgtacgtcatttgtgcaagaccgtttgtccmcttcattttgtataatcacagttgtgttcctgacactcaataaacagtcattggaaagagtgccagtcagcagtcatgcacgctgattgggtgtgtacat

SEQ ID NO: 79053 - DNA, 201 bp, Homo sapiens
aaactgcatcccacgttctgttaatttagtaaataaacaagtcaaagacttgtggaaaataggaagtgaacccatattttaaattctcataagtagcattsatgtaataaacaggtttttagtttgttcttcagattgatagggagttttaaagaaattttagtagttactaaaattatgttactgtatttttcagaaatc

SEQ ID NO: 79054 - DNA, 201 bp, Homo sapiens
agagggaatctctccttttgtatctagactcgatgctaagcagggtagatggtatgtggtacaaacaaattatgaccgttggaaacatcccttcttccttratgatcgcagaacgcctgcaaagatgtgtctgaaccgcaccagccaagaggtacctttgcagggtcatctatagaaagaaactgttgccattaaagattc

SEQ ID NO: 79055 - DNA, 201 bp, Homo sapiens
gaaaaaaaatgacccacacacaaaagaacagtcatacagtaaaatcttcatttaaatggtagtacagaccaggcacagtggcttatgcctgtaatcctcaygctttgggtggctgagatagacagatgacttgcacccaggggtttgagaccagtctgagcaacatggcgaaaccccgtctctataaaaaatacaaaaatt

SEQ ID NO: 79056 - DNA, 201 bp, Homo sapiens
tgatatactttgagttttaaggcatgtagcctaagagggaatctctccttttgtatctagactcgatgctaagcagggtagatggtatgtggtacaaacarattatgaccgttggaaacatcccttcttccttgatgatcgcagaacgcctgcaaagatgtgtctgaaccgcaccagccaagaggtacctttgcagggtca

SEQ ID NO: 79057 - DNA, 201 bp, Homo sapiens
tcaggcgttcattctctgcccttcagtttcctgtccaaaaagcgttgccagtgataccccacctacttatctcacatactagaatcaaaaatgctttgaaytttttaaaaagccttttatggttttgatttatttttgccttccccattacccaagctaggcctttatatcccactctgaagtacagtgagcgacagggcc

SEQ ID NO: 79058 - DNA, 201 bp, Homo sapiens
tacttttgaaattgcttattccgttggcaagcatttgttattttctgaaacttaattttctttgcttttcagtggacagaggactgcagaaaatcaacctrtcctccttcaggaccaacgtgagtaaacatcagatgatcaaaactccctttgacctttgtgaagttttttctgtatgtaataattgctcataaacgaacg

SEQ ID NO: 79059 - DNA, 201 bp, Homo sapiens
cgatgctaagcagggtagatggtatgtggtacaaacaaattatgaccgttggaaacatcccttcttccttgatgatcgcagaacgcctgcaaagatgtgtytgaaccgcaccagccaagaggtacctttgcagggtcatctatagaaagaaactgttgccattaaagattcccttggttctggcatttttctttggccttc

SEQ ID NO: 79060 - DNA, 201 bp, Homo sapiens
gactacagtcacgtgccgccacacccagctacttttctgaatttttagtagagacggaggcttgctgtgtcacccaggctggtctcccaactcctgggctyaggcgatcttcccgcctcaacctcccaaagtgttctcccaaagtgttgggatcgtaggtgtgaaccgccatgcccggcctgggttggatatttctttgtc

SEQ ID NO: 79061 - DNA, 201 bp, Homo sapiens
tcattggatgtatatgagtaagtaggtttgttaaagcaaaagaagtagaaacaaaagcatacactgatatactttgagttttaaggcatgtagcctaagarggaatctctccttttgtatctagactcgatgctaagcagggtagatggtatgtggtacaaacaaattatgaccgttggaaacatcccttcttccttgatg

SEQ ID NO: 79062 - DNA, 201 bp, Homo sapiens
aaggctgttggcttctgtatttaacttactgaacaaaactattttcttgtgttttagaatatctcatttgaaaccatgtatgatgtcctgtcaacaaaacstgtcctcaacaaggtattttaaatgttatatgtatatttgccttttagggaaagaatttggccctatgttttatctttctctgttatctttgatcagttt

SEQ ID NO: 79063 - DNA, 201 bp, Homo sapiens
taaacaggtttttagtttgttcttcagattgatagggagttttaaagaaattttagtagttactaaaattatgttactgtatttttcagaaatccaactgyttatgaaaagtactaatagaacttgttaacctttctaaccttcacgattaactgtgaaatgtacgtcatttgtgcaagaccgtttgtccacttcattttg

SEQ ID NO: 79064 - DNA, 201 bp, Homo sapiens
atgtaataaacaggtttttagtttgttcttcagattgatagggagttttaaagaaattttagtagttactaaaattatgttactgtatttttcagaaatcmaactgcttatgaaaagtactaatagaacttgttaacctttctaaccttcacgattaactgtgaaatgtacgtcatttgtgcaagaccgtttgtccacttc

SEQ ID NO: 79065 - DNA, 201 bp, Homo sapiens
cagtatgcaaagcaatcttttatacaataattgaagtgttccctttttcataattactctacttcccagtaaccctaaggaagttgctaacttaaaaaacygcatcccacgttctgttaatttagtaaataaacaagtcaaagacttgtggaaaataggaagtgaacccatattttaaattctcataagtagcattcatgt

SEQ ID NO: 79066 - DNA, 201 bp, Homo sapiens
tctaatgctggataccactctgaagttgaataacaaacaggcaagaatttaaaaaggggaaggagagagaggaaagtaatccattaaaactgttacctgtrtttctaacagtgactcccacagaaactccactgcggggatggaggggaggttgattaaagaatgtcttggtttctggtggcccatgtgtgtagataaggc

SEQ ID NO: 79067 - DNA, 201 bp, Homo sapiens
ttcttaacttaaagagcaaaattgtgctgtactttccttttctggttctaatgctggataccactctgaagttgaataacaaacaggcaagaatttaaaaaggggaaggagagagaggaaagtaatccattaaaactgttacctgtatttctaacagtgactcccacagaaactccactgcggggatggaggggaggttga

SEQ ID NO: 79068 - DNA, 201 bp, Homo sapiens
ggggtgaaaggggagggatagcattaggacaaatacctaatgcatgtagggcttgaaacttagatgatgggttgatgggtgcagcaaaccaccatggcacrtgtgtacctatgtaacaaacctgcacgttcagcacatgtgtcccagaacttaaagtaaaatttaaaaataaatgaagttatttactaaaattaaaaaaaa

SEQ ID NO: 79069 - DNA, 201 bp, Homo sapiens
atcagacttgatgttgtcttcacagattaactacttttgaaattgcttattccgttggcaagcatttgttattttctgaaacttaattttctttgcttttyagtggacagaggactgcagaaaatcaacctatcctccttcaggaccaacgtgagtaaacatcagatgatcaaaactccctttgacctttgtgaagttttt

SEQ ID NO: 79070 - DNA, 201 bp, Homo sapiens
gtgccgtcgcgcagcacgcgccgccggtgagtgagcttgagccgaggcgcagagaggggcgtgcaggtgcgggcgcggatggaggcgcaggtgtggcggcrcgagcgggtacaaggaacacctcgtgctgggcagcttctttacgggggtctgtggtttcgtgcacaggggtgtgggtgcagagcgggctggcgaaccccg

SEQ ID NO: 79071 - DNA, 201 bp, Homo sapiens
ctgtcaggaataagctcctataaggagctggagattctttcctgagcctgtttatattcattacctgaaacagtgatcctgttgaagttgtttgctttagytatttggtgagactttagctaattttatatgattatactatattaatataaatatatacattatataacatgctttgcatatattaagttatattattta

SEQ ID NO: 79072 - DNA, 201 bp, Homo sapiens
cttattgtttgaagaaacagttgtgaataaaaattaatcaaaattagaggccaggcacagtggcttacacctgtaatgccagcactttgcgaggccgaggygggcgaatcatctgaggttgggagtttgacaccagactggccaacatggtaaaaccccttctctactaaaagaaaaatacaaaaaaaaaaaaaaaagtag

SEQ ID NO: 79073 - DNA, 201 bp, Homo sapiens
tgaatcacagtaattgaggctcagatttctgtgtcctggtagaaccatgtgatagtgaaccaaaacatgaccattgattccttttcccatattctgatctwacctggaaacccgtgctctcagattttgtggggttatctggcagatagacggtgacaacagtcccatctggtgaaggcttaggatattaggatgtttctt

SEQ ID NO: 79074 - DNA, 201 bp, Homo sapiens
ataccagcctcactttcccgtatttttcctgactggttcccagagtacaaagcacaggacaacttcgctaactcaccctgatctttgacctatactctggktataaatctgcctgtaccttacccttgagatgtcctgctctaggggatgatgcctgaagggaaacatttgatgaatcacagtaattgaggctcagatttc

SEQ ID NO: 79075 - DNA, 201 bp, Homo sapiens
cgcccgaaggctgcctccttggtgacttgtttcatcttgagtctagagagtccaggctggggaagaaaaccacctccagccggccgttccagcacagcccyactggccaaagcacacactcacacaatgaaaacactgaaactttttcttaaaacaaatttttctcccattgtcatggttctgtatattaacacaaaattt

SEQ ID NO: 79076 - DNA, 201 bp, Homo sapiens
tattttttatgaattatttaccatttgtacttcaatagtagcagaagacaaaaaaggtaattgtgcgctgagggagggtgggcagcatgaagcactacatraagaaaaatcttctaaatgaaattagaacttctgaaatttgggcttgctatgtaaattctgtgtatgttgcatacagctttttatttcttggtaaaattt

SEQ ID NO: 79077 - DNA, 201 bp, Homo sapiens
ttcattatgtcttttagtaagcattttatttatttttcagctaaaggttatagtgaattctctgaagaatatgataaatacattcgtgccaagtggaaaarttatgcaggtggtggatgaaaaattggtaagagatattatttctcacaataaatgttaagcacatagaaaatgcgctgttatttatttaaaggcataatt

SEQ ID NO: 79078 - DNA, 201 bp, Homo sapiens
agttttttttttttttttttttttctgagatggagtcttgctctgtctcccaggctggagtgcagtcacactatctcgtctcactgcaacttccacctccyggcttcaggcaattctcctacctcagccttccgagtacctaggattacaggcacatgccaccagctaatttttgcattgttagtagtaacggggatttcg

SEQ ID NO: 79079 - DNA, 201 bp, Homo sapiens
gacattcaaagaggcttaagtttctatcaaataaccagaaaaattagagaattttctgacccaaacagtcttttaaaagcactttccagagagtttttttkttttttttttttttctgagatggagtcttgctctgtctcccaggctggagtgcagtcacactatctcgtctcactgcaacttccacctcctggcttcagg

SEQ ID NO: 79080 - DNA, 201 bp, Homo sapiens
ttcgggctcaaatattttaaggagctgtacaagttatgccattttttaagggtatggcgctttcattgagaccttaataatgttctctttatatttttgtkttttttttagaatgttgtgttcagtagctctgtaattaatttctcttaatgaatggggaggacattcaaagaggcttaagtttctatcaaataaccagaa

SEQ ID NO: 79081 - DNA, 201 bp, Homo sapiens
ggtttggaggaggggggttattatcaagaaatacaagctgaacatcgtatctgaattaaataacaagggttatgtaagtgggttattaaatatgactaaayggtcacaatcttactcttacatgactgataccacctcttaaccagatactatcaacccaatttgcaggtgtttaaaggcagtttttcccccagataggtg

SEQ ID NO: 79082 - DNA, 201 bp, Homo sapiens
ctcactcataagtgagagctgaacaaagagaacacgtgaacacagggaggggaacatcacgcaccagggcctgtcagggggtggggtgaaaggggagggakagcattaggacaaatacctaatgcatgtagggcttgaaacttagatgatgggttgatgggtgcagcaaaccaccatggcacatgtgtacctatgtaacaa

SEQ ID NO: 79083 - DNA, 201 bp, Homo sapiens
gacccacttcataagatgtgcgaagatgaaacgtaatggcttagtaattaattgccaaagtaaacttgtaaactcatttttatgcatcagcttctcatackagttaacagcgtatgtcaacattgttgacattacctattgaatcagctttagcaatgattttcacgcagttgccagaaatctcatagaccccatctggcc

SEQ ID NO: 79084 - DNA, 201 bp, Homo sapiens
tgtgttcagtagctctgtaattaatttctcttaatgaatggggaggacattcaaagaggcttaagtttctatcaaataaccagaaaaattagagaattttytgacccaaacagtcttttaaaagcactttccagagagttttttttttttttttttttttctgagatggagtcttgctctgtctcccaggctggagtgcag

SEQ ID NO: 79085 - DNA, 201 bp, Homo sapiens
aacagaaaaccgaacactgcatgttctcactcataagtgagagctgaacaaagagaacacgtgaacacagggaggggaacatcacgcaccagggcctgtcrgggggtggggtgaaaggggagggatagcattaggacaaatacctaatgcatgtagggcttgaaacttagatgatgggttgatgggtgcagcaaaccacca

SEQ ID NO: 79086 - DNA, 201 bp, Homo sapiens
ttctgttgttgagtgaaaggcatggacagtaagggtggaagatgatctcttgaggccactttgtttctccttcagattagaggggcttcctaagattcccrcttcccatctcagtgttcaccatacagggtcagggattgcttttcccagaggcattgctcaccatccttttttagaaaacacattgtggctggccatggt

SEQ ID NO: 79087 - DNA, 201 bp, Homo sapiens
acaaaaattagccaggcatggtgacacgtgcctgcctgtagtcccagctactcaggaggctgaggtgggaggatcacctgagcccaaggaggtcgagactrcagtgagctgggatcagtccactgcacttcaccctgagtgatagagtgagactctgtcttaaaaaaacaaaataaataaatacaaaatgtactacatatt

SEQ ID NO: 79088 - DNA, 201 bp, Homo sapiens
cacagtggcttatgcctgtaatcctcacgctttgggtggctgagatagacagatgacttgcacccaggggtttgagaccagtctgagcaacatggcgaaamcccgtctctataaaaaatacaaaaattagccaggcatggtgacacgtgcctgcctgtagtcccagctactcaggaggctgaggtgggaggatcacctgag

SEQ ID NO: 79089 - DNA, 201 bp, Homo sapiens
taaaaatatttgtcaagctccagcttaatcctttgaggaactattgcagaatttcttaagtgaacctctgacactcatgtggaattactcatgttttcttygtgcagactgtgtgttttatagcaaataaatgaattacttaaaaagcactagggatactgacattatgaaaggcacctatgaatatttttggtgtacaga

SEQ ID NO: 79090 - DNA, 201 bp, Homo sapiens
gtgtcacctcttccggttcctgacattgtgttcatctcttccaggtattctagaatggattctgggaaagaaagatgccatgtggatagggttcctcactrgaacagttctggaaaatagcacaaggtaaagtgtttcgttgctttactattaaatatttattttaaattactcatattaaaaaataaaaatatttgtcaa

SEQ ID NO: 79091 - DNA, 201 bp, Homo sapiens
tttactattaaatatttattttaaattactcatattaaaaaataaaaatatttgtcaagctccagcttaatcctttgaggaactattgcagaatttcttargtgaacctctgacactcatgtggaattactcatgttttctttgtgcagactgtgtgttttatagcaaataaatgaattacttaaaaagcactagggatac

SEQ ID NO: 79092 - DNA, 201 bp, Homo sapiens
tccgggtcctgactggttacatagtgtcacctcttccggttcctgacattgtgttcatctcttccaggtattctagaatggattctgggaaagaaagatgycatgtggatagggttcctcactagaacagttctggaaaatagcacaaggtaaagtgtttcgttgctttactattaaatatttattttaaattactcatat

SEQ ID NO: 79093 - DNA, 201 bp, Homo sapiens
atcccactctgaagtacagtgagcgacagggccttaaagcgcatggttgatgtttctgacttcgttgctttgtctttttctcagggactgttcagtcttamactgaatgaacgtttcagtataaatggtggttatctgggtaagtagagcattctcaagtgaaatgggaatctcagagcttttttatgaggaaggctggac

SEQ ID NO: 79094 - DNA, 201 bp, Homo sapiens
tttcttaaaacaaatttttctcccattgtcatggttctgtatattaacacaaaattttcttttctcataggagagattatttcattcaatattttttatgwattatttaccatttgtacttcaatagtagcagaagacaaaaaaggtaattgtgcgctgagggagggtgggcagcatgaagcactacataaagaaaaatct

SEQ ID NO: 79095 - DNA, 201 bp, Homo sapiens
ccactgcactgcagcttgggatacagagccagactccatctcaaaaaaaaaaaaaaaaaagaacacagaactgtttcgttctgtaggaagagtaggttgtrttatattgatgataagtaagtcccaagtcacacccaaaatgtgatcataagtgaagataaatggattgcttgagtgctgagacaagagggacatgctctt

SEQ ID NO: 79096 - DNA, 201 bp, Homo sapiens
aggtggtataattcttccaactttgtttttctcaatatttatttaagttactgatttctctgagcagtatcttttattttcagggagaagacctcacatgycattcgttaaaattattcttagatattgatggtttgggaagctatttttaaaatttcaatttaagctttatggcatgtaacgaaaaatattttccccacg

SEQ ID NO: 79097 - DNA, 201 bp, Homo sapiens
aaattaggtggtataattcttccaactttgtttttctcaatatttatttaagttactgatttctctgagcagtatcttttattttcagggagaagacctcrcatgccattcgttaaaattattcttagatattgatggtttgggaagctatttttaaaatttcaatttaagctttatggcatgtaacgaaaaatattttcc

SEQ ID NO: 79098 - DNA, 201 bp, Homo sapiens
acttacagtgtggtaaggcaaatttgacagctaatgtttgaatcacaggtaatgtcaacctactttatatattccccatgttatcaaaagttaaaacaagrtgctagacctccattcttacacagctgtccagcagatacattttctgtgctcaagctacagttccaggagttttctgagctcaagctacagttccaggag

SEQ ID NO: 79099 - DNA, 201 bp, Homo sapiens
tgagcctgtttatattcattacctgaaacagtgatcctgttgaagttgtttgctttagttatttggtgagactttagctaattttatatgattatactatrttaatataaatatatacattatataacatgctttgcatatattaagttatattatttaatattaaataacttctaaagcaaattctacaagtatagaaat

SEQ ID NO: 79100 - DNA, 201 bp, Homo sapiens
attacctgaaacagtgatcctgttgaagttgtttgctttagttatttggtgagactttagctaattttatatgattatactatattaatataaatatatasattatataacatgctttgcatatattaagttatattatttaatattaaataacttctaaagcaaattctacaagtatagaaatgctaatatatatcagaa

SEQ ID NO: 79101 - DNA, 201 bp, Homo sapiens
ctaaagcaaattctacaagtatagaaatgctaatatatatcagaacatctctgaattgaaaacgtccttaaagtaaaaataacttttctttcagctgaccrtatacacaaccttgatagatgttaccaaaggtcaattcgaaacttacctgcgggactgccctgacccttgtataggttggtgagcacacgtctggcctac

SEQ ID NO: 79102 - DNA, 201 bp, Homo sapiens
agcactttgcgaggccgaggcgggcgaatcatctgaggttgggagtttgacaccagactggccaacatggtaaaaccccttctctactaaaagaaaaatamaaaaaaaaaaaaaaaagtagccaggtgcggtcgcacatgtctgtaatcccaactacgtggaaggctgaggcacaagaattgcttgaacctgggaggcaga

SEQ ID NO: 79103 - DNA, 201 bp, Homo sapiens
tatgtttgaatctgaggctcactatttataagctgtgtgatattgagagagttacctgacttctctgaacctcaattttatcatttggaaaacagaataawtataccatattgtaaaggtcttgttaggattgatcgtggtgactcggtaaataaagctcctagtgtaatgcctggccctcatcatcatgttgatcattac

SEQ ID NO: 79104 - DNA, 201 bp, Homo sapiens
gcaagatgtgcattgtcttcttttatacctgtaaggagaaattctttaaaatcatggtgggatatgatttagccattaaaattgatataatgttcagcagwtaaaagtagaatccagaatagtatatacagtttttcctgtaataggaaaatacacagaacatgtatgtggacacgattaaaggccttaaaataaaattgc

SEQ ID NO: 79105 - DNA, 201 bp, Homo sapiens
gttgcagtgagccgagatcgcgccactgcactgcagcttgggatacagagccagactccatctcaaaaaaaaaaaaaaaaaagaacacagaactgtttcgktctgtaggaagagtaggttgtattatattgatgataagtaagtcccaagtcacacccaaaatgtgatcataagtgaagataaatggattgcttgagtgct

SEQ ID NO: 79106 - DNA, 201 bp, Homo sapiens
tggtggttcacgcctgtaatcccagctttttgggaggctgacacaggtggatcacgaggtcaggagttcaagaccagcctggccaagatggtgaaaccccrtctctactaaaaacataaaaattagccaggcatggtggtgggcatctgtaatcccggctacttgggagcctgaggcagagacttttttgaacctgcgagg

SEQ ID NO: 79107 - DNA, 201 bp, Homo sapiens
gagaaacatggattttggagtatttcttgggtaagtaaagaacaaagggtcaggcatggtggttcacgcctgtaatcccagctttttgggaggctgacacrggtggatcacgaggtcaggagttcaagaccagcctggccaagatggtgaaaccccatctctactaaaaacataaaaattagccaggcatggtggtgggca

SEQ ID NO: 79108 - DNA, 201 bp, Homo sapiens
ctgggaggcagaggtcgcagtgagctgagatcgcaccactgcactccagtctggccaacagaacgagactctgtctcaaaaataaattaattaatcaaaaytaattgtccagctttgatttagaatcttaactgctattacacgtctcttctgtctaccttcaaataggtcatctaatacatgggagaaacatggattttg

SEQ ID NO: 79109 - DNA, 201 bp, Homo sapiens
gaattgcttgaacctgggaggcagaggtcgcagtgagctgagatcgcaccactgcactccagtctggccaacagaacgagactctgtctcaaaaataaatwaattaatcaaaattaattgtccagctttgatttagaatcttaactgctattacacgtctcttctgtctaccttcaaataggtcatctaatacatgggaga

SEQ ID NO: 79110 - DNA, 201 bp, Homo sapiens
gatagtgaaccaaaacatgaccattgattccttttcccatattctgatcttacctggaaacccgtgctctcagattttgtggggttatctggcagatagayggtgacaacagtcccatctggtgaaggcttaggatattaggatgtttcttacttcttattgtttgaagaaacagttgtgaataaaaattaatcaaaatta

SEQ ID NO: 79111 - DNA, 201 bp, Homo sapiens
gttgatttcagacatgcaaaaaacctggaagaaatgttgcagggctagaaacattcttctcttcctcatagtttacttctacccatctacatgctttgatrgaagtgctcgcaggaggtgcttccttatcttcgtgtatgtcatgacatctgtccttttcttgaggcccagaacacacattctcccatcctttcccagcca

SEQ ID NO: 79112 - DNA, 201 bp, Homo sapiens
tagaaaaaggcggagttgagcaaattcacaaaacttgtgaacatgcgaggtgtttaaagctcatggttatttattatagtattccttttcagatattttgkggaaaatattggaatctcacatgtgttattgaaccggcaatataaaccatgagcttcatttgctcttgtggatataaccgtcatcatttctgtgaattat

SEQ ID NO: 79113 - DNA, 201 bp, Homo sapiens
ggtctcccaggactgccagctgtgcgtcaaggagggttaaggcagtcttaaagcattgggggtggagcaatgtgctgtcaggaataagctcctataaggarctggagattctttcctgagcctgtttatattcattacctgaaacagtgatcctgttgaagttgtttgctttagttatttggtgagactttagctaatttt

SEQ ID NO: 79114 - DNA, 201 bp, Homo sapiens
tgttttagaatatctcatttgaaaccatgtatgatgtcctgtcaacaaaacctgtcctcaacaaggtattttaaatgttatatgtatatttgccttttagrgaaagaatttggccctatgttttatctttctctgttatctttgatcagtttgagcacaaaaggtgtgttcagcttaggactgattttttattaaaaaatg

SEQ ID NO: 79115 - DNA, 201 bp, Homo sapiens
catactgtgtataaagcatagtgcttggatgtaataagtgtttaataaatacccattacgtcacatttgtttgttaaatggctggaacattccacttgggkaatgctttgagttcctagggaaaaaaaaaatatgtttaggtgacattacatgtaattaccaagttggttaaaaaagtgagattcgtgaattttaagcaga

SEQ ID NO: 79116 - DNA, 201 bp, Homo sapiens
gacagaaaggaatcattggatgtatatgagtaagtaggtttgttaaagcaaaagaagtagaaacaaaagcatacactgatatactttgagttttaaggcakgtagcctaagagggaatctctccttttgtatctagactcgatgctaagcagggtagatggtatgtggtacaaacaaattatgaccgttggaaacatccct

SEQ ID NO: 79117 - DNA, 201 bp, Homo sapiens
aggttgcagtgagccgagatcgcgccactgcactgcagcttgggatacagagccagactccatctcaaaaaaaaaaaaaaaaaagaacacagaactgtttygttctgtaggaagagtaggttgtattatattgatgataagtaagtcccaagtcacacccaaaatgtgatcataagtgaagataaatggattgcttgagtg

SEQ ID NO: 79118 - DNA, 201 bp, Homo sapiens
aggaaatgaagggtattgccgctgttactgatatacctttaggtaaagttcacttagaagctttaaaaaaaaaagtaattaaattcttttacaagtttccrttgaggtgtgatatacatacagcaaagtgcacaggtcttagatatacagctcagtgaagcttcagaaatgcatgcatgcatgtagccatgactcagatca

SEQ ID NO: 79119 - DNA, 201 bp, Homo sapiens
tattaaagttgatttcagacatgcaaaaaacctggaagaaatgttgcagggctagaaacattcttctcttcctcatagtttacttctacccatctacatgmtttgatggaagtgctcgcaggaggtgcttccttatcttcgtgtatgtcatgacatctgtccttttcttgaggcccagaacacacattctcccatcctttc

SEQ ID NO: 79120 - DNA, 201 bp, Homo sapiens
attatgatagcagtatctagaaaaaattatatgtccaagaactagatttcaaagcatgcttttattatatttgtttatattatattatatattttttattrttattatgttaaatgcttttattaatatatttgttttccagcctggcctacttggcaactttcctggcccttttgaagaggaaatgaagggtattgccgc

SEQ ID NO: 79121 - DNA, 201 bp, Homo sapiens
ggtttatctctgtgagtgtgggaaggaaatggtaagaacggtatatgccagtggctagagggtgaattcgtgcagagagataaggagtgcttgttacgatrtttttgtggtgtgggtcaggttaggtcatccaagtggaattactctcgttcctgccttctctggagaatgatggaaaaataaggcaggaaaaacaatctg

SEQ ID NO: 79122 - DNA, 201 bp, Homo sapiens
catgaacctacccaggactctaggctgaaaaagaatcaggaatttatggcggatatagaggcatgatttgggattggttggatgttatgaggtgaggagcrgctgattggagttcatagggatgagatgcatagctccaacaggccactgagttatctttgctactagacatagaaatctaaatgcacagttgaagggaga

SEQ ID NO: 79123 - DNA, 201 bp, Homo sapiens
tgcaggtttatctctgtgagtgtgggaaggaaatggtaagaacggtatatgccagtggctagagggtgaattcgtgcagagagataaggagtgcttgttaygatatttttgtggtgtgggtcaggttaggtcatccaagtggaattactctcgttcctgccttctctggagaatgatggaaaaataaggcaggaaaaacaa

SEQ ID NO: 79124 - DNA, 201 bp, Homo sapiens
gtgcaggtttgatggtagagaggtttgtggggtctcatcatccccacttcattgtaatcccttcattgtccgttgtgttgtgttcatcccctctcatcgcrtctctgagatccatgaacctacccaggactctaggctgaaaaagaatcaggaatttatggcggatatagaggcatgatttgggattggttggatgttatg

SEQ ID NO: 79125 - DNA, 201 bp, Homo sapiens
gcaaaaggccgtgaacttaagttgtgatctggatgttagtagttgccattgagaataaatatatgatgtccaccactgaatttgctcaatgtctctggttygctaaaagaatgcagttacttcatcttagctgaagatcagccattaaccatgacacagggctatggatagaatagtgcaggtttatctctgtgagtgtgg

SEQ ID NO: 79126 - DNA, 201 bp, Homo sapiens
gcttggatgtaataagtgtttaataaatacccattacgtcacatttgtttgttaaatggctggaacattccacttggggaatgctttgagttcctagggaraaaaaaaatatgtttaggtgacattacatgtaattaccaagttggttaaaaaagtgagattcgtgaattttaagcagattatctcagcaaaaggccgtga

SEQ ID NO: 79127 - DNA, 201 bp, Homo sapiens
ctcacaataaatgttaagcacatagaaaatgcgctgttatttatttaaaggcataattcagcaacctcttcgcagggacttgggcaaatctgcatgaatcyagctcactgtcagaacttcagagggacttaaatttggggaattggtaatattagggttacagcatagcaaattatggtttcgtaaaaggggatgggacta

SEQ ID NO: 79128 - DNA, 201 bp, Homo sapiens
gaggtacctttgcagggtcatctatagaaagaaactgttgccattaaagattcccttggttctggcatttttctttggccttcaagtaatttataaacgtyctatttttcatagtatctctagccactctccactgatttttttgtttcgttttcttaacttaaagagcaaaattgtgctgtactttccttttctggttct

SEQ ID NO: 79129 - DNA, 201 bp, Homo sapiens
acttaccaccctacaaaagatggcatgaattgatgcttgacaaggcaccaatggtatgctatgatgcttaaatcttttatttctttatttttatttttttwtattttatttctttatttttatttattgattgattttttttttgttttgagacagagtctcactctgtcacccaggctggaatgcagtggcacgatctca

SEQ ID NO: 79130 - DNA, 201 bp, Homo sapiens
cccgtggtcgagaatcattgccctagcggctgagtgctgtggccacatcctccctatgacacttgtacctgccaagcaccaaacccattatccctcacgtkcatgctctcggagcttttgtttcaggctatcctttatgttcatacttaccggacttcctcaaaacaaaaaaatgctggcaggagcaaaagaggatgaggc

SEQ ID NO: 79131 - DNA, 201 bp, Homo sapiens
gtatgctatgatgcttaaatcttttatttctttatttttatttttttatattttatttctttatttttatttattgattgattttttttttgttttgagayagagtctcactctgtcacccaggctggaatgcagtggcacgatctcagctcgccgcaacctccgcctcctgggttctagcaattcccctgcctcagcttc

SEQ ID NO: 79132 - DNA, 201 bp, Homo sapiens
tgacttaccaccctacaaaagatggcatgaattgatgcttgacaaggcaccaatggtatgctatgatgcttaaatcttttatttctttatttttatttttatatattttatttctttatttttatttattgattgattttttttttgttttgagacagagtctcactctgtcacccaggctggaatgcagtggcacgatct

SEQ ID NO: 79133 - DNA, 201 bp, Homo sapiens
ctctcattacaggtacagaggtgcagttccatggtacaccataaatcttgacttaccaccctacaaaagatggcatgaattgatgcttgacaaggcaccartggtatgctatgatgcttaaatcttttatttctttatttttatttttttatattttatttctttatttttatttattgattgattttttttttgttttga

SEQ ID NO: 79134 - DNA, 201 bp, Homo sapiens
gggtaaccaaattctacactgttgttaagactttgcctctcatatattcttatagatgtatctaactgaccctcacaaaaaaccctttcatcatttcaagrtgatacacctctcattacaggtacagaggtgcagttccatggtacaccataaatcttgacttaccaccctacaaaagatggcatgaattgatgcttgaca

SEQ ID NO: 79135 - DNA, 201 bp, Homo sapiens
tttctgtgaccgcttatgattgtgttctcaacctagaagcactaggtagagaatgaactttctttccaaattttggtttgggtaaccaaattctacactgytgttaagactttgcctctcatatattcttatagatgtatctaactgaccctcacaaaaaaccctttcatcatttcaaggtgatacacctctcattacagg

SEQ ID NO: 79136 - DNA, 201 bp, Homo sapiens
aatacagcttgggcttggactttgtccagaaaaatgagaagagaagaggtatatagtagggaagattaggatggctgacagaatcatgaaggttcttgaarctgatcgtgggaagataatacatgttgccatctggggcttaaaaggtgatcttcctgaaggcaacactggagacattggtttggcaatagtgttacactc

SEQ ID NO: 79137 - DNA, 201 bp, Homo sapiens
tgtagaattcatccaccagaaatatggcccagcttcactgataagtgactggatgttgctatatcctcagaaattgctgcacgtaagttaaagagtaggargttggaggatatgacagaatacagcttgggcttggactttgtccagaaaaatgagaagagaagaggtatatagtagggaagattaggatggctgacagaa

SEQ ID NO: 79138 - DNA, 201 bp, Homo sapiens
tttagcaatgattttcacgcagttgccagaaatctcatagaccccatctggcctaggaatttattgcacttcatctgcttttccctacttctcccaaagarggaacacacaggtgtaatccattcacttattcaacaaatactgcttgcctactatgtgccagactcctaaacgctgggaatgcgtcagccaatgagatag

SEQ ID NO: 79139 - DNA, 201 bp, Homo sapiens
ttgtggcacataccagagtcaccctgccagtctcaggagcagatcagtggaacagatgatggttatttttaggcataggtttatactgataaaccactaamtggcacacccttaaaagctatttcagtttagtaaccagggccagaaaataatgttcctatagcaacaaaaatagttgtagaattcatccaccagaaatat

SEQ ID NO: 79140 - DNA, 201 bp, Homo sapiens
acctgaatgtctgctagttaacagtttcataaaacctcatacatataccagggccccaagttacacagcattatttagagaaccaagtaattatttatgayagtggaaatataaatagaaccacagttcatgacttaggtaataacccatccccagctatggacataagtctagataacatttctatttaggagactggta

SEQ ID NO: 79141 - DNA, 201 bp, Homo sapiens
tgttgccattaaagattcccttggttctggcatttttctttggccttcaagtaatttataaacgtcctatttttcatagtatctctagccactctccactratttttttgtttcgttttcttaacttaaagagcaaaattgtgctgtactttccttttctggttctaatgctggataccactctgaagttgaataacaaac

SEQ ID NO: 79142 - DNA, 201 bp, Homo sapiens
atggcaggtatttcccgtcagtgataatcaggttagagctcttaagccatagttgattttttcatagaaaaccaattcacatgaaccttccctactagatmattctattccaggatttctgtgaccgcttatgattgtgttctcaacctagaagcactaggtagagaatgaactttctttccaaattttggtttgggtaac

SEQ ID NO: 79143 - DNA, 201 bp, Homo sapiens
ttacaaagtctaacctcttctggttcctgactggttatatagtccagcctcttccgggtcctgactggttacatagtgtcacctcttccggttcctgacaytgtgttcatctcttccaggtattctagaatggattctgggaaagaaagatgccatgtggatagggttcctcactagaacagttctggaaaatagcacaag

SEQ ID NO: 79144 - DNA, 201 bp, Homo sapiens
tttcattgagggtctcctaattctttcgggctcaaatattttaaggagctgtacaagttatgccattttttaagggtatggcgctttcattgagaccttawtaatgttctctttatatttttgttttttttttagaatgttgtgttcagtagctctgtaattaatttctcttaatgaatggggaggacattcaaagaggct

SEQ ID NO: 79145 - DNA, 201 bp, Homo sapiens
gtgccttctggttacaaagtccaacctcttccggttcccgactggttacaaagtctaacctcttctggttcctgactggttatatagtccagcctcttccrggtcctgactggttacatagtgtcacctcttccggttcctgacattgtgttcatctcttccaggtattctagaatggattctgggaaagaaagatgccat

SEQ ID NO: 79146 - DNA, 201 bp, Homo sapiens
atgtagatatcagctcctaagaaaatggggaacttgaaaatgctttgagaagaacaaaattcgttcactatgattttgtttaaatgtacatttccaaaatygaatatacttttcttttctgtctaaatcacaacctgaatgtctgctagttaacagtttcataaaacctcatacatataccagggccccaagttacacagc

SEQ ID NO: 79147 - DNA, 201 bp, Homo sapiens
taatatggggaacaataattacttactgaattgtgggacaaaattttacatgtgaaattatggtctgtcagaaatggaattaatttgttgtgatgaaaagyttttttctagaatataagtattgtagcatttcatgtagatatcagctcctaagaaaatggggaacttgaaaatgctttgagaagaacaaaattcgttcac

SEQ ID NO: 79148 - DNA, 201 bp, Homo sapiens
ttatagtgaattctctgaagaatatgataaatacattcgtgccaagtggaaaaattatgcaggtggtggatgaaaaattggtaagagatattatttctcamaataaatgttaagcacatagaaaatgcgctgttatttatttaaaggcataattcagcaacctcttcgcagggacttgggcaaatctgcatgaatctagct

SEQ ID NO: 79149 - DNA, 201 bp, Homo sapiens
aatcaggaatttatggcggatatagaggcatgatttgggattggttggatgttatgaggtgaggagcagctgattggagttcatagggatgagatgcatakctccaacaggccactgagttatctttgctactagacatagaaatctaaatgcacagttgaagggagaggggagactagtaatacctgcccataatatggg

SEQ ID NO: 79150 - DNA, 201 bp, Homo sapiens
attgtccgttgtgttgtgttcatcccctctcatcgcgtctctgagatccatgaacctacccaggactctaggctgaaaaagaatcaggaatttatggcggrtatagaggcatgatttgggattggttggatgttatgaggtgaggagcagctgattggagttcatagggatgagatgcatagctccaacaggccactgagt

SEQ ID NO: 79151 - DNA, 201 bp, Homo sapiens
tttagaaaactgtttaacgagaggtaaaatgtgcaattatggctaagctttagtcattaaaataatttggtttattagattaaccagttctctcaaattckaattagtgcaggtttgatggtagagaggtttgtggggtctcatcatccccacttcattgtaatcccttcattgtccgttgtgttgtgttcatcccctctc

SEQ ID NO: 79152 - DNA, 201 bp, Homo sapiens
atgggcagatatgagggaagaaaaagataacctgtttggccagcatgactagtcaaatcaatgctgaagataaaggaactgatagccagatcacccctgartccatctgagtcccattcagcatttctttcccactgctcacgggatgcctagcacttgctctcttatttgtatatgtgtgtgttgtgtcacctggactag

SEQ ID NO: 79153 - DNA, 201 bp, Homo sapiens
taagtgcgtagatttgggcagcatccatgggcagatatgagggaagaaaaagataacctgtttggccagcatgactagtcaaatcaatgctgaagataaargaactgatagccagatcacccctgaatccatctgagtcccattcagcatttctttcccactgctcacgggatgcctagcacttgctctcttatttgtata

SEQ ID NO: 79154 - DNA, 201 bp, Homo sapiens
gtaagttaccatggaaagatgatgaagggccctgtgctgtgtgccctgaaaatctggtttgggaggcaaatcccaggacaggttgcaacacacatggctgrtaagtgcagataatacatcctatcaggtcatttacttttagtgctaagtcagcctctctaacataaatattttccatctactttgttacatttgttcgtt

SEQ ID NO: 79155 - DNA, 201 bp, Homo sapiens
ttctaaatgaaattagaacttctgaaatttgggcttgctatgtaaattctgtgtatgttgcatacagctttttatttcttggtaaaattttgtgattgtastgaaaattttccttattttcagactactgtactgcctattaaagttgatttcagacatgcaaaaaacctggaagaaatgttgcagggctagaaacattct

SEQ ID NO: 79156 - DNA, 201 bp, Homo sapiens
taatttgatgtttattttggctttggaacccagggcgtgcaaatgtcattattaggaagggataggagtcattacgtttcacttaatttgccgagttgatkctagtgatcaccagaagccctgaactacgcgcagattattctgttaggaattaaattgaggcattggttttattatctctgtgggaagctgtttgataga

SEQ ID NO: 79157 - DNA, 201 bp, Homo sapiens
actacataaagaaaaatcttctaaatgaaattagaacttctgaaatttgggcttgctatgtaaattctgtgtatgttgcatacagctttttatttcttggyaaaattttgtgattgtactgaaaattttccttattttcagactactgtactgcctattaaagttgatttcagacatgcaaaaaacctggaagaaatgttg

SEQ ID NO: 79158 - DNA, 201 bp, Homo sapiens
agttgtctagtaagaaatgtgcctgtaatttgatgtttattttggctttggaacccagggcgtgcaaatgtcattattaggaagggataggagtcattacrtttcacttaatttgccgagttgattctagtgatcaccagaagccctgaactacgcgcagattattctgttaggaattaaattgaggcattggttttatta

SEQ ID NO: 79159 - DNA, 201 bp, Homo sapiens
ttcacgattaactgtgaaatgtacgtcatttgtgcaagaccgtttgtccacttcattttgtataatcacagttgtgttcctgacactcaataaacagtcaytggaaagagtgccagtcagcagtcatgcacgctgattgggtgtgtacatctgtgttggtttggaggaggggggttattatcaagaaatacaagctgaaca

SEQ ID NO: 79160 - DNA, 201 bp, Homo sapiens
aagcaatcttttatacaataattgaagtgttccctttttcataattactctacttcccagtaaccctaaggaagttgctaacttaaaaaactgcatcccasgttctgttaatttagtaaataaacaagtcaaagacttgtggaaaataggaagtgaacccatattttaaattctcataagtagcattcatgtaataaacag

SEQ ID NO: 79161 - DNA, 201 bp, Homo sapiens
tctaaatagcactttttggggttcaagaagtaatcagtatgcaaagcaatcttttatacaataattgaagtgttccctttttcataattactctacttccyagtaaccctaaggaagttgctaacttaaaaaactgcatcccacgttctgttaatttagtaaataaacaagtcaaagacttgtggaaaataggaagtgaac

SEQ ID NO: 79162 - DNA, 201 bp, Homo sapiens
tcccactctgaagtacagtgagcgacagggccttaaagcgcatggttgatgtttctgacttcgttgctttgtctttttctcagggactgttcagtcttacrctgaatgaacgtttcagtataaatggtggttatctgggtaagtagagcattctcaagtgaaatgggaatctcagagcttttttatgaggaaggctggact

SEQ ID NO: 79163 - DNA, 201 bp, Homo sapiens
ccattacccaagctaggcctttatatcccactctgaagtacagtgagcgacagggccttaaagcgcatggttgatgtttctgacttcgttgctttgtcttyttctcagggactgttcagtcttacactgaatgaacgtttcagtataaatggtggttatctgggtaagtagagcattctcaagtgaaatgggaatctcaga

SEQ ID NO: 79164 - DNA, 201 bp, Homo sapiens
tatttttgccttccccattacccaagctaggcctttatatcccactctgaagtacagtgagcgacagggccttaaagcgcatggttgatgtttctgacttsgttgctttgtctttttctcagggactgttcagtcttacactgaatgaacgtttcagtataaatggtggttatctgggtaagtagagcattctcaagtgaa

SEQ ID NO: 79165 - DNA, 201 bp, Homo sapiens
ggctgggtgtcaagggctgggagtcacaatctgatttctagtcctgggtcttccgctcacttaggcaagtcaggcgttcattctctgcccttcagtttcckgtccaaaaagcgttgccagtgataccccacctacttatctcacatactagaatcaaaaatgctttgaactttttaaaaagccttttatggttttgattta

SEQ ID NO: 79166 - DNA, 201 bp, Homo sapiens
taaatgcttttattaatatatttgttttccagcctggcctacttggcaactttcctggcccttttgaagaggaaatgaagggtattgccgctgttactgawatacctttaggtaaagttcacttagaagctttaaaaaaaaaagtaattaaattcttttacaagtttccattgaggtgtgatatacatacagcaaagtgca

SEQ ID NO: 79167 - DNA, 201 bp, Homo sapiens
ctttgctcacagttgtctagtaagaaatgtgcctgtaatttgatgtttattttggctttggaacccagggcgtgcaaatgtcattattaggaagggatagsagtcattacgtttcacttaatttgccgagttgattctagtgatcaccagaagccctgaactacgcgcagattattctgttaggaattaaattgaggcatt

SEQ ID NO: 79168 - DNA, 201 bp, Homo sapiens
agtcttgctctgtctcccaggctggagtgcagtcacactatctcgtctcactgcaacttccacctcctggcttcaggcaattctcctacctcagccttccragtacctaggattacaggcacatgccaccagctaatttttgcattgttagtagtaacggggatttcgccatgttggccaggctggtcttgaagtcctgac

SEQ ID NO: 79169 - DNA, 201 bp, Homo sapiens
ggcatccgttccaggaaacatggggaggggaaagcttgggggctaaagaatgaggatcgttttcatttggggtgtatgttaaatttcaggtggcagagagrcatccagcaggccactcggactggcactcagaagagagacactgagagtcactggcataatgatattatatttgaagcccttggagcagatgaacttacc

SEQ ID NO: 79170 - DNA, 201 bp, Homo sapiens
cctctcaatggatataatagttcttatctagaacagcgattatcaaagtctagtctggccactggtgtcactttgggaagctgttttcacaggttttcaakgaaactggaaaaataagaatgcaaaactaaaattattaatttagaatgttaatctttactctgattgtatggacttcaagttttcattgttgcaaacgtg

SEQ ID NO: 79171 - DNA, 201 bp, Homo sapiens; identical to SEQ ID NO: 54135

SEQ ID NO: 79172 - DNA, 201 bp, Homo sapiens; identical to SEQ ID NO: 54136

SEQ ID NO: 79173 - DNA, 201 bp, Homo sapiens; identical to SEQ ID NO: 54137

SEQ ID NO: 79174 - DNA, 201 bp, Homo sapiens; identical to SEQ ID NO: 54144

SEQ ID NO: 79175 - DNA, 201 bp, Homo sapiens; identical to SEQ ID NO: 54146

SEQ ID NO: 79176 - DNA, 201 bp, Homo sapiens; identical to SEQ ID NO: 54148

SEQ ID NO: 79177 - DNA, 201 bp, Homo sapiens; identical to SEQ ID NO: 54150

SEQ ID NO: 79178 - DNA, 201 bp, Homo sapiens; identical to SEQ ID NO: 10301

SEQ ID NO: 79179 - DNA, 201 bp, Homo sapiens; identical to SEQ ID NO: 10306

SEQ ID NO: 79180 - DNA, 201 bp, Homo sapiens; identical to SEQ ID NO: 54156

SEQ ID NO: 79181 - DNA, 201 bp, Homo sapiens
ggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgcctcgactagcgtgacacctccttggatcggcgtccaagggttatgcaggg

SEQ ID NO: 79182 - DNA, 201 bp, Homo sapiens; identical to SEQ ID NO: 54161

SEQ ID NO: 79183 - DNA, 201 bp, Homo sapiens; identical to SEQ ID NO: 54162

SEQ ID NO: 79184 - DNA, 201 bp, Homo sapiens; identical to SEQ ID NO: 54163

SEQ ID NO: 79185 - DNA, 201 bp, Homo sapiens; identical to SEQ ID NO: 54164

SEQ ID NO: 79186 - DNA, 201 bp, Homo sapiens; identical to SEQ ID NO: 54165

SEQ ID NO: 79187 - DNA, 201 bp, Homo sapiens; identical to SEQ ID NO: 54166

SEQ ID NO: 79188 - DNA, 201 bp, Homo sapiens; identical to SEQ ID NO: 54167

SEQ ID NO: 79189 - DNA, 201 bp, Homo sapiens; identical to SEQ ID NO: 54169

SEQ ID NO: 79190 - DNA, 201 bp, Homo sapiens
caaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtc

SEQ ID NO: 79191 - DNA, 201 bp, Homo sapiens
cgggcgctctcaggcacttaccgctgcaaggcggccaatgatcaaggcgaggcggtcaaggacgtaacgctaacggtggagtgtgagtgggggtgcgcagrgtgcatttctatctggttcaaggtctggagggtggccagcctccagggaagagtaggagtagggtatgaggtgtccctttgggtgaggttttgggaaagg

SEQ ID NO: 79192 - DNA, 201 bp, Homo sapiens; identical to SEQ ID NO: 10293

SEQ ID NO: 79193 - DNA, 201 bp, Homo sapiens; identical to SEQ ID NO: 54171

SEQ ID NO: 79194 - DNA, 201 bp, Homo sapiens; identical to SEQ ID NO: 54172

SEQ ID NO: 79195 - DNA, 201 bp, Homo sapiens; identical to SEQ ID NO: 10295

SEQ ID NO: 79196 - DNA, 201 bp, Homo sapiens; identical to SEQ ID NO: 54175

SEQ ID NO: 79197 - DNA, 201 bp, Homo sapiens
tcatcgaggggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcc

SEQ ID NO: 79198 - DNA, 201 bp, Homo sapiens; identical to SEQ ID NO: 54176

SEQ ID NO: 79199 - DNA, 201 bp, Homo sapiens; identical to SEQ ID NO: 54178

SEQ ID NO: 79200 - DNA, 201 bp, Homo sapiens; identical to SEQ ID NO: 54179

SEQ ID NO: 79201 - DNA, 201 bp, Homo sapiens; identical to SEQ ID NO: 54180

SEQ ID NO: 79202 - DNA, 201 bp, Homo sapiens; identical to SEQ ID NO: 54181

SEQ ID NO: 79203 - DNA, 201 bp, Homo sapiens; identical to SEQ ID NO: 54182

SEQ ID NO: 79204 - DNA, 201 bp, Homo sapiens; identical to SEQ ID NO: 54183

SEQ ID NO: 79205 - DNA, 201 bp, Homo sapiens; identical to SEQ ID NO: 10317

SEQ ID NO: 79206 - DNA, 201 bp, Homo sapiens; identical to SEQ ID NO: 54185

SEQ ID NO: 79207 - DNA, 201 bp, Homo sapiens; identical to SEQ ID NO: 54188

SEQ ID NO: 79208 - DNA, 201 bp, Homo sapiens; identical to SEQ ID NO: 54190

SEQ ID NO: 79209 - DNA, 201 bp, Homo sapiens; identical to SEQ ID NO: 54191

SEQ ID NO: 79210 - DNA, 201 bp, Homo sapiens; identical to SEQ ID NO: 54189

SEQ ID NO: 79211 - DNA, 201 bp, Homo sapiens; identical to SEQ ID NO: 54192

SEQ ID NO: 79212 - DNA, 201 bp, Homo sapiens; identical to SEQ ID NO: 54193

SEQ ID NO: 79213 - DNA, 201 bp, Homo sapiens; identical to SEQ ID NO: 54194

SEQ ID NO: 79214 - DNA, 201 bp, Homo sapiens; identical to SEQ ID NO: 54195

SEQ ID NO: 79215 - DNA, 201 bp, Homo sapiens
gccttgccgcgccaaggagggtctagggacgtcagatttgcccccaaaccccaaagccaacaatacactccctcctccagacgcaccagcgctggacagcrtgggctgcccagaacgcattacttggctggagggaacagaagcctcgctgagctgtgtggcgcacggggtaccgccgcctgatgtgatctgcgtgcgctc

SEQ ID NO: 79216 - DNA, 201 bp, Homo sapiens; identical to SEQ ID NO: 54196

SEQ ID NO: 79217 - DNA, 201 bp, Homo sapiens; identical to SEQ ID NO: 54199

SEQ ID NO: 79218 - DNA, 201 bp, Homo sapiens; identical to SEQ ID NO: 10300

SEQ ID NO: 79219 - DNA, 201 bp, Homo sapiens; identical to SEQ ID NO: 10305

SEQ ID NO: 79220 - DNA, 201 bp, Homo sapiens; identical to SEQ ID NO: 10308

SEQ ID NO: 79221 - DNA, 201 bp, Homo sapiens; identical to SEQ ID NO: 54206

SEQ ID NO: 79222 - DNA, 201 bp, Homo sapiens; identical to SEQ ID NO: 10311

SEQ ID NO: 79223 - DNA, 201 bp, Homo sapiens; identical to SEQ ID NO: 10314

SEQ ID NO: 79224 - DNA, 201 bp, Homo sapiens; identical to SEQ ID NO: 54210

SEQ ID NO: 79225 - DNA, 201 bp, Homo sapiens
ccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgc

SEQ ID NO: 79226 - DNA, 201 bp, Homo sapiens; identical to SEQ ID NO: 54214

SEQ ID NO: 79227 - DNA, 201 bp, Homo sapiens; identical to SEQ ID NO: 54215

SEQ ID NO: 79228 - DNA, 201 bp, Homo sapiens; identical to SEQ ID NO: 54216

SEQ ID NO: 79229 - DNA, 201 bp, Homo sapiens; identical to SEQ ID NO: 54217

SEQ ID NO: 79230 - DNA, 201 bp, Homo sapiens; identical to SEQ ID NO: 54218

SEQ ID NO: 79231 - DNA, 201 bp, Homo sapiens; identical to SEQ ID NO: 54219

SEQ ID NO: 79232 - DNA, 201 bp, Homo sapiens; identical to SEQ ID NO: 54220

SEQ ID NO: 79233 - DNA, 201 bp, Homo sapiens; identical to SEQ ID NO: 54221

SEQ ID NO: 79234 - DNA, 201 bp, Homo sapiens; identical to SEQ ID NO: 54222

SEQ ID NO: 79235 - DNA, 201 bp, Homo sapiens; identical to SEQ ID NO: 54223

SEQ ID NO: 79236 - DNA, 201 bp, Homo sapiens; identical to SEQ ID NO: 54224

SEQ ID NO: 79237 - DNA, 201 bp, Homo sapiens
accaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagctt

SEQ ID NO: 79238 - DNA, 201 bp, Homo sapiens; identical to SEQ ID NO: 54225

SEQ ID NO: 79239 - DNA, 201 bp, Homo sapiens
ctctcaggcacttaccgctgcaaggcggccaatgatcaaggcgaggcggtcaaggacgtaacgctaacggtggagtgtgagtgggggtgcgcagggtgcayttctatctggttcaaggtctggagggtggccagcctccagggaagagtaggagtagggtatgaggtgtccctttgggtgaggttttgggaaagggaagag

SEQ ID NO: 79240 - DNA, 201 bp, Homo sapiens; identical to SEQ ID NO: 54227

SEQ ID NO: 79241 - DNA, 201 bp, Homo sapiens
ttgggcggagtcgtggaaaggcgggcagtccagagtgtttaagtttttagacgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtca

SEQ ID NO: 79242 - DNA, 201 bp, Homo sapiens; identical to SEQ ID NO: 54229

SEQ ID NO: 79243 - DNA, 201 bp, Homo sapiens; identical to SEQ ID NO: 54234

SEQ ID NO: 79244 - DNA, 201 bp, Homo sapiens; identical to SEQ ID NO: 10303

SEQ ID NO: 79245 - DNA, 201 bp, Homo sapiens; identical to SEQ ID NO: 54237

SEQ ID NO: 79246 - DNA, 201 bp, Homo sapiens
ggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacggtggaat

SEQ ID NO: 79247 - DNA, 201 bp, Homo sapiens; identical to SEQ ID NO: 54245

SEQ ID NO: 79248 - DNA, 201 bp, Homo sapiens; identical to SEQ ID NO: 54137

SEQ ID NO: 79249 - DNA, 201 bp, Homo sapiens
tggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcac

SEQ ID NO: 79250 - DNA, 201 bp, Homo sapiens
ggggcgtgacctgggtcttggggcggccggccccgcctgcctccctctcggtcccggtagactagacggaagtgggacagagtagaagtcaaaggtgcctkagcgggtggggctgttgatcgcactttgaggggtgggagatggaggtggcagggggactgaattcaaggggagggaccctccggggctgtcactgctgca

SEQ ID NO: 79251 - DNA, 201 bp, Homo sapiens; identical to SEQ ID NO: 10301

SEQ ID NO: 79252 - DNA, 201 bp, Homo sapiens; identical to SEQ ID NO: 10306

SEQ ID NO: 79253 - DNA, 201 bp, Homo sapiens; identical to SEQ ID NO: 54156

SEQ ID NO: 79254 - DNA, 201 bp, Homo sapiens
gcgcccccgggggccctcaacatcggcctgtcgagcaacaacagcacactgagcgtggcaggcgccatgggaagccacggcggcgagtacgagtgcgcagscaccaacgcgcacgggcgccacgcgcggcgcatcacggtgcgcgtggccggtaagtggcagctggggagaggcggggcgaggtatctgagagggggcgtg

SEQ ID NO: 79255 - DNA, 201 bp, Homo sapiens; identical to SEQ ID NO: 79181

SEQ ID NO: 79256 - DNA, 201 bp, Homo sapiens
caccagccaggtgcagtccctgccactaacagcacctcaccttttctgcctgtgccctccctacttaatgatctctctccgctcctactgacctcaaggtstctttcagagccttcagatgagatatttattttagtaggttggtgcaaaagtaattgctgtttttgccattgaaagtaatggcaggcagggcatggtggc

SEQ ID NO: 79257 - DNA, 201 bp, Homo sapiens; identical to SEQ ID NO: 54161

SEQ ID NO: 79258 - DNA, 201 bp, Homo sapiens
ggggcgaggtatctgagagggggcgtgacctgggtcttggggcggccggccccgcctgcctccctctcggtcccggtagactagacggaagtgggacagartagaagtcaaaggtgccttagcgggtggggctgttgatcgcactttgaggggtgggagatggaggtggcagggggactgaattcaaggggagggaccctc

SEQ ID NO: 79259 - DNA, 201 bp, Homo sapiens
cgcgcccccgggggccctcaacatcggcctgtcgagcaacaacagcacactgagcgtggcaggcgccatgggaagccacggcggcgagtacgagtgcgcasccaccaacgcgcacgggcgccacgcgcggcgcatcacggtgcgcgtggccggtaagtggcagctggggagaggcggggcgaggtatctgagagggggcgt

SEQ ID NO: 79260 - DNA, 201 bp, Homo sapiens; identical to SEQ ID NO: 54162

SEQ ID NO: 79261 - DNA, 201 bp, Homo sapiens
tgcctcgccccctggaggcgtgcgcccaggaggaaacttcacgttgacctgccgcgcggaggcctggcctccagcccagatcagctggcgcgcgcccccgrgggccctcaacatcggcctgtcgagcaacaacagcacactgagcgtggcaggcgccatgggaagccacggcggcgagtacgagtgcgcagccaccaacgc

SEQ ID NO: 79262 - DNA, 201 bp, Homo sapiens; identical to SEQ ID NO: 54163

SEQ ID NO: 79263 - DNA, 201 bp, Homo sapiens; identical to SEQ ID NO: 54164

SEQ ID NO: 79264 - DNA, 201 bp, Homo sapiens; identical to SEQ ID NO: 54165

SEQ ID NO: 79265 - DNA, 201 bp, Homo sapiens; identical to SEQ ID NO: 54166

SEQ ID NO: 79266 - DNA, 201 bp, Homo sapiens; identical to SEQ ID NO: 54167

SEQ ID NO: 79267 - DNA, 201 bp, Homo sapiens; identical to SEQ ID NO: 54169

SEQ ID NO: 79268 - DNA, 201 bp, Homo sapiens; identical to SEQ ID NO: 79190

SEQ ID NO: 79269 - DNA, 201 bp, Homo sapiens
accttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgggggccctcaacatcggcctgtcgagcaacaacagcacactgagcgtggcaggcgcca

SEQ ID NO: 79270 - DNA, 201 bp, Homo sapiens; identical to SEQ ID NO: 79191

SEQ ID NO: 79271 - DNA, 201 bp, Homo sapiens; identical to SEQ ID NO: 10293

SEQ ID NO: 79272 - DNA, 201 bp, Homo sapiens; identical to SEQ ID NO: 54171

SEQ ID NO: 79273 - DNA, 201 bp, Homo sapiens; identical to SEQ ID NO: 54172

SEQ ID NO: 79274 - DNA, 201 bp, Homo sapiens; identical to SEQ ID NO: 10295

SEQ ID NO: 79275 - DNA, 201 bp, Homo sapiens
tcacgtctgtaatcccagcactttgcgaggctgaggcgggcggatcatggggttagaagatcaagactgtcctggctaacatggtgaaaccccgtcactamtaaaaacacaaaaattagccgggcgtggtggcacatgcctgtagtcccagctactcaagaggctgaggcaggagaatcgctttaaccccggaggcagagg

SEQ ID NO: 79276 - DNA, 201 bp, Homo sapiens; identical to SEQ ID NO: 79197

SEQ ID NO: 79277 - DNA, 201 bp, Homo sapiens; identical to SEQ ID NO: 54175

SEQ ID NO: 79278 - DNA, 201 bp, Homo sapiens; identical to SEQ ID NO: 54176

SEQ ID NO: 79279 - DNA, 201 bp, Homo sapiens
ggtaagtggcagctggggagaggcggggcgaggtatctgagagggggcgtgacctgggtcttggggcggccggccccgcctgcctccctctcggtcccggkagactagacggaagtgggacagagtagaagtcaaaggtgccttagcgggtggggctgttgatcgcactttgaggggtgggagatggaggtggcaggggga

SEQ ID NO: 79280 - DNA, 201 bp, Homo sapiens
gcagctggggagaggcggggcgaggtatctgagagggggcgtgacctgggtcttggggcggccggccccgcctgcctccctctcggtcccggtagactagrcggaagtgggacagagtagaagtcaaaggtgccttagcgggtggggctgttgatcgcactttgaggggtgggagatggaggtggcagggggactgaattc

SEQ ID NO: 79281 - DNA, 201 bp, Homo sapiens
ctggggagaggcggggcgaggtatctgagagggggcgtgacctgggtcttggggcggccggccccgcctgcctccctctcggtcccggtagactagacggwagtgggacagagtagaagtcaaaggtgccttagcgggtggggctgttgatcgcactttgaggggtgggagatggaggtggcagggggactgaattcaagg

SEQ ID NO: 79282 - DNA, 201 bp, Homo sapiens
ctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgct

SEQ ID NO: 79283 - DNA, 201 bp, Homo sapiens
tgatcttggctcactgcaacctctgcctcctgggttcaagcaattcccctgccttggcttcccaaatagctgggactataggcatgcaccaccacacccarctaatttttgtatttttagtagagacagggtttcaccatgttggccaggctggtctcgaactcctgacctaaggtgatccacctgcctcggtctcccaaa

SEQ ID NO: 79284 - DNA, 201 bp, Homo sapiens
ccagaccctgtctctaaaaacaaacaacgaaaaaatccaaaaactttttttgaacacctactatgcatcaggcacaatctaagctgtctttttctttttcttttttttatttttgagacggagtctctctgtcgcccaggctggagtgcagtggtgtaatctcagctcactgcaagctctgcctcccacgttcaagcgatt

SEQ ID NO: 79285 - DNA, 201 bp, Homo sapiens; identical to SEQ ID NO: 54180

SEQ ID NO: 79286 - DNA, 201 bp, Homo sapiens
tgtctctaaaaacaaacaacgaaaaaatccaaaaactttttttgaacacctactatgcatcaggcacaatctaagctgtctttttctttttcttttttttwtttttgagacggagtctctctgtcgcccaggctggagtgcagtggtgtaatctcagctcactgcaagctctgcctcccacgttcaagcgattttcctgcc

SEQ ID NO: 79287 - DNA, 201 bp, Homo sapiens; identical to SEQ ID NO: 54181

SEQ ID NO: 79288 - DNA, 201 bp, Homo sapiens
aggctggtctcgaactcctgatccacccacctcagcttcccaaagtgctgggattacaggcaggcatgagccatggtgcccgacatttttttttttttttytttttttttttgagacagagtctcactttgtcacccaggctggagtgcaaaggcaagatctcactgcagcctctgcctcctgggttaaagcgattctccc

SEQ ID NO: 79289 - DNA, 201 bp, Homo sapiens; identical to SEQ ID NO: 54182

SEQ ID NO: 79290 - DNA, 201 bp, Homo sapiens
gtgcaaaggcaagatctcactgcagcctctgcctcctgggttaaagcgattctcccaccttagccccctgagtaggtgagattacaggcacatgccaccamacctgcctaatttttgtatttttaatagagagggggtttcaccattttgtccacgctggtctcgaactcctgacctcaagggattcgcccacctcagcct

SEQ ID NO: 79291 - DNA, 201 bp, Homo sapiens; identical to SEQ ID NO: 54183

SEQ ID NO: 79292 - DNA, 201 bp, Homo sapiens
cttgcagtgagccgagatcgcgccactgcactccaccctggcagacagcaagactccgtctcaaaaaaaaaaaaaaaaattagccagggccgagcacagtrctctcgcttgaatcccagaactttgggaaactaaggcggggggggggggtcacttgaggtcaggagttcgagaccaccctggccaacgtggtgaaacacc

SEQ ID NO: 79293 - DNA, 201 bp, Homo sapiens
ttagccttccaaaatgctgggattacaggcatgaggcaccgcgtcctgcctctgagttttttttttttttttttttactgtctcctagaacatcagccccrgtagagcagggatctttgttctgttcaccactgagggtcctcattgggtcctagcacacacagttgctcaataaatgttgaataagtgggtaaagacagc

SEQ ID NO: 79294 - DNA, 201 bp, Homo sapiens; identical to SEQ ID NO: 10317

SEQ ID NO: 79295 - DNA, 201 bp, Homo sapiens; identical to SEQ ID NO: 54185

SEQ ID NO: 79296 - DNA, 201 bp, Homo sapiens; identical to SEQ ID NO: 54189

SEQ ID NO: 79297 - DNA, 201 bp, Homo sapiens; identical to SEQ ID NO: 54190

SEQ ID NO: 79298 - DNA, 201 bp, Homo sapiens
aaggactttaaaacttgggctggattctgcgtggtggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggt

SEQ ID NO: 79299 - DNA, 201 bp, Homo sapiens; identical to SEQ ID NO: 54193

SEQ ID NO: 79300 - DNA, 201 bp, Homo sapiens; identical to SEQ ID NO: 54194

SEQ ID NO: 79301 - DNA, 201 bp, Homo sapiens; identical to SEQ ID NO: 79215

SEQ ID NO: 79302 - DNA, 201 bp, Homo sapiens; identical to SEQ ID NO: 54195

SEQ ID NO: 79303 - DNA, 201 bp, Homo sapiens
cagtccgcctgccttagccttccaaaatgctgggattacaggcatgaggcaccgcgtcctgcctctgagttttttttttttttttttttactgtctcctaraacatcagccccagtagagcagggatctttgttctgttcaccactgagggtcctcattgggtcctagcacacacagttgctcaataaatgttgaataagt

SEQ ID NO: 79304 - DNA, 201 bp, Homo sapiens; identical to SEQ ID NO: 54196

SEQ ID NO: 79305 - DNA, 201 bp, Homo sapiens
agatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgttggagggagagaggggtcaagatcgccttctctc

SEQ ID NO: 79306 - DNA, 201 bp, Homo sapiens; identical to SEQ ID NO: 54199

SEQ ID NO: 79307 - DNA, 201 bp, Homo sapiens
aataaagtttttataaaggaactccctgtctccgcttctgtttctgcaaggtggaacaagcccagggttccagtcgtgacctcccgagttattcattcaawaagcgatttttgagagggcctggggtggtggcttaggcctgtaatcccaggacttgtgggaggcccaggtgggaggatcccttgcacccaagagtttcag

SEQ ID NO: 79308 - DNA, 201 bp, Homo sapiens; identical to SEQ ID NO: 10300

SEQ ID NO: 79309 - DNA, 201 bp, Homo sapiens
ggagcacggccctcctcaaatcctggattagaacactgacctgggcttcacctccttccattcggtgaagaagggcgaggaattttagccgcaacagcagyctgattgtcggggaaggaggctctgataggaggcaggatcctcttctgcccatcagaggcgcggtggtctcccatcgatcgttgtgggccggagcagggc

SEQ ID NO: 79310 - DNA, 201 bp, Homo sapiens; identical to SEQ ID NO: 10305

SEQ ID NO: 79311 - DNA, 201 bp, Homo sapiens; identical to SEQ ID NO: 10308

SEQ ID NO: 79312 - DNA, 201 bp, Homo sapiens; identical to SEQ ID NO: 54206

SEQ ID NO: 79313 - DNA, 201 bp, Homo sapiens; identical to SEQ ID NO: 10311

SEQ ID NO: 79314 - DNA, 201 bp, Homo sapiens; identical to SEQ ID NO: 10314

SEQ ID NO: 79315 - DNA, 201 bp, Homo sapiens; identical to SEQ ID NO: 54210

SEQ ID NO: 79316 - DNA, 201 bp, Homo sapiens
agatcacgaggtcgaggtcatgagatcgagaccatcctggccaatatggtgaaaccctgtctctactaaaaatacaaaaattagctgggcatggtggtgcrcgcctgtagtcccagctattcgggaggctgaggcaggagaatcgctttaaccccggaggcagaggttgcagtgagccgagatcgtgccactgaactccag

SEQ ID NO: 79317 - DNA, 201 bp, Homo sapiens
acgaggtcgaggtcatgagatcgagaccatcctggccaatatggtgaaaccctgtctctactaaaaatacaaaaattagctgggcatggtggtgcgcgccygtagtcccagctattcgggaggctgaggcaggagaatcgctttaaccccggaggcagaggttgcagtgagccgagatcgtgccactgaactccagcctgg

SEQ ID NO: 79318 - DNA, 201 bp, Homo sapiens; identical to SEQ ID NO: 79225

SEQ ID NO: 79319 - DNA, 201 bp, Homo sapiens; identical to SEQ ID NO: 54215

SEQ ID NO: 79320 - DNA, 201 bp, Homo sapiens; identical to SEQ ID NO: 54214

SEQ ID NO: 79321 - DNA, 201 bp, Homo sapiens; identical to SEQ ID NO: 54216

SEQ ID NO: 79322 - DNA, 201 bp, Homo sapiens
ccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccgaggcggcggggggcgcggccgagtcgccggcggagggcgaggtcttcg

SEQ ID NO: 79323 - DNA, 201 bp, Homo sapiens; identical to SEQ ID NO: 54218

SEQ ID NO: 79324 - DNA, 201 bp, Homo sapiens; identical to SEQ ID NO: 54217

SEQ ID NO: 79325 - DNA, 201 bp, Homo sapiens
cgagtacaacgtgcaggaggccgagagctcaggcgaggccgtgtgtctgaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggg

SEQ ID NO: 79326 - DNA, 201 bp, Homo sapiens; identical to SEQ ID NO: 54222

SEQ ID NO: 79327 - DNA, 201 bp, Homo sapiens; identical to SEQ ID NO: 54219

SEQ ID NO: 79328 - DNA, 201 bp, Homo sapiens; identical to SEQ ID NO: 54220

SEQ ID NO: 79329 - DNA, 201 bp, Homo sapiens; identical to SEQ ID NO: 54221

SEQ ID NO: 79330 - DNA, 201 bp, Homo sapiens
cagacatggtggtgcatgcctgtagtcccagctacttgggaggctgaggcaggaggatcctttgagcctaggaggtcaaagccacttccagctatgatatygtcattgtgctccagcccaggtgacagaaccagaccctgtctctaaaaacaaacaacgaaaaaatccaaaaactttttttgaacacctactatgcatcag

SEQ ID NO: 79331 - DNA, 201 bp, Homo sapiens; identical to SEQ ID NO: 54223

SEQ ID NO: 79332 - DNA, 201 bp, Homo sapiens; identical to SEQ ID NO: 54224

SEQ ID NO: 79333 - DNA, 201 bp, Homo sapiens
gtattcaactccaagggcgtcacccccattttctacccatcccctcaataaagtttttataaaggaactccctgtctccgcttctgtttctgcaaggtggracaagcccagggttccagtcgtgacctcccgagttattcattcaaaaagcgatttttgagagggcctggggtggtggcttaggcctgtaatcccaggact

SEQ ID NO: 79334 - DNA, 201 bp, Homo sapiens; identical to SEQ ID NO: 79237

SEQ ID NO: 79335 - DNA, 201 bp, Homo sapiens
aactccaagggcgtcacccccattttctacccatcccctcaataaagtttttataaaggaactccctgtctccgcttctgtttctgcaaggtggaacaagsccagggttccagtcgtgacctcccgagttattcattcaaaaagcgatttttgagagggcctggggtggtggcttaggcctgtaatcccaggacttgtggg

SEQ ID NO: 79336 - DNA, 201 bp, Homo sapiens; identical to SEQ ID NO: 79239

SEQ ID NO: 79337 - DNA, 201 bp, Homo sapiens
acacgggggcttatttattgctttatttatttacttattcatttatttatgtattcaactccaagggcgtcacccccattttctacccatcccctcaataragtttttataaaggaactccctgtctccgcttctgtttctgcaaggtggaacaagcccagggttccagtcgtgacctcccgagttattcattcaaaaagc

SEQ ID NO: 79338 - DNA, 201 bp, Homo sapiens; identical to SEQ ID NO: 54225

SEQ ID NO: 79339 - DNA, 201 bp, Homo sapiens; identical to SEQ ID NO: 79241

SEQ ID NO: 79340 - DNA, 201 bp, Homo sapiens
acgccccccagactcacacgggggcttatttattgctttatttatttacttattcatttatttatgtattcaactccaagggcgtcacccccattttctasccatcccctcaataaagtttttataaaggaactccctgtctccgcttctgtttctgcaaggtggaacaagcccagggttccagtcgtgacctcccgagtt

SEQ ID NO: 79341 - DNA, 201 bp, Homo sapiens; identical to SEQ ID NO: 54227

SEQ ID NO: 79342 - DNA, 201 bp, Homo sapiens
ttatttattgctttatttatttacttattcatttatttatgtattcaactccaagggcgtcacccccattttctacccatcccctcaataaagtttttatraaggaactccctgtctccgcttctgtttctgcaaggtggaacaagcccagggttccagtcgtgacctcccgagttattcattcaaaaagcgatttttgag

SEQ ID NO: 79343 - DNA, 201 bp, Homo sapiens; identical to SEQ ID NO: 54229

SEQ ID NO: 79344 - DNA, 201 bp, Homo sapiens; identical to SEQ ID NO: 54234

SEQ ID NO: 79345 - DNA, 201 bp, Homo sapiens; identical to SEQ ID NO: 54237

SEQ ID NO: 79346 - DNA, 201 bp, Homo sapiens; identical to SEQ ID NO: 79246

SEQ ID NO: 79347 - DNA, 201 bp, Homo sapiens
gtggcaggcgccatgggaagccacggcggcgagtacgagtgcgcagccaccaacgcgcacgggcgccacgcgcggcgcatcacggtgcgcgtggccggtamgtggcagctggggagaggcggggcgaggtatctgagagggggcgtgacctgggtcttggggcggccggccccgcctgcctccctctcggtcccggtagac

SEQ ID NO: 79348 - DNA, 201 bp, Homo sapiens
cgtggcaggcgccatgggaagccacggcggcgagtacgagtgcgcagccaccaacgcgcacgggcgccacgcgcggcgcatcacggtgcgcgtggccggtmagtggcagctggggagaggcggggcgaggtatctgagagggggcgtgacctgggtcttggggcggccggccccgcctgcctccctctcggtcccggtaga

SEQ ID NO: 79349 - DNA, 201 bp, Homo sapiens; identical to SEQ ID NO: 54250

SEQ ID NO: 79350 - DNA, 201 bp, Homo sapiens
tgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggt

SEQ ID NO: 79351 - DNA, 201 bp, Homo sapiens; identical to SEQ ID NO: 54254

SEQ ID NO: 79352 - DNA, 201 bp, Homo sapiens
tgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcctgggagatcagtaggtggtatgggt

SEQ ID NO: 79353 - DNA, 201 bp, Homo sapiens; identical to SEQ ID NO: 54258

SEQ ID NO: 79354 - DNA, 201 bp, Homo sapiens; identical to SEQ ID NO: 54259

SEQ ID NO: 79355 - DNA, 201 bp, Homo sapiens
aagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgt

SEQ ID NO: 79356 - DNA, 201 bp, Homo sapiens
tgtactccagcctgggtaacagagcgagactcttgtcttgaaaacaaggaaagaaattatcttacagagtctcgaggaagagagatacagcagtgtcttcsaatagtatgggaagcatccctgttttagggcttcagtctgactcttggccattgtttctcactgttgccatttcaaacagggcatttctttactgtccat

SEQ ID NO: 79357 - DNA, 201 bp, Homo sapiens
gccctaggcagccaggacactttcgttttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggattt

SEQ ID NO: 79358 - DNA, 201 bp, Homo sapiens
tgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccggttgtgttctacacccctaaggagttgggtggactcgg

SEQ ID NO: 79359 - DNA, 201 bp, Homo sapiens
acccgggaggcggagcttgcagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcct

SEQ ID NO: 79360 - DNA, 201 bp, Homo sapiens
catggctcacattcttaagaattgtagttctttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtt

SEQ ID NO: 79361 - DNA, 201 bp, Homo sapiens; identical to SEQ ID NO: 54261

SEQ ID NO: 79362 - DNA, 201 bp, Homo sapiens
aggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctgggca

SEQ ID NO: 79363 - DNA, 201 bp, Homo sapiens
gaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgaca

SEQ ID NO: 79364 - DNA, 201 bp, Homo sapiens
agccccagatggttctcttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagttt

SEQ ID NO: 79365 - DNA, 201 bp, Homo sapiens
tgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatt

SEQ ID NO: 79366 - DNA, 201 bp, Homo sapiens
gagtctcgccctgtcactcaggttggagtgcagtggcgcgatctctgctcactgcaagctccgtctcccgggttcacgccattctcctgcttcagctcccragtagctgggactacaggtgcccaccaccacacccggctaatatttttttttgtatttttactacagacgcggtttcaccgtgtttgcgaggatggtctc

SEQ ID NO: 79367 - DNA, 201 bp, Homo sapiens
agggatgctttccctcagctcttctaggagaaatgcgtgaggttggctgatgttactaaacgctcaggtggagggagatgtgttttccgtcttgctaagtrttccccttgagctataagcgaatatgagaattcagcatttgctttaaaacatgtcattggtataatcctgttttctgtgattatccttttggactttacg

SEQ ID NO: 79368 - DNA, 201 bp, Homo sapiens
cttttgtcagtgtgaagtctcggttgaaccagtctcagagggaggagctaggtctgatcgagcaggcctacgataacccccacgaggcgctgtcccgcatmaagcgtcacctcctcacacagagagccttcaaagaggtgagtgaggcctcccaagttttctttttggttctaccaaaggtagcagttgcctttggttcta

SEQ ID NO: 79369 - DNA, 201 bp, Homo sapiens; identical to SEQ ID NO: 54267

SEQ ID NO: 79370 - DNA, 201 bp, Homo sapiens; identical to SEQ ID NO: 54268

SEQ ID NO: 79371 - DNA, 201 bp, Homo sapiens
aagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttt

SEQ ID NO: 79372 - DNA, 201 bp, Homo sapiens
gaaggctgctgtttaggttgggccagggcgggaaaactttggctgactcttcctttcattttaggtaccatactcccaatgttgtattcatcaaaactgargatcctgacttgccagctttctactttgaccctttgatcaacccaatctcccataggcactcagtcaaggtgaggaagggaagggatgctttccctcagc

SEQ ID NO: 79373 - DNA, 201 bp, Homo sapiens
ctgtccaggagctagtactgcattgcatgtacacattgatgacaacagacatcgtacaatgcgcaatcttggcaaatttattcaaaccctttagacttcgstctctcacagtgcgacgccgggagcccatcacacgctgaggtctgtcagaggccccagaaacagcctcggaaatggaggaggcggggcctcaccccgacc

SEQ ID NO: 79374 - DNA, 201 bp, Homo sapiens
tttagacttcggtctctcacagtgcgacgccgggagcccatcacacgctgaggtctgtcagaggccccagaaacagcctcggaaatggaggaggcggggcytcaccccgaccacacccccttgcgttcaaagcctttccgcctatgggcccgcctcctcggcgcagtgtgcaactctaattggtcgtctcactaatccatc

SEQ ID NO: 79375 - DNA, 201 bp, Homo sapiens
ttcccattcacccttcccattgcttttgtcagtgtgaagtctcggttgaaccagtctcagagggaggagctaggtctgatcgagcaggcctacgataaccyccacgaggcgctgtcccgcatcaagcgtcacctcctcacacagagagccttcaaagaggtgagtgaggcctcccaagttttctttttggttctaccaaag

SEQ ID NO: 79376 - DNA, 201 bp, Homo sapiens
ggataaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaa

SEQ ID NO: 79377 - DNA, 201 bp, Homo sapiens; identical to SEQ ID NO: 54279

SEQ ID NO: 79378 - DNA, 201 bp, Homo sapiens
ccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaa

SEQ ID NO: 79379 - DNA, 201 bp, Homo sapiens
agggatgaagactggaatgaattcaatgatattaacaagattatcatccggcagcctatccgcactgagtacaagattgcttttccttacttgtacaacamtcttccacaccatgtccacctcacctggtaagagacctggaacacaacatttggaaaggagaaggctgctgtttaggttgggccagggcgggaaaacttt

SEQ ID NO: 79380 - DNA, 201 bp, Homo sapiens; identical to SEQ ID NO: 54280

SEQ ID NO: 79381 - DNA, 201 bp, Homo sapiens
aaaaaaaaaaagtctgcttattcttgatgttgtaccctagggatgaagactggaatgaattcaatgatattaacaagattatcatccggcagcctatccgsactgagtacaagattgcttttccttacttgtacaacaatcttccacaccatgtccacctcacctggtaagagacctggaacacaacatttggaaaggaga

SEQ ID NO: 79382 - DNA, 201 bp, Homo sapiens; identical to SEQ ID NO: 54281

SEQ ID NO: 79383 - DNA, 201 bp, Homo sapiens
tgttgaactcaaatctttctttagtagtagggataaaactaactgcatcaagtagtctccaccctccccgcccctggctcatctgtaatttactttttttyctactacctttagattgtgaataagtggaatacagctctcattggccttatgacatactttcgggaggctgtggtgaacacccaagagctcttggactta

SEQ ID NO: 79384 - DNA, 201 bp, Homo sapiens
aatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataataaataaataaataatccgt

SEQ ID NO: 79385 - DNA, 201 bp, Homo sapiens
tctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaat

SEQ ID NO: 79386 - DNA, 201 bp, Homo sapiens
tttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgac

SEQ ID NO: 79387 - DNA, 201 bp, Homo sapiens
tcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcc

SEQ ID NO: 79388 - DNA, 201 bp, Homo sapiens; identical to SEQ ID NO: 54284

SEQ ID NO: 79389 - DNA, 201 bp, Homo sapiens
tgattgctctagcccagtctggaagtggaagaggaaaggattcctgaaagaagtagcatgtgatgagacaggtgagggagagcattcctttagccagaagygtggcgatgtaactagcttgtgtacatgggaccatggaaagttcaaggtttgctggagtaaattgtggaattgggaatgttaagagatgaggctggataa

SEQ ID NO: 79390 - DNA, 201 bp, Homo sapiens
gactaatgatgttgaactcaaatctttctttagtagtagggataaaactaactgcatcaagtagtctccaccctccccgcccctggctcatctgtaatttrcttttttttctactacctttagattgtgaataagtggaatacagctctcattggccttatgacatactttcgggaggctgtggtgaacacccaagagctc

SEQ ID NO: 79391 - DNA, 201 bp, Homo sapiens; identical to SEQ ID NO: 54285

SEQ ID NO: 79392 - DNA, 201 bp, Homo sapiens
agtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgc

SEQ ID NO: 79393 - DNA, 201 bp, Homo sapiens
tcatgttggtgctcagaatgttgggactcagaaagtttcagctttttgtgagcattttgggttttagattaacctgtatgtgggaatctgtgagagcactrgagttagtgattgctctagcccagtctggaagtggaagaggaaaggattcctgaaagaagtagcatgtgatgagacaggtgagggagagcattcctttag

SEQ ID NO: 79394 - DNA, 201 bp, Homo sapiens
ctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttc

SEQ ID NO: 79395 - DNA, 201 bp, Homo sapiens
catgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtg

SEQ ID NO: 79396 - DNA, 201 bp, Homo sapiens
ctcgggagtggaaaaaagtagaatttgctgaggggagaacaaaagaggttaactctggagaatcctggggcatggctcacattcttaagaattgtagttckttctttctaggacatgaaccatacgaattcatatgggatcatcagaggcctgcagtttgcctcattcatcgtgcagtattatggcctggtgatggatttg

SEQ ID NO: 79397 - DNA, 201 bp, Homo sapiens
gattgcgccagtgcactctcagcctgggtgactgagcacaactccgcctcgggagtggaaaaaagtagaatttgctgaggggagaacaaaagaggttaacyctggagaatcctggggcatggctcacattcttaagaattgtagttctttctttctaggacatgaaccatacgaattcatatgggatcatcagaggcctgc

SEQ ID NO: 79398 - DNA, 201 bp, Homo sapiens
gtggtggtgggcgcctgtaatcccagctacttgggaggctgaggcaggagaatcacttgaacccgggaagtggaggttgcagtgagctgagattgcgccastgcactctcagcctgggtgactgagcacaactccgcctcgggagtggaaaaaagtagaatttgctgaggggagaacaaaagaggttaactctggagaatc

SEQ ID NO: 79399 - DNA, 201 bp, Homo sapiens
ttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccagtgcactctcagcctgggtgactgagcacaac

SEQ ID NO: 79400 - DNA, 201 bp, Homo sapiens
catctgggtagcatgattggtttactctcttgatgcgtggtagtaaagggaagtagtgttcgtgttaaactgaggaaaagcccatagtcaaagcaatccaratgaatacgtggaatcatagtgggattggttatggaaggtaatgatagttcctgtggggctagtcttgcaagaggatttctaacctgctggagacctgcc

SEQ ID NO: 79401 - DNA, 201 bp, Homo sapiens
gtgagccaccgcgcccggccaaggtcttaattcttgcctgcctttctgctcccctgtgaactctactggttgtcttttttcctgctttatccctcgtcctyggtagacagtgatggttaaatgaatgaatgcatgaacaaatgactgtccaggagctagtactgcattgcatgtacacattgatgacaacagacatcgtac

SEQ ID NO: 79402 - DNA, 201 bp, Homo sapiens
attagctgggcgtggtggcgggtgcctgtagtcccagctactccggaggctgaggctggagaagggcgtgaacctgggaggcggagcttgcagtgagccgrgattgcgccgctgcgctccagcctggggaaagagcgagactgtctcaaaaaataaataaataaaaataaaatggaatgaagcccggggagggtgggggta

SEQ ID NO: 79403 - DNA, 201 bp, Homo sapiens
gaagttttgtttatttcaaaaaatacttagagaactgtgctggctgctggggatatagtagcgagcagagggtaacaatctccgcctttctgcagtgtgcrgtctagtggcctgacagacatgagacaactggtgatagtgaagtatggtgaatactttattatgatttatgggaagatgcggagggaataggatgtgaga

SEQ ID NO: 79404 - DNA, 201 bp, Homo sapiens; identical to SEQ ID NO: 54302

SEQ ID NO: 79405 - DNA, 201 bp, Homo sapiens
tcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaa

SEQ ID NO: 79406 - DNA, 201 bp, Homo sapiens; identical to SEQ ID NO: 54315

SEQ ID NO: 79407 - DNA, 201 bp, Homo sapiens; identical to SEQ ID NO: 54317

SEQ ID NO: 79408 - DNA, 201 bp, Homo sapiens; identical to SEQ ID NO: 54319

SEQ ID NO: 79409 - DNA, 201 bp, Homo sapiens; identical to SEQ ID NO: 54321

SEQ ID NO: 79410 - DNA, 201 bp, Homo sapiens
cttgtttacaagtggtgtcaaggtagaactttcatgagatcgccctgtgaggaacggggcaggaatttagttctacgtcaaaaatctcatctgggtagcaygattggtttactctcttgatgcgtggtagtaaagggaagtagtgttcgtgttaaactgaggaaaagcccatagtcaaagcaatccaaatgaatacgtgga

SEQ ID NO: 79411 - DNA, 201 bp, Homo sapiens
agataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacgtcaaaaatctcatctgggta

SEQ ID NO: 79412 - DNA, 201 bp, Homo sapiens
cattgctaacttgtattcttaacttctgcttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctc

SEQ ID NO: 79413 - DNA, 201 bp, Homo sapiens
ctctttttttcttttttgagacggagtcttgctcttttgcccaggctggagtgcagtgactatctcagctcactacaacctctacctcctgggttcaagcrattctccttccttagcctctcaagtagctcgaagcacaggtgcgtgccaccatgcccggctaatttttttgtatttttagtagagacagggtttcaccgt

SEQ ID NO: 79414 - DNA, 201 bp, Homo sapiens
tgagcctgggaggtggaggctgcaatgagtggagatggtgccattgcactctagcctgggcaacagagcaagaccctgtcttgcttgagagaaagatccarctacagctgtgagtttattgtctttcaggtccatcatttttgaaattctgttattagttacataatgtatttaggattattaggtcttctgaacgagttg

SEQ ID NO: 79415 - DNA, 201 bp, Homo sapiens; identical to SEQ ID NO: 54329

SEQ ID NO: 79416 - DNA, 201 bp, Homo sapiens
ttccagcttgggtgataagagtgagaccctgtctcaaaaaaaaaaaagtctgcttattcttgatgttgtaccctagggatgaagactggaatgaattcaaygatattaacaagattatcatccggcagcctatccgcactgagtacaagattgcttttccttacttgtacaacaatcttccacaccatgtccacctcacct

SEQ ID NO: 79417 - DNA, 201 bp, Homo sapiens; identical to SEQ ID NO: 54332

SEQ ID NO: 79418 - DNA, 201 bp, Homo sapiens
acacccaagagctcttggacttactggtgaagtgtgagaacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaac

SEQ ID NO: 79419 - DNA, 201 bp, Homo sapiens
gtccgtgtgggcgggacagaagcgtttggggcaggtgagcaggtttaaagatgaagaggctgtagaaccatgttgcctcttattcttggggtggacttggyaatatttactggtttattagatgaaaggctgagaacatctcatttgaacttatccccaaaataccttgggaagtattctgtgggaggtccaagagtgtat

SEQ ID NO: 79420 - DNA, 201 bp, Homo sapiens
tagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttagtttttcatcaagtcattttaagcgcg

SEQ ID NO: 79421 - DNA, 201 bp, Homo sapiens
aatgttgggactcagaaagtttcagctttttgtgagcattttgggttttagattaacctgtatgtgggaatctgtgagagcactagagttagtgattgctstagcccagtctggaagtggaagaggaaaggattcctgaaagaagtagcatgtgatgagacaggtgagggagagcattcctttagccagaagtgtggcgat

SEQ ID NO: 79422 - DNA, 201 bp, Homo sapiens
gcagctgttcctcaagataatccacacgtccgtgtgggcgggacagaagcgtttggggcaggtgagcaggtttaaagatgaagaggctgtagaaccatgtkgcctcttattcttggggtggacttggtaatatttactggtttattagatgaaaggctgagaacatctcatttgaacttatccccaaaataccttgggaag

SEQ ID NO: 79423 - DNA, 201 bp, Homo sapiens
ggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagt

SEQ ID NO: 79424 - DNA, 201 bp, Homo sapiens
tctcagtttccaggacatagccactgaggctgcccaccccatccgtctcttctgcagatacattgatcgcatccatatttttttcaggtgagggctttccyggattcctagccttgcagggtactgaggcatgtgctttgcctctgaaatcagctattgtacctgagttgacttaactgctgttggggctttaaaatggaa

SEQ ID NO: 79425 - DNA, 201 bp, Homo sapiens
tttggtagagaaggggtttcaccgtgttagccaggatggtctcgaactcctgaccttgtgatccgcctgcctcagcctcccaaagtactgggattacaggygtgagccaccacacccggcctgatttttaaattttttgtagagctgggatctcactctcttgtccaggctggtctcagactctggattcaagcagtcctc

SEQ ID NO: 79426 - DNA, 201 bp, Homo sapiens; identical to SEQ ID NO: 54337

SEQ ID NO: 79427 - DNA, 201 bp, Homo sapiens
ctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctacgcttggagcctgtcaacacccttag

SEQ ID NO: 79428 - DNA, 201 bp, Homo sapiens
ggctggagtgcagtgactatctcagctcactacaacctctacctcctgggttcaagcaattctccttccttagcctctcaagtagctcgaagcacaggtgygtgccaccatgcccggctaatttttttgtatttttagtagagacagggtttcaccgtgttagccaggatggtctcgatctcctgaccttgtgatccgcca

SEQ ID NO: 79429 - DNA, 201 bp, Homo sapiens
gcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcag

SEQ ID NO: 79430 - DNA, 201 bp, Homo sapiens
cctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctctttttcatgcgtggcattacccctttat

SEQ ID NO: 79431 - DNA, 201 bp, Homo sapiens
cttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatg

SEQ ID NO: 79432 - DNA, 201 bp, Homo sapiens
caccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagt

SEQ ID NO: 79433 - DNA, 201 bp, Homo sapiens
ctgagcgatgctgacactccctgcctgtttttagggccatctctgctgccaacctgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggcc

SEQ ID NO: 79434 - DNA, 201 bp, Homo sapiens
aagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaaggagactggctacacctacatccttcccaagaatgtgcttaagaagttcatctg

SEQ ID NO: 79435 - DNA, 201 bp, Homo sapiens; identical to SEQ ID NO: 54257

SEQ ID NO: 79436 - DNA, 201 bp, Homo sapiens
agtctctcttggtgcctgtcctatgtgtgctggaaaatatctgttaatctgtattctgctattgttaggttgagtgttttacaaacattaggtccagtcarttggttacattgcttaagtcttctatatccttagtgatattttttgtatacttctatcgattactgaggagtattagaaatctctagtaatcccagcagt

SEQ ID NO: 79437 - DNA, 201 bp, Homo sapiens
ggagtgcagtggcgcgatctctgctcactgcaagctccgtctcccgggttcacgccattctcctgcttcagctcccaagtagctgggactacaggtgcccrccaccacacccggctaatatttttttttgtatttttactacagacgcggtttcaccgtgtttgcgaggatggtctcgatctcctgaccaccacctgatca

SEQ ID NO: 79438 - DNA, 201 bp, Homo sapiens; identical to SEQ ID NO: 54264

SEQ ID NO: 79439 - DNA, 201 bp, Homo sapiens
cccgatcttggcttactgcaacctctgcctaccgggttcacaccattctcctgcctcagcctcccgagtagctgggactacaggcgcccgccaccatgccyggctaatttttttgtatttttagtagagatggggtttcaccgtgttagccaggatggtctcgatctcctgacctcgtgatccaccctcctcagcctccca

SEQ ID NO: 79440 - DNA, 201 bp, Homo sapiens
gagcccatcacacgctgaggtctgtcagaggccccagaaacagcctcggaaatggaggaggcggggcctcaccccgaccacacccccttgcgttcaaagcytttccgcctatgggcccgcctcctcggcgcagtgtgcaactctaattggtcgtctcactaatccatctgagcacctcggcgccgactggatcaactgctg

SEQ ID NO: 79441 - DNA, 201 bp, Homo sapiens
actttctagcacagccagattgatatggtgcctattttcagagcatgccatgttagtttctatatctaaaccttttttggcctggcacggtggctcacgcytgaaatcccagcaatttgggaggctgaggtaggcagattacttgagctcagtagttcgagaccagcctgacaaacatggagaaacgccatctctacgaaa

SEQ ID NO: 79442 - DNA, 201 bp, Homo sapiens
ttgatatggtgcctattttcagagcatgccatgttagtttctatatctaaaccttttttggcctggcacggtggctcacgcttgaaatcccagcaatttgsgaggctgaggtaggcagattacttgagctcagtagttcgagaccagcctgacaaacatggagaaacgccatctctacgaaaaatacaaaattagccgggt

SEQ ID NO: 79443 - DNA, 201 bp, Homo sapiens
gatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttca

SEQ ID NO: 79444 - DNA, 201 bp, Homo sapiens
ggagtgcagtggcccgatcttggcttactgcaacctctgcctaccgggttcacaccattctcctgcctcagcctcccgagtagctgggactacaggcgccygccaccatgcccggctaatttttttgtatttttagtagagatggggtttcaccgtgttagccaggatggtctcgatctcctgacctcgtgatccaccctc

SEQ ID NO: 79445 - DNA, 201 bp, Homo sapiens
ctctactaaaaatacaaaaattagccaggcgcggtggcgggtgcctgtaatctcagctactcgggaggctgaggcaggagaattgcttgaacccgggaggyagaggttgcagtgagccaagatcgtgccactgcaccccagcctcggcgacagagcaagactccgtctcgaagaaaagaaaagtaggtaattgatgagcag

SEQ ID NO: 79446 - DNA, 201 bp, Homo sapiens
ttcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcg

SEQ ID NO: 79447 - DNA, 201 bp, Homo sapiens
tctactaaaaatacaaaaattagccaggcgcggtggcgggtgcctgtaatctcagctactcgggaggctgaggcaggagaattgcttgaacccgggaggtrgaggttgcagtgagccaagatcgtgccactgcaccccagcctcggcgacagagcaagactccgtctcgaagaaaagaaaagtaggtaattgatgagcaga

SEQ ID NO: 79448 - DNA, 201 bp, Homo sapiens; identical to SEQ ID NO: 54266

SEQ ID NO: 79449 - DNA, 201 bp, Homo sapiens
gtagagtggtaaggcattgaatgcaagggaatcaagagtgcgggacccagccggccgcggtggctcatacctgtaatcccagcactttgggaggccgaggygggtggatcacgagttcaggagattgagaccatcctggctaacgcggtgaaaccccgtctctactaaaaatacaaaaaattagctggatgtcgtggcggg

SEQ ID NO: 79450 - DNA, 201 bp, Homo sapiens
tttgggaggccgaggcgggtggatcacgagttcaggagattgagaccatcctggctaacgcggtgaaaccccgtctctactaaaaatacaaaaaattagcyggatgtcgtggcgggcgcctgtggtcccagctactcaggggggctgatgcaggagaatggcaggaacctgggaggcagagcttgcagtgaaccgagatcg

SEQ ID NO: 79451 - DNA, 201 bp, Homo sapiens
gagaaaagatgcataactttactagtgtatcagggatattatagtttataaaacatcattttgggccaaggtgggtgaatcacttgaggtcaggagttcargaccagcttggccaacgtggcgaaaccccgtctctcttaaatatatgaaaattagcggggcatggtggcatgtgcctgtagtcccagctactcaggaagc

SEQ ID NO: 79452 - DNA, 201 bp, Homo sapiens
cattgcatgtacacattgatgacaacagacatcgtacaatgcgcaatcttggcaaatttattcaaaccctttagacttcggtctctcacagtgcgacgccrggagcccatcacacgctgaggtctgtcagaggccccagaaacagcctcggaaatggaggaggcggggcctcaccccgaccacacccccttgcgttcaaag

SEQ ID NO: 79453 - DNA, 201 bp, Homo sapiens; identical to SEQ ID NO: 54270

SEQ ID NO: 79454 - DNA, 201 bp, Homo sapiens; identical to SEQ ID NO: 54272

SEQ ID NO: 79455 - DNA, 201 bp, Homo sapiens; identical to SEQ ID NO: 54277

SEQ ID NO: 79456 - DNA, 201 bp, Homo sapiens
cccttcccattgcttttgtcagtgtgaagtctcggttgaaccagtctcagagggaggagctaggtctgatcgagcaggcctacgataacccccacgaggcrctgtcccgcatcaagcgtcacctcctcacacagagagccttcaaagaggtgagtgaggcctcccaagttttctttttggttctaccaaaggtagcagttg

SEQ ID NO: 79457 - DNA, 201 bp, Homo sapiens
gcagacacagaaccacctccgctgcttgtttacaagtggtgtcaaggtagaactttcatgagatcgccctgtgaggaacggggcaggaatttagttctacrtcaaaaatctcatctgggtagcatgattggtttactctcttgatgcgtggtagtaaagggaagtagtgttcgtgttaaactgaggaaaagcccatagtca

SEQ ID NO: 79458 - DNA, 201 bp, Homo sapiens
ctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttcctt

SEQ ID NO: 79459 - DNA, 201 bp, Homo sapiens
aaggagcccagtagcagttgagtgtacaagagaaaagtgtggaattggctggacacagtggctcacgcccgtaatcccagcactttgggaggccaaggtgkgtgaatcaccaagtcaggagttcgagaccagcctggccaacatggtgaaaccccgtctctactaaaaatacaaaaattagccaggcgcggtggcgggtgc

SEQ ID NO: 79460 - DNA, 201 bp, Homo sapiens
tgacatcctttgaatttttttctaattatttcactttgatttgtaaattctcaactagattcaggggctgtatgggttacaattcctctgcaccctccacrgaatttcagacttttttttttcccccgagacagagtctcgctctgtcacccaggctggagtgcagtggcgcgatcttggctcactgcaacctccccctcc

SEQ ID NO: 79461 - DNA, 201 bp, Homo sapiens; identical to SEQ ID NO: 54282

SEQ ID NO: 79462 - DNA, 201 bp, Homo sapiens
ttctacgtcaaaaatctcatctgggtagcatgattggtttactctcttgatgcgtggtagtaaagggaagtagtgttcgtgttaaactgaggaaaagcccrtagtcaaagcaatccaaatgaatacgtggaatcatagtgggattggttatggaaggtaatgatagttcctgtggggctagtcttgcaagaggatttctaa

SEQ ID NO: 79463 - DNA, 201 bp, Homo sapiens
ctacgtcaaaaatctcatctgggtagcatgattggtttactctcttgatgcgtggtagtaaagggaagtagtgttcgtgttaaactgaggaaaagcccatrgtcaaagcaatccaaatgaatacgtggaatcatagtgggattggttatggaaggtaatgatagttcctgtggggctagtcttgcaagaggatttctaacc

SEQ ID NO: 79464 - DNA, 201 bp, Homo sapiens
atctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcac

SEQ ID NO: 79465 - DNA, 201 bp, Homo sapiens
tctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacg

SEQ ID NO: 79466 - DNA, 201 bp, Homo sapiens
gttgcagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtg

SEQ ID NO: 79467 - DNA, 201 bp, Homo sapiens
tttttttttttttttgaggcagagtttcgctcttgttgcccaggctggagtgcaatggcgcgatctcagctcactgcaacctctgcctccagatgcaagcrattcttacatctcagcctcccaagtagctgggattacaggcatgcaccaccatgccccgccaatttttgtatttttagtagagacagagtttcaccatgt

SEQ ID NO: 79468 - DNA, 201 bp, Homo sapiens
agtgtggcgatgtaactagcttgtgtacatgggaccatggaaagttcaaggtttgctggagtaaattgtggaattgggaatgttaagagatgaggctggayaaatagtggagagccatatcatggagggcatcgcacaccttaggaagaatcatataagggtcttaagcacagagtgactttgtcagatgtgtttttcttc

SEQ ID NO: 79469 - DNA, 201 bp, Homo sapiens; identical to SEQ ID NO: 54294

SEQ ID NO: 79470 - DNA, 201 bp, Homo sapiens
cagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtg

SEQ ID NO: 79471 - DNA, 201 bp, Homo sapiens
tcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagcgggtttagggttagga

SEQ ID NO: 79472 - DNA, 201 bp, Homo sapiens; identical to SEQ ID NO: 54305

SEQ ID NO: 79473 - DNA, 201 bp, Homo sapiens; identical to SEQ ID NO: 54308

SEQ ID NO: 79474 - DNA, 201 bp, Homo sapiens; identical to SEQ ID NO: 54309

SEQ ID NO: 79475 - DNA, 201 bp, Homo sapiens; identical to SEQ ID NO: 54311

SEQ ID NO: 79476 - DNA, 201 bp, Homo sapiens
tccttcctctccatttacctttatgaaatcctcacatccatccatctccatcaaatctttaacaattctcctctgtcttttttgactgtagggacctttasaacacccagcattaaaaaatagatttcaggccgggcatgggggctcacgcctgtaatcccagcactttgggagggccgaggcaggaggatttcgtaaggt

SEQ ID NO: 79477 - DNA, 201 bp, Homo sapiens
gaggcaggagaatcacttgaacccgggaagtggaggttgcagtgagctgagattgcgccagtgcactctcagcctgggtgactgagcacaactccgcctcrggagtggaaaaaagtagaatttgctgaggggagaacaaaagaggttaactctggagaatcctggggcatggctcacattcttaagaattgtagttctttc

SEQ ID NO: 79478 - DNA, 201 bp, Homo sapiens; identical to SEQ ID NO: 54320

SEQ ID NO: 79479 - DNA, 201 bp, Homo sapiens
acaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagcc

SEQ ID NO: 79480 - DNA, 201 bp, Homo sapiens
ccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctac

SEQ ID NO: 79481 - DNA, 201 bp, Homo sapiens
cgggccggaggcggggcgggtgtgcgcgcgcgcaggcgggtggggaccctccccgtttgggcagctcctgaggtgtcagctcccttgttatttccagttartttttcatcaagtcattttaagcgcgtattatttgcaagcgctgatccagcgggggtacagtagtgacggagacaaaattcctgtccttacggggtttaa

SEQ ID NO: 79482 - DNA, 201 bp, Homo sapiens
cccaccccatccgtctcttctgcagatacattgatcgcatccatatttttttcaggtgagggctttcctggattcctagccttgcagggtactgaggcatrtgctttgcctctgaaatcagctattgtacctgagttgacttaactgctgttggggctttaaaatggaatgaagcggccgggtgcggtagctcacgcctgt

SEQ ID NO: 79483 - DNA, 201 bp, Homo sapiens; identical to SEQ ID NO: 54333

SEQ ID NO: 79484 - DNA, 201 bp, Homo sapiens
ggtgtggtggtacacgcctgtagtcccaggtgcttgggaggctgaggcgggagagtctcctgagcctgggaggtggaggctgcaatgagtggagatggtgycattgcactctagcctgggcaacagagcaagaccctgtcttgcttgagagaaagatccaactacagctgtgagtttattgtctttcaggtccatcatttt

SEQ ID NO: 79485 - DNA, 201 bp, Homo sapiens
ggactggttctatgaccaccagccgttgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctg

SEQ ID NO: 79486 - DNA, 201 bp, Homo sapiens
acctcacctggtaagagacctggaacacaacatttggaaaggagaaggctgctgtttaggttgggccagggcgggaaaactttggctgactcttcctttcrttttaggtaccatactcccaatgttgtattcatcaaaactgaggatcctgacttgccagctttctactttgaccctttgatcaacccaatctcccatagg

SEQ ID NO: 79487 - DNA, 201 bp, Homo sapiens
ttacttgtacaacaatcttccacaccatgtccacctcacctggtaagagacctggaacacaacatttggaaaggagaaggctgctgtttaggttgggccarggcgggaaaactttggctgactcttcctttcattttaggtaccatactcccaatgttgtattcatcaaaactgaggatcctgacttgccagctttctact

SEQ ID NO: 79488 - DNA, 201 bp, Homo sapiens
gctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttg

SEQ ID NO: 79489 - DNA, 201 bp, Homo sapiens
gcaggcttgagattaaaaaggtagaaggaaaatgcctagctagcaagctctctgcttttccggaacattctctagctctgttgaaaagtttgagacactckttttacccaaaggtgactgcagcaacctacatgttagcctcacctgaccctgcaccaagggagccaggctctgggcttccatttgcccttctggttgggt

SEQ ID NO: 79490 - DNA, 201 bp, Homo sapiens
gagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcggga

SEQ ID NO: 79491 - DNA, 201 bp, Homo sapiens
aggcgctctcccgccagtgtctggattctgcctcttgccaaagcagagggggctgccatcccctgcctgccacctgcccctcggctgcatgcccacagccrtacctgcctgaggacaaaggcttgcactgtctcgcccgcgcctggcccccaccccctccccggccagcctgaggctgcctgaggaaggaaggacccgctt

SEQ ID NO: 79492 - DNA, 201 bp, Homo sapiens
atcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagt

SEQ ID NO: 79493 - DNA, 201 bp, Homo sapiens
cacctgggcatcgaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctccca

SEQ ID NO: 79494 - DNA, 201 bp, Homo sapiens
tcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagc

SEQ ID NO: 79495 - DNA, 201 bp, Homo sapiens
caccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagct

SEQ ID NO: 79496 - DNA, 201 bp, Homo sapiens
agggccccgtaggggcttctcctacctctgaccctcacactaagtaaaagcccctttcctcggtggtgtgtgtgggaatgctgttggcgaggagagggggwcacggtgtgggctggccacctgggcatcgaagtggtgggagctgggactctggggccagccatcctatggacttgcagagattctcatgcccctggactg

SEQ ID NO: 79497 - DNA, 201 bp, Homo sapiens
accaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctt

SEQ ID NO: 79498 - DNA, 201 bp, Homo sapiens
ccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagctta

SEQ ID NO: 79499 - DNA, 201 bp, Homo sapiens
aatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgc

SEQ ID NO: 79500 - DNA, 201 bp, Homo sapiens
cttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcacc

SEQ ID NO: 79501 - DNA, 201 bp, Homo sapiens
aggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacc

SEQ ID NO: 79502 - DNA, 201 bp, Homo sapiens
ggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacct

SEQ ID NO: 79503 - DNA, 201 bp, Homo sapiens; identical to SEQ ID NO: 10342

SEQ ID NO: 79504 - DNA, 201 bp, Homo sapiens
ctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctgggctcaagggatcctccc

SEQ ID NO: 79505 - DNA, 201 bp, Homo sapiens
ccccaggtgcgcgccaccacacccagctaatttttaaattctttgcagagatagggtcttgctgtgttgcccaggttggtgtcgaactcctgggctcaagrgatcctcccctcttggcctcccaaagtgctgggattacaggcgtaaacctccacacccagcctgataaacattcagccctggagtggcggaaaccccaaa

SEQ ID NO: 79506 - DNA, 201 bp, Homo sapiens
gagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagtt

SEQ ID NO: 79507 - DNA, 201 bp, Homo sapiens
gggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagc

SEQ ID NO: 79508 - DNA, 201 bp, Homo sapiens
ggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcg

SEQ ID NO: 79509 - DNA, 201 bp, Homo sapiens
gagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcga

SEQ ID NO: 79510 - DNA, 201 bp, Homo sapiens
agtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgat

SEQ ID NO: 79511 - DNA, 201 bp, Homo sapiens
actcctgacctcatatgatccacccacctcagcctcccaaagtgctgggactacaggtgtgagccaccattctcggcttataatttaattattattattattattattttttttttgagacagagtctcactttgtcaccaggctggagtgcaatgccgtgatctcagctcactgcaacctccacctcttggttcaagcga

SEQ ID NO: 79512 - DNA, 201 bp, Homo sapiens
tcctgacctcatatgatccacccacctcagcctcccaaagtgctgggactacaggtgtgagccaccattctcggcttataatttaattattattattattwttattttttttttgagacagagtctcactttgtcaccaggctggagtgcaatgccgtgatctcagctcactgcaacctccacctcttggttcaagcgatt

SEQ ID NO: 79513 - DNA, 201 bp, Homo sapiens
cctcaagttcctggtcagcggcgaccagaagacaggtaggtgccccgggcagcctcggtcgctgtcactccccggcctgagcccagcccactggccaccgsccggaatgtgttaagctgagccgggccagcggggccatggaaaggccgcatcccaggagctgtctgcccgtcagagctattgcatcactgccagccccaa

SEQ ID NO: 79514 - DNA, 201 bp, Homo sapiens
catctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctccca

SEQ ID NO: 79515 - DNA, 201 bp, Homo sapiens
atctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttactgcaccctggacctcccag

SEQ ID NO: 79516 - DNA, 201 bp, Homo sapiens
aagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctca

SEQ ID NO: 79517 - DNA, 201 bp, Homo sapiens
actgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccatt

SEQ ID NO: 79518 - DNA, 201 bp, Homo sapiens
ggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaa

SEQ ID NO: 79519 - DNA, 201 bp, Homo sapiens
ggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcct

SEQ ID NO: 79520 - DNA, 201 bp, Homo sapiens
gtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctc

SEQ ID NO: 79521 - DNA, 201 bp, Homo sapiens
gatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaa

SEQ ID NO: 79522 - DNA, 201 bp, Homo sapiens
gtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcct

SEQ ID NO: 79523 - DNA, 201 bp, Homo sapiens
ggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgta

SEQ ID NO: 79524 - DNA, 201 bp, Homo sapiens
ttgataacaatctaggagttaaatagatactatcatctgtttacgtcatcatttatgatagatactatcatcatatacacctgaaaaacgaggcctggagygatggaggagcttgttcaaggtcagagccagcactcacatatgggtcttaagacactggagcagccaagggcctctagaccaggacattccactcggagc

SEQ ID NO: 79525 - DNA, 201 bp, Homo sapiens
ggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccacc

SEQ ID NO: 79526 - DNA, 201 bp, Homo sapiens
agtgccagccggatgctgcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcctgggggagggaaagggatttgcctgatttcacccaagaggtgacccc

SEQ ID NO: 79527 - DNA, 201 bp, Homo sapiens
tccagccacttggggacaaggctccctctggaggggacccgagggccagaatgccagcccccacccaccacccagctccccagcccccacccacctcccarctccgcagcccccacccaccacccagctccccagcctcctgcaggccagggaggactcgggagtccgtggatgtggaaagtcagggccgggggtgccacg

SEQ ID NO: 79528 - DNA, 201 bp, Homo sapiens
cctgacctcatatgatccacccacctcagcctcccaaagtgctgggactacaggtgtgagccaccattctcggcttataatttaattattattattattawtattttttttttgagacagagtctcactttgtcaccaggctggagtgcaatgccgtgatctcagctcactgcaacctccacctcttggttcaagcgattc

SEQ ID NO: 79529 - DNA, 201 bp, Homo sapiens
tcagcaggggcccgggctgggcattgtcccaagtccacttccagaggcctggctgcagctctgcctcccctgagcgccccgagtcacgcttggtgggaaaygcagtgcgggaaacgcagtgcgggaaacgcagtgtgggaaatgcagtgcgtgctgggcatggagtgagcctgcctcctctcccatctctctgtagcactg

SEQ ID NO: 79530 - DNA, 201 bp, Homo sapiens
tgacctcatatgatccacccacctcagcctcccaaagtgctgggactacaggtgtgagccaccattctcggcttataatttaattattattattattattwttttttttttgagacagagtctcactttgtcaccaggctggagtgcaatgccgtgatctcagctcactgcaacctccacctcttggttcaagcgattctc

SEQ ID NO: 79531 - DNA, 201 bp, Homo sapiens
cttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactcca

SEQ ID NO: 79532 - DNA, 201 bp, Homo sapiens
caggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgc

SEQ ID NO: 79533 - DNA, 201 bp, Homo sapiens
tgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaa

SEQ ID NO: 79534 - DNA, 201 bp, Homo sapiens
cttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggc

SEQ ID NO: 79535 - DNA, 201 bp, Homo sapiens
agcactttggaaggccgaggcgggcagatcacgagctcaggagatcaagacaatcctggctaacacggtgaaaccccgtctctactaaaaatacaaaaaaktagccgggcgtggtgacgggtgcctgtactcccagctactcgggaggctgaggcaggagaatggcgtgaacccgggaggcggagcttgcagtgagcggag

SEQ ID NO: 79536 - DNA, 201 bp, Homo sapiens
gggcagatcacgagctcaggagatcaagacaatcctggctaacacggtgaaaccccgtctctactaaaaatacaaaaaagtagccgggcgtggtgacgggygcctgtactcccagctactcgggaggctgaggcaggagaatggcgtgaacccgggaggcggagcttgcagtgagcggagattataccactgcgctccagc

SEQ ID NO: 79537 - DNA, 201 bp, Homo sapiens
ggcagatcacgagctcaggagatcaagacaatcctggctaacacggtgaaaccccgtctctactaaaaatacaaaaaagtagccgggcgtggtgacgggtrcctgtactcccagctactcgggaggctgaggcaggagaatggcgtgaacccgggaggcggagcttgcagtgagcggagattataccactgcgctccagcc

SEQ ID NO: 79538 - DNA, 201 bp, Homo sapiens
tgaggcaggagaatggcgtgaacccgggaggcggagcttgcagtgagcggagattataccactgcgctccagcctgggcaacagagcgagactccgtctcaaaaaaaaaaaaagaaaagaaagaaaaaaacattctttgaaggctggcgcatgctctgccttggtccccactctacccccagtgcctagaatcgtgcctgg

SEQ ID NO: 79539 - DNA, 201 bp, Homo sapiens
ttacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcagatgatgactttcattcattccactcaaccgagc

SEQ ID NO: 79540 - DNA, 201 bp, Homo sapiens
gtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcag

SEQ ID NO: 79541 - DNA, 201 bp, Homo sapiens
agaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccac

SEQ ID NO: 79542 - DNA, 201 bp, Homo sapiens
tccctggggtaactggaggtccctggtgcctttactcaggcagtgctgcctcacccactccattccttgtccccgtggctcctgcttgcagcagtagaacstgcagccccccaagccctcagttattccacggcccctgtgcagtcactggccccacaagtcacccatcctgggccctggcgtgctctctccatccatcct

SEQ ID NO: 79543 - DNA, 201 bp, Homo sapiens
tcagggccgggggtgccacggttgccccttgtttctgcctgccagcaatgccatggcctgccctgggccaaaaggcacgtacgtccggcatcttagagaarctcccgcgcccgcactgtcccagggccttggccctgcaggcactcctgtccggtggtcatgctctatggccagaatgccaggggaggggccgcctgcagc

SEQ ID NO: 79544 - DNA, 201 bp, Homo sapiens; identical to SEQ ID NO: 54296

SEQ ID NO: 79545 - DNA, 201 bp, Homo sapiens
cccccacactctaggaggtggatcttatcattatatgatgtccatgttatggacaaggaaactgagctagagcaaggtcatgcaggtagaaagtggagaawcaaacactggaagctagaaaccagattccagttccacgctcttcatccacacggccccggcggggctccttggccacacgttggcatgaagcacgagtcc

SEQ ID NO: 79546 - DNA, 201 bp, Homo sapiens
tgcctggccgggcgcggtggctcacacctgtaatcccagcactttgggaggccaaggcgggtggatcacaaggtcagaagatcgagaccatcctggccaayacggtgaaaccctgtctctacaaaaacgcaaaaattagccgggtaaggtggcgcgtgcctgtagtcccagctactcgggaggctgaggcaggagaatcgc

SEQ ID NO: 79547 - DNA, 201 bp, Homo sapiens
tttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctac

SEQ ID NO: 79548 - DNA, 201 bp, Homo sapiens; identical to SEQ ID NO: 10344

SEQ ID NO: 79549 - DNA, 201 bp, Homo sapiens; identical to SEQ ID NO: 54307

SEQ ID NO: 79550 - DNA, 201 bp, Homo sapiens
agtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctc

SEQ ID NO: 79551 - DNA, 201 bp, Homo sapiens
gtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccg

SEQ ID NO: 79552 - DNA, 201 bp, Homo sapiens
aggcgcccgccaccacgcccggctaattttttgtatttttagtagagacggggtttcactgtgttagccaggatggtctcgatctcctgaccttgtgatcygcccgcctcggcctcccaaagtgctgggattacaggcgtgagccatcgtgcctggcccctatgccattcttttttttttttttttccttttgagttggag

SEQ ID NO: 79553 - DNA, 201 bp, Homo sapiens
tgccatgtgccagctcaggcacacgctgctacttctctccccgtcgtcttagctcagccttcacagagcactgcagcatatggatggccatcttcttgtasccgagaccccctccgagagtcacactcagcttgccactgagaagggccggggagtgtccgtagtgctggtccagccccgacacagtccctaaaacgtgcc

SEQ ID NO: 79554 - DNA, 201 bp, Homo sapiens
tggccaggctagtctcgaactcctgacctcaggcgatccacccgccttggcctcccaaagtgctgggattttacaggtgtgaggcaccgtgcccagctcasatgatgactttcattcattccactcaaccgagcagcccaccagccctttgttatttgcggagggcctgttccctgccaggctctgtgcttgctgctgcag

SEQ ID NO: 79555 - DNA, 201 bp, Homo sapiens
acaggtaggtgccccgggcagcctcggtcgctgtcactccccggcctgagcccagcccactggccaccggccggaatgtgttaagctgagccgggccagcsgggccatggaaaggccgcatcccaggagctgtctgcccgtcagagctattgcatcactgccagccccaactgtttcttcgtgtccccatcagggtttcct

SEQ ID NO: 79556 - DNA, 201 bp, Homo sapiens
gtgtttacttcttcctctcctttcctctctccccccttagagatcgtgacccttcctgcttgcctccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttg

SEQ ID NO: 79557 - DNA, 201 bp, Homo sapiens
tttccccatgccctgactcaccccaatccctgggtgaggacagagctcctgaaggccactgaaggaggtgcagcacactccacctgggtggccttccgcarctcagccctcttcctgccagcaggaagcctctgcctgtgctccttaagttagccatcctcaccccctccgggcagctctgagactgagccagggccacta

SEQ ID NO: 79558 - DNA, 201 bp, Homo sapiens
gggacttgggccaaatggccatccaagcctgctgcggggtagcctgagccctcgagaggccgccagccagccctggcattcccagtggggggactctgaaygggcacctgcccttctgatctttgggaatccctgtcatgaccctgaggtcagggtttccttccctcttcacacagagaatgtcaccaatggcacagtggg

SEQ ID NO: 79559 - DNA, 201 bp, Homo sapiens
tccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgcctgg

SEQ ID NO: 79560 - DNA, 201 bp, Homo sapiens
tggaagggagaccagctctggccatctggaggagacccatggtgtcagatgccttggctgggcgtcaggggcaggttctttgacctttccctctctctgarcacagcaggaggtagatgtgacagagccgcttcccgcaggcagtgtggtgacagggaccctgattgcaccaggtcttccgcatgcccgccacttccccat

SEQ ID NO: 79561 - DNA, 201 bp, Homo sapiens
tagatggatcgcttgaggtcaggagttcaagaccagcctggcagcatggtgaaaccctatctctactaacaatacaaaaattagccgggcatggtggtgcrcacctgtggtcccagccacacaggacgctgaggcaggagactcgcttgaacttgggaggtggaggttgcagagagccaagattgcatgtcagtgcattcc

SEQ ID NO: 79562 - DNA, 201 bp, Homo sapiens
gtggcccctctccaccacccccacccgggcaggatgcacctgggcatcacaggggcgacaaatgaaaaccgcggggcctcaggggacgggaatcacgcatktggctgcaggatctgccgcaggtgcctttgcatttcggggctggggcaggggaagggcggtgggtgagtctgtttccagttgtgagtcttgcccccgtct

SEQ ID NO: 79563 - DNA, 201 bp, Homo sapiens
acctgggcatcacaggggcgacaaatgaaaaccgcggggcctcaggggacgggaatcacgcatgtggctgcaggatctgccgcaggtgcctttgcatttcrgggctggggcaggggaagggcggtgggtgagtctgtttccagttgtgagtcttgcccccgtctcctccgtcatcctggtctcccgctgctcccctgctcc

SEQ ID NO: 79564 - DNA, 201 bp, Homo sapiens
cagggagtgctctgtgggtatcggctcaccccattcccacctcaccccaaaaggggaggcggccccgcccgccctgttctgcagaggcgctcaggaaggcytgggggagggaaagggatttgcctgatttcacccaagaggtgaccccaccgcagcgccaaccccgttaccctcaccaggcccgtcccgagggccccctcc

SEQ ID NO: 79565 - DNA, 201 bp, Homo sapiens
actccaggggacttgggccaaatggccatccaagcctgctgcggggtagcctgagccctcgagaggccgccagccagccctggcattcccagtggggggaytctgaatgggcacctgcccttctgatctttgggaatccctgtcatgaccctgaggtcagggtttccttccctcttcacacagagaatgtcaccaatggca

SEQ ID NO: 79566 - DNA, 201 bp, Homo sapiens
ggagtgcagtggcgcgatctcggctcactgcaagctccgcctcccgggttcacgctattctcctgcctcagcctcccgagtagctgggaccacaggcgccygccaccacgcccggctaattttttgtatttttagtagagacggggtttcactgtgttagccaggatggtctcgatctcctgaccttgtgatccgcccgcc

SEQ ID NO: 79567 - DNA, 201 bp, Homo sapiens
cctcaaaaaaaaaaagaaaaagaaaatatcagggggagaaggtggcatctgttctatgtttgagaaggcagctggacttcccattgaaggaggcgccgcaktctccccacatggacagaggagaaccaggctattggggtgagaccagtgcttgtgcttcccaagtggtctgggttctgcctccatactggctgcagtctg

SEQ ID NO: 79568 - DNA, 201 bp, Homo sapiens
ctgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactga

SEQ ID NO: 79569 - DNA, 201 bp, Homo sapiens; identical to SEQ ID NO: 10336

SEQ ID NO: 79570 - DNA, 201 bp, Homo sapiens
cagttgggttctcagcccgagaagcacggggcttcctggagctgtgtcctcttggcctctgggatggcaacgtgacggcccactcctgagctctttcttcrttttctctgttgtccagtggcccccgcttcaacagggtcagggtcagcctggggggctgcggctacctgtggatggtttttttttatttgagacagggtc

SEQ ID NO: 79571 - DNA, 201 bp, Homo sapiens; identical to SEQ ID NO: 54297

SEQ ID NO: 79572 - DNA, 201 bp, Homo sapiens; identical to SEQ ID NO: 10343

SEQ ID NO: 79573 - DNA, 201 bp, Homo sapiens; identical to SEQ ID NO: 54301

SEQ ID NO: 79574 - DNA, 201 bp, Homo sapiens; identical to SEQ ID NO: 54303

SEQ ID NO: 79575 - DNA, 201 bp, Homo sapiens; identical to SEQ ID NO: 54306

SEQ ID NO: 79576 - DNA, 201 bp, Homo sapiens; identical to SEQ ID NO: 54310

SEQ ID NO: 79577 - DNA, 201 bp, Homo sapiens
atttcctaatagcctaagggttcttggcaggtctttccccacatcagcaagaaatcttgggagttgggaagagtcagaccttgttccctgaacaagctttmtgctttggccaagagttgttaggagattaatgcctgtccccgaaaggcacaggttggagtgtttacttcttcctctcctttcctctctccccccttagag

SEQ ID NO: 79578 - DNA, 201 bp, Homo sapiens
catcagcaagaaatcttgggagttgggaagagtcagaccttgttccctgaacaagctttctgctttggccaagagttgttaggagattaatgcctgtcccygaaaggcacaggttggagtgtttacttcttcctctcctttcctctctccccccttagagatcgtgacccttcctgcttgcctccctggtgggctctttca

SEQ ID NO: 79579 - DNA, 201 bp, Homo sapiens
caagctccaggctgggagcagagggccaccccacgccttggcacttcctgggtgcttaatctgtttgtctctctcctgacccacggtggcccaggtgggascagagggagaggaacagcctgggtgtgtctgtttgggcatctgctgggtgcatgtgggctgtttactgtcaacagagcttctgggctcaccaagggcttc

SEQ ID NO: 79580 - DNA, 201 bp, Homo sapiens
aatttttatatttttcatatttatttatttatttatttatttatttatttatttatttattgagatggagtctccctctgtcgcccaggctggagtgcagyggcgcgatctcggctcactgcaagctccgcctcccgggttcacgctattctcctgcctcagcctcccgagtagctgggaccacaggcgcccgccaccacg

SEQ ID NO: 79581 - DNA, 201 bp, Homo sapiens
tgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaa

SEQ ID NO: 79582 - DNA, 201 bp, Homo sapiens; identical to SEQ ID NO: 54318

SEQ ID NO: 79583 - DNA, 201 bp, Homo sapiens; identical to SEQ ID NO: 54322

SEQ ID NO: 79584 - DNA, 201 bp, Homo sapiens
ccctgggccaaaaggcacgtacgtccggcatcttagagaagctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccaggggg

SEQ ID NO: 79585 - DNA, 201 bp, Homo sapiens
ccggccgggaaggcacaggaggtggccgggggaggggagcacacccttcccctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcag

SEQ ID NO: 79586 - DNA, 201 bp, Homo sapiens
cctcccaaagtgctgggatgacaggcgtgagccacggcgctcggccgaaaaccagcagctctttcatcagcatgaaaactaaaaacctggcctcacctccrttattttagtcacgcgacgcctctgtcacggcaggcctgaatttcagggataaaggaacgagatggtccttgagcttgaggacctcacaccccgaaatgc

SEQ ID NO: 79587 - DNA, 201 bp, Homo sapiens; identical to SEQ ID NO: 54330

SEQ ID NO: 79588 - DNA, 201 bp, Homo sapiens
gcctggctgcagctctgcctcccctgagcgccccgagtcacgcttggtgggaaatgcagtgcgggaaacgcagtgcgggaaacgcagtgtgggaaatgcartgcgtgctgggcatggagtgagcctgcctcctctcccatctctctgtagcactgagatttctgccactaacctctcttctttctgctttttcacttttgc

SEQ ID NO: 79589 - DNA, 201 bp, Homo sapiens
cgttggaggccggtggagaagccccacctggcttatgccctggagagggtttagcgggctgggtggacccctcgcctcctccccgagggccaatgccgcgracacgttttcactgtcaccctcgttctgtctgccacctgaagggaatttgaggaccgccgccagggcaccccgtacatacacacagctgcttttgtggag

SEQ ID NO: 79590 - DNA, 201 bp, Homo sapiens
tctttgggaggatgtagtttgccctaggcctggatttcggtagaatgagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccga

SEQ ID NO: 79591 - DNA, 201 bp, Homo sapiens
tctcaaaaacaacaacaaaaaagaaagtcaaaagaggaaccaaaaagtctctcccagagggaagaagggaactctctgtgggctcgcccagttgggcaatygtgccattccgagctggccattgggaaagaagtgagaataatagcttcttcagagaggcttctgtccatcaaggaaacctcgcctgcatcagtttaccgg

SEQ ID NO: 79592 - DNA, 201 bp, Homo sapiens
tcacccactccattccttgtccccgtggctcctgcttgcagcagtagaacctgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaa

SEQ ID NO: 79593 - DNA, 201 bp, Homo sapiens
gactataggcgtgcaccatcacgcctcgctaatttttgtatttttagtagagacggggtttcaccatgttggccaggctggtctcatacccctgatctcarccaatctgcccgcctcagcctcccaaagtgctgggatgacaggcgtgagccacggcgctcggccgaaaaccagcagctctttcatcagcatgaaaactaa

SEQ ID NO: 79594 - DNA, 201 bp, Homo sapiens
cggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacc

SEQ ID NO: 79595 - DNA, 201 bp, Homo sapiens
taatttttgtatttttagtagagacggggtttcaccatgttggccaggctggtctcatacccctgatctcagccaatctgcccgcctcagcctcccaaagygctgggatgacaggcgtgagccacggcgctcggccgaaaaccagcagctctttcatcagcatgaaaactaaaaacctggcctcacctccattattttagt

SEQ ID NO: 79596 - DNA, 201 bp, Homo sapiens
attgtgctgctgcactgtagccttggcgacagagtgaggctctgtctcaaaaaataaataagtaaatgaatgaaaaataaacctctagttgaagggcgcakattggatcttaataaggcacatgtaaaagccgtgggatccaaactgaagtgtgtattggccggagccacaggagactccagagaggcagcgtggcctggg

SEQ ID NO: 79597 - DNA, 201 bp, Homo sapiens
cgctctgtcgcccaggctggagtgcagtggctctatctcggctcactgcaacctccgcctcccgggttcacaccattctcctgcctcaggctcccaagtakctgggactacaggcgcccgccaccacgcccggctaattttttttaatatatatttttagtagagacaggggtttcacagtgttagacaagatggtcttga

SEQ ID NO: 79598 - DNA, 201 bp, Homo sapiens
caagtgatccacgtgcctcagcctcccaaagtgctgagattacaggcgtgagccacgatgcccagccaaaaagccagtcttgagatggggaagacgtggcscatgctgtcctcagcagtgcccagtcccagccaaagtgggcactgctgcctcactctcccacccaccctcagggtgtggcacttactgggaagaagcagg

SEQ ID NO: 79599 - DNA, 201 bp, Homo sapiens
tctagttgaagggcgcagattggatcttaataaggcacatgtaaaagccgtgggatccaaactgaagtgtgtattggccggagccacaggagactccagakaggcagcgtggcctggggcctacacacagaggcttggcctggcttgaatccccaatctgaccattactagcttgggggagtcccttgacttttctaatct

SEQ ID NO: 79600 - DNA, 201 bp, Homo sapiens
tgccgagtagctgggattacaggtgcacgccaccacgcctggctaattttttgtatttttagtagagatggggtttcaccgtattggccaggctggtctcraactcctgacctcaggtgatcccctgcctcggcctcccaaagtgctgggattacaggtgtgagccaccgcgcccggcctcatggtgttttttgaccaata

SEQ ID NO: 79601 - DNA, 201 bp, Homo sapiens
tggggtttcaccgtattggccaggctggtctcgaactcctgacctcaggtgatcccctgcctcggcctcccaaagtgctgggattacaggtgtgagccacygcgcccggcctcatggtgttttttgaccaataaaagtttttaaataggtggtcaaaagtgtgtttcagcttttagggagtacctagcatttgtgtcaaat

SEQ ID NO: 79602 - DNA, 201 bp, Homo sapiens
tttaaaggggaatactaatttgtgttttatcctgtagtcggcttccttttcttcctcccagagctgtggttcctgccagaggacacttccctcgttggctrtgcccaggagcagcttgaccagaagattttccctgttatgaagtcataacacatatcataatagtaactattgttaatacctaccctatttatgatcttt

SEQ ID NO: 79603 - DNA, 201 bp, Homo sapiens
cacttccctcgttggctgtgcccaggagcagcttgaccagaagattttccctgttatgaagtcataacacatatcataatagtaactattgttaatacctrccctatttatgatctttaaaaccctcggccgggcgcagtggctcacgcctgtaatcccagcactttgggaggctgaggcgggtggatcacctgaggtcag

SEQ ID NO: 79604 - DNA, 201 bp, Homo sapiens
taaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggactctgaatgg

SEQ ID NO: 79605 - DNA, 201 bp, Homo sapiens
aagctcaggctgctgggcaggtcagtgtgggtcccttagggggcagggagtgggcaggtggaccccctgggctgagttccccacagaagggtatcctggtygtacctgatatcaggtgtactgtggagctccctgaaggccctccagaatggagttcctaccccgtccgccaccgaatcagcaggtactgtggtcctcgcc

SEQ ID NO: 79606 - DNA, 201 bp, Homo sapiens
aggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataa

SEQ ID NO: 79607 - DNA, 201 bp, Homo sapiens
gtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccgggcagcatgtgcttggaggtgcccggttgttgtgggtaggaaacagcccag

SEQ ID NO: 79608 - DNA, 201 bp, Homo sapiens
tacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggc

SEQ ID NO: 79609 - DNA, 201 bp, Homo sapiens
tgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactcca

SEQ ID NO: 79610 - DNA, 201 bp, Homo sapiens
agtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggag

SEQ ID NO: 79611 - DNA, 201 bp, Homo sapiens; identical to SEQ ID NO: 10337

SEQ ID NO: 79612 - DNA, 201 bp, Homo sapiens
ttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttttt

SEQ ID NO: 79613 - DNA, 201 bp, Homo sapiens
tcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccc

SEQ ID NO: 79614 - DNA, 201 bp, Homo sapiens
tcgaactcctgacctcgtgatccgcccacctcgggctcccaaagtgctgggattacaggcatgagccaccgcgcccagccgttctgggctatttctagagrcagaaactaacggcccgtcacttagcctccgtcacaggagttcccaagttatagcgacttcctggagctctgggaaggccattgtgacactctgggtttc

SEQ ID NO: 79615 - DNA, 201 bp, Homo sapiens
taaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccagg

SEQ ID NO: 79616 - DNA, 201 bp, Homo sapiens
tgaggcaggagaattgtttggactggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagcccggggtcaccaga

SEQ ID NO: 79617 - DNA, 201 bp, Homo sapiens; identical to SEQ ID NO: 10339

SEQ ID NO: 79618 - DNA, 201 bp, Homo sapiens
tgcccagtcccagccaaagtgggcactgctgcctcactctcccacccaccctcagggtgtggcacttactgggaagaagcaggcattgagaaacagaattraggaggggaaacagtccagggccaacagtgcttggggattgaggcctgaaaatgggagcagggtacagaggctgtggctggccagatgggtcgggtgccc

SEQ ID NO: 79619 - DNA, 201 bp, Homo sapiens
aggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcg

SEQ ID NO: 79620 - DNA, 201 bp, Homo sapiens; identical to SEQ ID NO: 10340

SEQ ID NO: 79621 - DNA, 201 bp, Homo sapiens
aagtgggcactgctgcctcactctcccacccaccctcagggtgtggcacttactgggaagaagcaggcattgagaaacagaattgaggaggggaaacagtycagggccaacagtgcttggggattgaggcctgaaaatgggagcagggtacagaggctgtggctggccagatgggtcgggtgccccctgcacccccacccc

SEQ ID NO: 79622 - DNA, 201 bp, Homo sapiens
ccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtc

SEQ ID NO: 79623 - DNA, 201 bp, Homo sapiens
cacccagctaatttttatatttttcatatttatttatttatttatttatttatttatttatttatttattgagatggagtctccctctgtcgcccaggctrgagtgcagtggcgcgatctcggctcactgcaagctccgcctcccgggttcacgctattctcctgcctcagcctcccgagtagctgggaccacaggcgccc

SEQ ID NO: 79624 - DNA, 201 bp, Homo sapiens
cagcaggaggtagatgtgacagagccgcttcccgcaggcagtgtggtgacagggaccctgattgcaccaggtcttccgcatgcccgccacttccccatcaygctacccgccaacgtcacaggcctgattcaccagtccgcctgtgacccggcaccagcagacaggagaatgtcagcaggggcccgggctgggcattgtccc

SEQ ID NO: 79625 - DNA, 201 bp, Homo sapiens
aggaggtagatgtgacagagccgcttcccgcaggcagtgtggtgacagggaccctgattgcaccaggtcttccgcatgcccgccacttccccatcacgctmcccgccaacgtcacaggcctgattcaccagtccgcctgtgacccggcaccagcagacaggagaatgtcagcaggggcccgggctgggcattgtcccaagt

SEQ ID NO: 79626 - DNA, 201 bp, Homo sapiens
cttagggctccccaggtgcgcgccaccacacccagctaatttttaaattctttgcagagatagggtcttgctgtgttgcccaggttggtgtcgaactcctrggctcaagggatcctcccctcttggcctcccaaagtgctgggattacaggcgtaaacctccacacccagcctgataaacattcagccctggagtggcgga

SEQ ID NO: 79627 - DNA, 201 bp, Homo sapiens
ttgctataaccatattatgtgttaatagagttgttcatgattgtgaagattaaacaaggtactggagtcctactttatgtaagggatgggctccaagatcrgaggatgagttaaacgctgttttcttttttctttttctttttttttttttgagacggagtctcgctctgtcgcccaggctggagtgcagtggctctatct

SEQ ID NO: 79628 - DNA, 201 bp, Homo sapiens
aggagaatgtcagcaggggcccgggctgggcattgtcccaagtccacttccagaggcctggctgcagctctgcctcccctgagcgccccgagtcacgcttrgtgggaaatgcagtgcgggaaacgcagtgcgggaaacgcagtgtgggaaatgcagtgcgtgctgggcatggagtgagcctgcctcctctcccatctctct

SEQ ID NO: 79629 - DNA, 201 bp, Homo sapiens
cctcccagagtgctgggattacaggcataagccaccacgcccagccaaacgctgttttccatggctccacaccttaatataataagctacggtttattgcmtgaggccctccaccgaggactccatgcacagtatctcagtgaagactcccagcaccctggcgaagtggggaccagtgttatacccattttacagatgagg

SEQ ID NO: 79630 - DNA, 201 bp, Homo sapiens
tagtttgcctagggccgcacagttaggaagtggtgggcctgggactccctgcacatctgtgagcacctggggtccgttcttggatcatccagggtgtctgygtgggtgtgagactgggatcggtaatcgttcattcacgagagataattgcagagggtgcctggccgggcgcggtggctcacacctgtaatcccagcactt

SEQ ID NO: 79631 - DNA, 201 bp, Homo sapiens
aggtcctggctgctgagcgggatggcagggctgtgtacagaagacaaggcgaccacagggacctggtggccaagaggatggctcttaaaaagtgcctctcrgagttggcggagtccgccagcagcagccttcctgggcagggggcctcccacagacagcgacagaactttactaggaccagcctgggcaatatggcgacac

SEQ ID NO: 79632 - DNA, 201 bp, Homo sapiens
tattttaatataatttatttatttagtcataaatttatgtaatttttttttttttgagacagagtctagctctgtcacccaggctggagtgcagtggtgckatctcggctcaccgcaacctccgcctccccggttcaagcgattctcctgcctcaccctcctgagtagctgggaatacaggcgcccgccaccacacccggc

SEQ ID NO: 79633 - DNA, 201 bp, Homo sapiens
ccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatctt

SEQ ID NO: 79634 - DNA, 201 bp, Homo sapiens
gtacagattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatccctt

SEQ ID NO: 79635 - DNA, 201 bp, Homo sapiens
gccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctcc

SEQ ID NO: 79636 - DNA, 201 bp, Homo sapiens
aaccaacaccaactcacaaagcagctcctcctttccagaagctgccccactgtggatgggcgagtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggcc

SEQ ID NO: 79637 - DNA, 201 bp, Homo sapiens
gagccaattcctttgctgctggcagagctgacatttgaaaccaacaccaactcacaaagcagctcctcctttccagaagctgccccactgtggatgggcgmgtggcccaggcctgtcggctgtggcggtgtacatgaccgctctgagctccaccctgacgggctcgaggaccccgtctgccatgtgtttggctgaccgtgt

SEQ ID NO: 79638 - DNA, 201 bp, Homo sapiens
gacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccaga

SEQ ID NO: 79639 - DNA, 201 bp, Homo sapiens; identical to SEQ ID NO: 54265

SEQ ID NO: 79640 - DNA, 201 bp, Homo sapiens
ccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttcca

SEQ ID NO: 79641 - DNA, 201 bp, Homo sapiens
tcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggag

SEQ ID NO: 79642 - DNA, 201 bp, Homo sapiens
aaaatagctgggcgtggtggcacatacctgcaatgggaggtgccgctcgggaggctgaggtgggagaatggcatgaacccaggagacagaggttggagtgrgccgagatcgcaccactgcactccagcctgggagacagagcgagactccatctaaaaaaaaaaattggttatttatctttttattattgagatgtagggg

SEQ ID NO: 79643 - DNA, 201 bp, Homo sapiens
gaggctgaggtgggagaatggcatgaacccaggagacagaggttggagtgggccgagatcgcaccactgcactccagcctgggagacagagcgagactccrtctaaaaaaaaaaattggttatttatctttttattattgagatgtaggggttctttatatgttctattttttgttttttgaataactgttgggcactatg

SEQ ID NO: 79644 - DNA, 201 bp, Homo sapiens
cccaagtagctgggattataggcgcctgcccccgcttccggctcctttttgtttttttcgtagagacagggtttcgccatgtttgccaggctgatctccgwattccctgacctcaggtgatctgccccccttgtctctctctcttttttttaactttaaaaagatacagaggcagggtttcgccatgttgtccaggctggt

SEQ ID NO: 79645 - DNA, 201 bp, Homo sapiens
ggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaa

SEQ ID NO: 79646 - DNA, 201 bp, Homo sapiens
gtttacgtcatcatttatgatagatactatcatcatatacacctgaaaaacgaggcctggagcgatggaggagcttgttcaaggtcagagccagcactcayatatgggtcttaagacactggagcagccaagggcctctagaccaggacattccactcggagcagcagctcaggggccaccaggcctctgtggcagggggg

SEQ ID NO: 79647 - DNA, 201 bp, Homo sapiens
cccggctcagatggtgactttcattcattgcattcaatcatgcagcccaccaaccctttgttatctgcctgcaaggtttattccggtcagtttgagtagtragttgctataaccatattatgtgttaatagagttgttcatgattgtgaagattaaacaaggtactggagtcctactttatgtaagggatgggctccaaga

SEQ ID NO: 79648 - DNA, 201 bp, Homo sapiens
agagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcc

SEQ ID NO: 79649 - DNA, 201 bp, Homo sapiens
tctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacctgcagccccccaagccctcagttattccacggcccctgtgcagtcactg

SEQ ID NO: 79650 - DNA, 201 bp, Homo sapiens
gcagtctcggctcactgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctca

SEQ ID NO: 79651 - DNA, 201 bp, Homo sapiens
tctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccggctaattttttgt

SEQ ID NO: 79652 - DNA, 201 bp, Homo sapiens
agctcgaggccgtggtcagcaacctcttgctcagtgctgtgcccatacacgtctgtcagcagggccctggttctagtgtttgccgacttccacggtgcacrtgcactcaccgtggctgatttccagctgcccatgtgttgccactgactgtggaactggagagtcacagtgacacgtggtatttctacagtagatgtgaaa

SEQ ID NO: 79653 - DNA, 201 bp, Homo sapiens; identical to SEQ ID NO: 10338

SEQ ID NO: 79654 - DNA, 201 bp, Homo sapiens
cagtgctgtgcccatacacgtctgtcagcagggccctggttctagtgtttgccgacttccacggtgcacatgcactcaccgtggctgatttccagctgccyatgtgttgccactgactgtggaactggagagtcacagtgacacgtggtatttctacagtagatgtgaaaagcctggccgggcacggcggctcacgcctgt

SEQ ID NO: 79655 - DNA, 201 bp, Homo sapiens
tgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatgggg

SEQ ID NO: 79656 - DNA, 201 bp, Homo sapiens
tacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctt

SEQ ID NO: 79657 - DNA, 201 bp, Homo sapiens
ctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagc

SEQ ID NO: 79658 - DNA, 201 bp, Homo sapiens
tcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgctat

SEQ ID NO: 79659 - DNA, 201 bp, Homo sapiens
ggagattaatgcctgtccccgaaaggcacaggttggagtgtttacttcttcctctcctttcctctctccccccttagagatcgtgacccttcctgcttgcytccctggtgggctctttcaggctggacacagggtttaaaaaaaaaaaaaaaaaagcagaaaaaaagtcatcgtccccagagaaagcttttagtgtctcac

SEQ ID NO: 79660 - DNA, 201 bp, Homo sapiens
agctttctgctttggccaagagttgttaggagattaatgcctgtccccgaaaggcacaggttggagtgtttacttcttcctctcctttcctctctcccccsttagagatcgtgacccttcctgcttgcctccctggtgggctctttcaggctggacacagggtttaaaaaaaaaaaaaaaaaagcagaaaaaaagtcatcg

SEQ ID NO: 79661 - DNA, 201 bp, Homo sapiens
gtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcc

SEQ ID NO: 79662 - DNA, 201 bp, Homo sapiens
acaagctttctgctttggccaagagttgttaggagattaatgcctgtccccgaaaggcacaggttggagtgtttacttcttcctctcctttcctctctccycccttagagatcgtgacccttcctgcttgcctccctggtgggctctttcaggctggacacagggtttaaaaaaaaaaaaaaaaaagcagaaaaaaagtca

SEQ ID NO: 79663 - DNA, 201 bp, Homo sapiens
accccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaa

SEQ ID NO: 79664 - DNA, 201 bp, Homo sapiens
agactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcct

SEQ ID NO: 79665 - DNA, 201 bp, Homo sapiens
atttatttatttatttatttatttatttatttatttattgagatggagtctccctctgtcgcccaggctggagtgcagtggcgcgatctcggctcactgcragctccgcctcccgggttcacgctattctcctgcctcagcctcccgagtagctgggaccacaggcgcccgccaccacgcccggctaattttttgtatttt

SEQ ID NO: 79666 - DNA, 201 bp, Homo sapiens
tcttaaactctgaggtcaaaggcagcactctgggattgcaggcgtgagccactgcgtccagcagatcctgtctcttaaaacaagaaaaaaaggccgggtgyggtggctcacgcctgtaatcccagcactttgggaggccaaggcgggcggatcacgaagtcaggagatggagaccatcctggctaacgtggtgaaaccccg

SEQ ID NO: 79667 - DNA, 201 bp, Homo sapiens
ccagcagatcctgtctcttaaaacaagaaaaaaaggccgggtgcggtggctcacgcctgtaatcccagcactttgggaggccaaggcgggcggatcacgargtcaggagatggagaccatcctggctaacgtggtgaaaccccgtctctactgaaaatacaaaaaaattagccgggtgtggtggcgggcgcctatagtccc

SEQ ID NO: 79668 - DNA, 201 bp, Homo sapiens
tgtctcttaaaacaagaaaaaaaggccgggtgcggtggctcacgcctgtaatcccagcactttgggaggccaaggcgggcggatcacgaagtcaggagatsgagaccatcctggctaacgtggtgaaaccccgtctctactgaaaatacaaaaaaattagccgggtgtggtggcgggcgcctatagtcccagctacacggg

SEQ ID NO: 79669 - DNA, 201 bp, Homo sapiens
taatcattgcagtttgggaagccaaggtggaaggatcgctggaatccaggagttcaagaccagcctgggcaatagagtgagaccctgtctctataaaaatwattaaaacaaagctgaaggagaccttgctatgcagccccctgccgcttgtgcacccttgtcgacccacacgcaccttcaggagggcggcgcacacctggg

SEQ ID NO: 79670 - DNA, 201 bp, Homo sapiens
gtctcttaaaacaagaaaaaaaggccgggtgcggtggctcacgcctgtaatcccagcactttgggaggccaaggcgggcggatcacgaagtcaggagatgsagaccatcctggctaacgtggtgaaaccccgtctctactgaaaatacaaaaaaattagccgggtgtggtggcgggcgcctatagtcccagctacacggga

SEQ ID NO: 79671 - DNA, 201 bp, Homo sapiens
tcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaagg

SEQ ID NO: 79672 - DNA, 201 bp, Homo sapiens
cctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtc

SEQ ID NO: 79673 - DNA, 201 bp, Homo sapiens
taactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcac

SEQ ID NO: 79674 - DNA, 201 bp, Homo sapiens; identical to SEQ ID NO: 54328

SEQ ID NO: 79675 - DNA, 201 bp, Homo sapiens
ccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccagg

SEQ ID NO: 79676 - DNA, 201 bp, Homo sapiens; identical to SEQ ID NO: 54331

SEQ ID NO: 79677 - DNA, 201 bp, Homo sapiens
ccaaagcagagggggctgccatcccctgcctgccacctgcccctcggctgcatgcccacagccgtacctgcctgaggacaaaggcttgcactgtctcgccygcgcctggcccccaccccctccccggccagcctgaggctgcctgaggaaggaaggacccgcttcctgttgtcggtgctaattcctttgtaattccagccc

SEQ ID NO: 79678 - DNA, 201 bp, Homo sapiens
ataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctc

SEQ ID NO: 79679 - DNA, 201 bp, Homo sapiens
gaggtcaggagttcgagaccatcctgaccaacatggagaaaccccgtctgtactaaaaataaacattaatcgggcgtggtggcgtgcgcctgtaatcccarctactcgggagcctgaggcaggagaatcgcttgaaccggggagacggagattgccgtgagtcgagatcgcaccattgcactccagcctgggcaacagagc

SEQ ID NO: 79680 - DNA, 201 bp, Homo sapiens
tggtcggccttctccaaaccctctaggcctctgtctgcagctgctgctgcctggacctatacacaaggtcccacccctcaccggggccaaagacgtggttkcaggccctggtggatcctttctgttttgctccatccccgtcccctcttgcacccagcatcgtcctggtcagaacttccgtttaaaccttccttgcctgcc

SEQ ID NO: 79681 - DNA, 201 bp, Homo sapiens
tggacctatacacaaggtcccacccctcaccggggccaaagacgtggtttcaggccctggtggatcctttctgttttgctccatccccgtcccctcttgcrcccagcatcgtcctggtcagaacttccgtttaaaccttccttgcctgccgtgcactccgaggggggcgtcactttgccataggccccagggctgaaaatg

SEQ ID NO: 79682 - DNA, 201 bp, Homo sapiens
ggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactg

SEQ ID NO: 79683 - DNA, 201 bp, Homo sapiens
gccgggtgtggtggcgggcgcctatagtcccagctacacgggaggctgaggcaggagaatggcgtgaacctgggaggcggagcttgcagtgagccgagatmgcgccactgcactccagcccggccgatagagcgagactccgtctcaaaaaaaaaaaaaagaaagaaagaaagaaaaagattcaagacaaatggggagtgg

SEQ ID NO: 79684 - DNA, 201 bp, Homo sapiens
cgggtgtggtggcgggcgcctatagtcccagctacacgggaggctgaggcaggagaatggcgtgaacctgggaggcggagcttgcagtgagccgagatcgmgccactgcactccagcccggccgatagagcgagactccgtctcaaaaaaaaaaaaaagaaagaaagaaagaaaaagattcaagacaaatggggagtggtg

SEQ ID NO: 79685 - DNA, 201 bp, Homo sapiens
ggcgggcgcctatagtcccagctacacgggaggctgaggcaggagaatggcgtgaacctgggaggcggagcttgcagtgagccgagatcgcgccactgcastccagcccggccgatagagcgagactccgtctcaaaaaaaaaaaaaagaaagaaagaaagaaaaagattcaagacaaatggggagtggtggggagggtgg

SEQ ID NO: 79686 - DNA, 201 bp, Homo sapiens
cgggcgcctatagtcccagctacacgggaggctgaggcaggagaatggcgtgaacctgggaggcggagcttgcagtgagccgagatcgcgccactgcactmcagcccggccgatagagcgagactccgtctcaaaaaaaaaaaaaagaaagaaagaaagaaaaagattcaagacaaatggggagtggtggggagggtggag

SEQ ID NO: 79687 - DNA, 201 bp, Homo sapiens
tcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctccc

SEQ ID NO: 79688 - DNA, 201 bp, Homo sapiens
cctatagtcccagctacacgggaggctgaggcaggagaatggcgtgaacctgggaggcggagcttgcagtgagccgagatcgcgccactgcactccagccyggccgatagagcgagactccgtctcaaaaaaaaaaaaaagaaagaaagaaagaaaaagattcaagacaaatggggagtggtggggagggtggaggggaca

SEQ ID NO: 79689 - DNA, 201 bp, Homo sapiens
attggctccggaggatggggttgatccaactccaggctgacactgcccctggggtgagggcccccaggaattggagggcgggggctgaggggacggtcccytaaggccttatgcccacagtcgccttttcctcccccagatcctctccttcatcctgcacacaatcgtgcgaggattcatccactccgctgtcgggggcct

SEQ ID NO: 79690 - DNA, 201 bp, Homo sapiens
tcccagctacacgggaggctgaggcaggagaatggcgtgaacctgggaggcggagcttgcagtgagccgagatcgcgccactgcactccagcccggccgawagagcgagactccgtctcaaaaaaaaaaaaaagaaagaaagaaagaaaaagattcaagacaaatggggagtggtggggagggtggaggggacatagatta

SEQ ID NO: 79691 - DNA, 201 bp, Homo sapiens
ggaaaggtttgctacacacagtgtgatgtctcttgaggttagagaacctgtgcctctttgggaggatgtagtttgccctaggcctggatttcggtagaatsagcaagagttagccttgaagtcctgttcaggtgggccccctcttgccctgtacccagaatgagctgatgtgagatgccgagagtggcttcgttgggaaga

SEQ ID NO: 79692 - DNA, 201 bp, Homo sapiens
ggtagatgtgacagagccgcttcccgcaggcagtgtggtgacagggaccctgattgcaccaggtcttccgcatgcccgccacttccccatcacgctacccrccaacgtcacaggcctgattcaccagtccgcctgtgacccggcaccagcagacaggagaatgtcagcaggggcccgggctgggcattgtcccaagtccac

SEQ ID NO: 79693 - DNA, 201 bp, Homo sapiens
agggctgtgcctctttgcgcggctcagcacagggacagcaggggtggccagacgcccctgcctgctgcggctctggcctccccgggctaactctgcccccycccccccccaccccgtccccgcggtgcctgtcagctcatctatgatgctggtgtctccttcatcgtcgtcctcgtggtctgggccggctgctccgggctg

SEQ ID NO: 79694 - DNA, 201 bp, Homo sapiens
caagttcctggtcagcggcgaccagaagacaggtaggtgccccgggcagcctcggtcgctgtcactccccggcctgagcccagcccactggccaccggccrgaatgtgttaagctgagccgggccagcggggccatggaaaggccgcatcccaggagctgtctgcccgtcagagctattgcatcactgccagccccaactg

SEQ ID NO: 79695 - DNA, 201 bp, Homo sapiens
tgtgcctctttgcgcggctcagcacagggacagcaggggtggccagacgcccctgcctgctgcggctctggcctccccgggctaactctgccccctccccyccccaccccgtccccgcggtgcctgtcagctcatctatgatgctggtgtctccttcatcgtcgtcctcgtggtctgggccggctgctccgggctggtttt

SEQ ID NO: 79696 - DNA, 201 bp, Homo sapiens
ccagcggctgacccgcctcttccctgctcctttgccgtttctagcacctggcttacttcctggcacacagtgagcactcaataaatgtatgctgagaatgrctgcgagcggcttcctccttggctcctgtgtctctttctccctagatcacacatttctcgcctcttgtctggtgcccaggttccctgtcccttgactggg

SEQ ID NO: 79697 - DNA, 201 bp, Homo sapiens
gaggcgggcagatcacgagctcaggagatcaagacaatcctggctaacacggtgaaaccccgtctctactaaaaatacaaaaaagtagccgggcgtggtgrcgggtgcctgtactcccagctactcgggaggctgaggcaggagaatggcgtgaacccgggaggcggagcttgcagtgagcggagattataccactgcgct

SEQ ID NO: 79698 - DNA, 201 bp, Homo sapiens
ccctgggtatcgtcatggacaagtatggcccgaggaagctcaggctgctgggcaggtcagtgtgggtcccttagggggcagggagtgggcaggtggacccyctgggctgagttccccacagaagggtatcctggtcgtacctgatatcaggtgtactgtggagctccctgaaggccctccagaatggagttcctaccccgt

SEQ ID NO: 79699 - DNA, 201 bp, Homo sapiens
tcaataaatatttgggggacgaagtttaaaaagagagagagacagaaataccacagaaaagaagctaaaatagactaagaggctgggagaagagcagagcrgaagatggaaacagtgaaatacagtctccccaggacacccagagatgggttacagggctggctataaccgacgcagtaccaagggtcaaccacccagggg

SEQ ID NO: 79700 - DNA, 201 bp, Homo sapiens; identical to SEQ ID NO: 54256

SEQ ID NO: 79701 - DNA, 201 bp, Homo sapiens
caggcatgagccgccacacctggccctgttgtttttatttattcagtaaacagctattgtaggccaagacctgggtgagatactggggacacagaagtgamcacagtgcaggccctgcccttcggggctcacagcccagtgggggattagacatgtctttgcgcttccacacacgctgacgggactgtgctccccacagcc

SEQ ID NO: 79702 - DNA, 201 bp, Homo sapiens
tcgctgtcactccccggcctgagcccagcccactggccaccggccggaatgtgttaagctgagccgggccagcggggccatggaaaggccgcatcccaggmgctgtctgcccgtcagagctattgcatcactgccagccccaactgtttcttcgtgtccccatcagggtttcctggtccaggagggagggaaggaccaaaa

SEQ ID NO: 79703 - DNA, 201 bp, Homo sapiens
gccagtgctggctctcccagggccctgcagcacagggcctgggccatcgcgtgccatccgtggagggcggacgccaggtcactccatgggggcagagcacyccccacggtgtggatcctcagcctcccccgggacatctggacggcacgctcagtgtttgttcagtgcctcgcgtttgtacagccctttgcactcgcttca

SEQ ID NO: 79704 - DNA, 201 bp, Homo sapiens
tccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcac

SEQ ID NO: 79705 - DNA, 201 bp, Homo sapiens
tgaccctcacactaagtaaaagcccctttcctcggtggtgtgtgtgggaatgctgttggcgaggagagggggtcacggtgtgggctggccacctgggcatygaagtggtgggagctgggactctggggccagccatcctatggacttgcagagattctcatgcccctggactggggagcatcccgaaagttcttcctcctc

SEQ ID NO: 79706 - DNA, 201 bp, Homo sapiens
ggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcgtcaggggcaggttctttgacctttccctc

SEQ ID NO: 79707 - DNA, 201 bp, Homo sapiens
tccgcccacctcgggctcccaaagtgctgggattacaggcatgagccaccgcgcccagccgttctgggctatttctagaggcagaaactaacggcccgtcrcttagcctccgtcacaggagttcccaagttatagcgacttcctggagctctgggaaggccattgtgacactctgggtttcattagctgtttcttagaaac

SEQ ID NO: 79708 - DNA, 201 bp, Homo sapiens
gagcacctggggtccgttcttggatcatccagggtgtctgcgtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggccaacacg

SEQ ID NO: 79709 - DNA, 201 bp, Homo sapiens; identical to SEQ ID NO: 10352

SEQ ID NO: 79710 - DNA, 201 bp, Homo sapiens
gggtgcctggccgggcgcggtggctcacacctgtaatcccagcactttgggaggccaaggcgggtggatcacaaggtcagaagatcgagaccatcctggcyaacacggtgaaaccctgtctctacaaaaacgcaaaaattagccgggtaaggtggcgcgtgcctgtagtcccagctactcgggaggctgaggcaggagaat

SEQ ID NO: 79711 - DNA, 201 bp, Homo sapiens
gcacttaacaatggtagcatttggccgggcgcggtggctcacgcctgtaatcccagcactttgggaggccgaggcgggcggatcacgaggtcaggagatcragaccatcccggctaaaacggtgaaaccccgtctctactaaaaatacaaaaaattagccgggcgtagtggcgggcgcctgtagtcccagctacttgggag

SEQ ID NO: 79712 - DNA, 201 bp, Homo sapiens
cctggccgggcgcggtggctcacacctgtaatcccagcactttgggaggccaaggcgggtggatcacaaggtcagaagatcgagaccatcctggccaacayggtgaaaccctgtctctacaaaaacgcaaaaattagccgggtaaggtggcgcgtgcctgtagtcccagctactcgggaggctgaggcaggagaatcgctt

SEQ ID NO: 79713 - DNA, 201 bp, Homo sapiens
gtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagt

SEQ ID NO: 79714 - DNA, 201 bp, Homo sapiens
gaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggcttt

SEQ ID NO: 79715 - DNA, 201 bp, Homo sapiens
agattgcgccactgcactccagcctgggcgacagagtgcgactccatctcaaaagaaaaaaaaatatctgtggaacacactttggggaaccctaatctatyatgtctctttctttcttgtttttttgaggcagggtctctttctgcgttgcttaggctggagtgcagtgatgtgaacgctgcagccttgacctcttagggc

SEQ ID NO: 79716 - DNA, 201 bp, Homo sapiens
aacgactggcttgcaaaatttctgaaaattcacaattggctccggaggatggggttgatccaactccaggctgacactgcccctggggtgagggcccccargaattggagggcgggggctgaggggacggtcccttaaggccttatgcccacagtcgccttttcctcccccagatcctctccttcatcctgcacacaatcg

SEQ ID NO: 79717 - DNA, 201 bp, Homo sapiens
agctctgagcaggacagacttgtggccaagtcaagaaagtaaggtctggtcccagcgaggtggctcatccctgtaatcccagtgctttgggaggccgaagsgggggcggggtggatcacttgaggtcaggggtttgagaccagcctgaccaacatggtgaaacctcaactctactaaaaatacaaaaattagggccgggcg

SEQ ID NO: 79718 - DNA, 201 bp, Homo sapiens
agaccagctctggccatctggaggagacccatggtgtcagatgccttggctgggcgtcaggggcaggttctttgacctttccctctctctgagcacagcargaggtagatgtgacagagccgcttcccgcaggcagtgtggtgacagggaccctgattgcaccaggtcttccgcatgcccgccacttccccatcacgctac

SEQ ID NO: 79719 - DNA, 201 bp, Homo sapiens
ctagccaaaaagccagtcttgagatggggaagacgtggcccgtgctgtccccagcagtgcccagtcccagccaaagtgggcagtgctgcctcactctcccmcccaccctcagggtgtggcacttactgggaagaagcaggcattgagaaacagaattgagggggggaaacagtccagggccaacagtgcttggggattgag

SEQ ID NO: 79720 - DNA, 201 bp, Homo sapiens
ggaagtcacacagggtcaggacgaagcaaacacctcacagtccatcagcccaagttccccagaccctgtgggtctgccagggccccgtaggggcttctccyacctctgaccctcacactaagtaaaagcccctttcctcggtggtgtgtgtgggaatgctgttggcgaggagagggggtcacggtgtgggctggccacctg

SEQ ID NO: 79721 - DNA, 201 bp, Homo sapiens
cccagccaaagtgggcactgctgcctcactctcccacccaccctcagggtgtggcacttactgggaagaagcaggcattgagaaacagaattgaggagggraaacagtccagggccaacagtgcttggggattgaggcctgaaaatgggagcagggtacagaggctgtggctggccagatgggtcgggtgccccctgcacc

SEQ ID NO: 79722 - DNA, 201 bp, Homo sapiens
ggggtcccgggcagcacccacagacactctcccggggccccagggtgaagatcaagttcagctggctgggctttgaccacaagatcacagggaagcagttytacaagcaggtgaccacggtgggccggcgcctgagtgtgggcagctccatgaggagtgccaaggagcaggtggcgctgcaggagggccacaagctgtgcc

SEQ ID NO: 79723 - DNA, 201 bp, Homo sapiens
gcagctccatgaggagtgccaaggagcaggtggcgctgcaggagggccacaagctgtgcctgtccaccgtcgacctggaggtgaagtgccagccggatgcygcaggtacccgcctgagaccgcagccgggcgacgggcagggagtgctctgtgggtatcggctcaccccattcccacctcaccccaaaaggggaggcggcc

SEQ ID NO: 79724 - DNA, 201 bp, Homo sapiens
gctcagtggggacagtcatctttttgttttatgtaggtctcactgaaagaaaagttgtaaaaaggcaacaaggcatttgaggtggggaggcctgcacagcktgtgtgtgtgtgtgtgtgtgtgtgtgtgtgtgtgtgggcactgggcacagccctctttcaacactgccaagagcagcccctgcccccccaccacccacat

SEQ ID NO: 79725 - DNA, 201 bp, Homo sapiens
ttgccgtgtgtgtctgtaaatgaaaacagaacagaacgctccacctgagcatggctgaaagacagcaggtcaagcccaaagtcctcccagaaagtggcacrgtgggtgcgtggacaccctgggcatcgaggtcaggacggggctggagacgctggggcaactggcccacactgggatctgcatccctcaccgagaaacagg

SEQ ID NO: 79726 - DNA, 201 bp, Homo sapiens
tcagtggggacagtcatctttttgttttatgtaggtctcactgaaagaaaagttgtaaaaaggcaacaaggcatttgaggtggggaggcctgcacagcgtstgtgtgtgtgtgtgtgtgtgtgtgtgtgtgtgtgggcactgggcacagccctctttcaacactgccaagagcagcccctgcccccccaccacccacattc

SEQ ID NO: 79727 - DNA, 201 bp, Homo sapiens
ggtgactttcattcattgcattcaatcatgcagcccaccaaccctttgttatctgcctgcaaggtttattccggtcagtttgagtagtaagttgctataamcatattatgtgttaatagagttgttcatgattgtgaagattaaacaaggtactggagtcctactttatgtaagggatgggctccaagatcagaggatgag

SEQ ID NO: 79728 - DNA, 201 bp, Homo sapiens; identical to SEQ ID NO: 54283

SEQ ID NO: 79729 - DNA, 201 bp, Homo sapiens
aaaaatgcaaaaattagccagatgtggtggtgggcgcctgtagtccccacgactcaggaggctgaggcaggagaattgcttgaacccgggaggcagaggtygcagtgagctgagattgtgccactgcactccagcatgggtgacagagcgagactctgactcaaaaaaaaaaaagtctattgtctggccctttatggaaaa

SEQ ID NO: 79730 - DNA, 201 bp, Homo sapiens
tgataacaatctaggagttaaatagatactatcatctgtttacgtcatcatttatgatagatactatcatcatatacacctgaaaaacgaggcctggagckatggaggagcttgttcaaggtcagagccagcactcacatatgggtcttaagacactggagcagccaagggcctctagaccaggacattccactcggagca

SEQ ID NO: 79731 - DNA, 201 bp, Homo sapiens
cagtggggacagtcatctttttgttttatgtaggtctcactgaaagaaaagttgtaaaaaggcaacaaggcatttgaggtggggaggcctgcacagcgtgygtgtgtgtgtgtgtgtgtgtgtgtgtgtgtgtgggcactgggcacagccctctttcaacactgccaagagcagcccctgcccccccaccacccacattcc

SEQ ID NO: 79732 - DNA, 201 bp, Homo sapiens
ctggggagaagactccagaagaccaggcagggccacatggtcaccccagggccctgtggctctgttggtctgtagcctaggttagggttaaggcaggcagscttgagattaaaaaggtagaaggaaaatgcctagctagcaagctctctgcttttccggaacattctctagctctgttgaaaagtttgagacactcttttt

SEQ ID NO: 79733 - DNA, 201 bp, Homo sapiens
tggctcacacctgtaatcccagcactccgggaggccgatgggggtggtggatcatgaggtcaggagttcgagaccagcctggcccaagatagtgaaacccmgtctctactaaaatatacaaaaattagctgggcacagtggtgggtccctggaatcccagctacttgggaggctgaggcaggagaatcgcttgaggccggg

SEQ ID NO: 79734 - DNA, 201 bp, Homo sapiens
caggagagggtcccacggtggcccccggccagctctggagggtccaggagagggtcccgcggtggcccccggccagctctggagggtctaggtgcctggtragcgggacttgccagtgcccagtgcctgctgtgcctccccaccttcctctctttctgtcctgtaccttggggaagctcaggcagtcagctacttgccatt

SEQ ID NO: 79735 - DNA, 201 bp, Homo sapiens
gggaagttgaggctgcagtgaactgagattgcaccagtgcactccagcccgggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacac

SEQ ID NO: 79736 - DNA, 201 bp, Homo sapiens
caatcttggctcactgcaacctccgcctcccgggttcaggcaattctcctacctcagcctcccgagtagttgggactataggcgtgcaccatcacgcctcrctaatttttgtatttttagtagagacggggtttcaccatgttggccaggctggtctcatacccctgatctcagccaatctgcccgcctcagcctcccaaa

SEQ ID NO: 79737 - DNA, 201 bp, Homo sapiens; identical to SEQ ID NO: 10349

SEQ ID NO: 79738 - DNA, 201 bp, Homo sapiens
atttccagctgcccatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaa

SEQ ID NO: 79739 - DNA, 201 bp, Homo sapiens; identical to SEQ ID NO: 10350

SEQ ID NO: 79740 - DNA, 201 bp, Homo sapiens
cggagtctcgctctgtcgcccaggctggagtgcagtggctctatctcggctcactgcaacctccgcctcccgggttcacaccattctcctgcctcaggctyccaagtagctgggactacaggcgcccgccaccacgcccggctaattttttttaatatatatttttagtagagacaggggtttcacagtgttagacaagat

SEQ ID NO: 79741 - DNA, 201 bp, Homo sapiens
tgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacat

SEQ ID NO: 79742 - DNA, 201 bp, Homo sapiens; identical to SEQ ID NO: 54324

SEQ ID NO: 79743 - DNA, 201 bp, Homo sapiens; identical to SEQ ID NO: 54325

SEQ ID NO: 79744 - DNA, 201 bp, Homo sapiens; identical to SEQ ID NO: 54326

SEQ ID NO: 79745 - DNA, 201 bp, Homo sapiens; identical to SEQ ID NO: 54327

SEQ ID NO: 79746 - DNA, 201 bp, Homo sapiens
ggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctct

SEQ ID NO: 79747 - DNA, 201 bp, Homo sapiens
cctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatg

SEQ ID NO: 79748 - DNA, 201 bp, Homo sapiens
tgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctc

SEQ ID NO: 79749 - DNA, 201 bp, Homo sapiens
cccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcc

SEQ ID NO: 79750 - DNA, 201 bp, Homo sapiens
agtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctagggtatcagaa

SEQ ID NO: 79751 - DNA, 201 bp, Homo sapiens
agaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggaggggagggtacagcctggagg

SEQ ID NO: 79752 - DNA, 201 bp, Homo sapiens
gtgattcaggagaggagggtacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagc

SEQ ID NO: 79753 - DNA, 201 bp, Homo sapiens
tttaaaaattccatagcaatgggtaagaaggtttaaaggctggggccggcagcctcaggatgcgtctcagagaagagctggtggccttggctcttcccacygccccagcctccctccttcttggttcgtgacctcatttccctcacagacatccactggccacccctggcttctggtgtccatgaaggtcctgtccagctt

SEQ ID NO: 79754 - DNA, 201 bp, Homo sapiens
aggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattc

SEQ ID NO: 79755 - DNA, 201 bp, Homo sapiens
aggatgcacctgggcatcacaggggcgacaaatgaaaaccgcggggcctcaggggacgggaatcacgcatgtggctgcaggatctgccgcaggtgcctttrcatttcggggctggggcaggggaagggcggtgggtgagtctgtttccagttgtgagtcttgcccccgtctcctccgtcatcctggtctcccgctgctccc

SEQ ID NO: 79756 - DNA, 201 bp, Homo sapiens; identical to SEQ ID NO: 54336

SEQ ID NO: 79757 - DNA, 201 bp, Homo sapiens; identical to SEQ ID NO: 54338

SEQ ID NO: 79758 - DNA, 201 bp, Homo sapiens
tctcccatctctctgtagcactgagatttctgccactaacctctcttctttctgctttttcacttttgctttcttgatgcagtgatggccacgggtaagcrgggggtgggggggattgtcagggaatgctgtgatgtcccctcccagccagtctctgttcaacccagaagctcctcacctcaagctccagacatgcctcct

SEQ ID NO: 79759 - DNA, 201 bp, Homo sapiens; identical to SEQ ID NO: 54340

SEQ ID NO: 79760 - DNA, 201 bp, Homo sapiens
ggggagcaggcccaggcatggtccccgtttcttggagtggaagggagaccagctctggccatctggaggagacccatggtgtcagatgccttggctgggcrtcaggggcaggttctttgacctttccctctctctgagcacagcaggaggtagatgtgacagagccgcttcccgcaggcagtgtggtgacagggaccctga

SEQ ID NO: 79761 - DNA, 201 bp, Homo sapiens; identical to SEQ ID NO: 54341

SEQ ID NO: 79762 - DNA, 201 bp, Homo sapiens
cggtgaaaccccgtctctactaaaaatacaaaaaattagccgggcgtagtggcgggcgcctgtagtcccagctacttgggaggctgaggcaggagaatggygtgaacccgggaggcggagcttgcagtgagccgagatcccgccactgcactccagcctgggcgacagagcgagactccgtctcaaaaaaaaaaaaaaaaa

SEQ ID NO: 79763 - DNA, 201 bp, Homo sapiens; identical to SEQ ID NO: 10353

SEQ ID NO: 79764 - DNA, 201 bp, Homo sapiens; identical to SEQ ID NO: 54285

SEQ ID NO: 79765 - DNA, 201 bp, Homo sapiens; identical to SEQ ID NO: 79466

SEQ ID NO: 79766 - DNA, 201 bp, Homo sapiens; identical to SEQ ID NO: 54250

SEQ ID NO: 79767 - DNA, 201 bp, Homo sapiens; identical to SEQ ID NO: 54294

SEQ ID NO: 79768 - DNA, 201 bp, Homo sapiens; identical to SEQ ID NO: 54254

SEQ ID NO: 79769 - DNA, 201 bp, Homo sapiens; identical to SEQ ID NO: 54302

SEQ ID NO: 79770 - DNA, 201 bp, Homo sapiens; identical to SEQ ID NO: 54305

SEQ ID NO: 79771 - DNA, 201 bp, Homo sapiens; identical to SEQ ID NO: 54308

SEQ ID NO: 79772 - DNA, 201 bp, Homo sapiens; identical to SEQ ID NO: 54309

SEQ ID NO: 79773 - DNA, 201 bp, Homo sapiens; identical to SEQ ID NO: 54311

SEQ ID NO: 79774 - DNA, 201 bp, Homo sapiens; identical to SEQ ID NO: 79433

SEQ ID NO: 79775 - DNA, 201 bp, Homo sapiens; identical to SEQ ID NO: 79434

SEQ ID NO: 79776 - DNA, 201 bp, Homo sapiens; identical to SEQ ID NO: 54257

SEQ ID NO: 79777 - DNA, 201 bp, Homo sapiens; identical to SEQ ID NO: 54258

SEQ ID NO: 79778 - DNA, 201 bp, Homo sapiens; identical to SEQ ID NO: 54259

SEQ ID NO: 79779 - DNA, 201 bp, Homo sapiens; identical to SEQ ID NO: 54315

SEQ ID NO: 79780 - DNA, 201 bp, Homo sapiens; identical to SEQ ID NO: 79356

SEQ ID NO: 79781 - DNA, 201 bp, Homo sapiens; identical to SEQ ID NO: 54317

SEQ ID NO: 79782 - DNA, 201 bp, Homo sapiens; identical to SEQ ID NO: 54319

SEQ ID NO: 79783 - DNA, 201 bp, Homo sapiens; identical to SEQ ID NO: 54320

SEQ ID NO: 79784 - DNA, 201 bp, Homo sapiens; identical to SEQ ID NO: 54321

SEQ ID NO: 79785 - DNA, 201 bp, Homo sapiens; identical to SEQ ID NO: 54261

SEQ ID NO: 79786 - DNA, 201 bp, Homo sapiens; identical to SEQ ID NO: 79362

SEQ ID NO: 79787 - DNA, 201 bp, Homo sapiens; identical to SEQ ID NO: 79363

SEQ ID NO: 79788 - DNA, 201 bp, Homo sapiens; identical to SEQ ID NO: 54264

SEQ ID NO: 79789 - DNA, 201 bp, Homo sapiens; identical to SEQ ID NO: 54329

SEQ ID NO: 79790 - DNA, 201 bp, Homo sapiens; identical to SEQ ID NO: 54332

SEQ ID NO: 79791 - DNA, 201 bp, Homo sapiens; identical to SEQ ID NO: 54333

SEQ ID NO: 79792 - DNA, 201 bp, Homo sapiens; identical to SEQ ID NO: 79446

SEQ ID NO: 79793 - DNA, 201 bp, Homo sapiens; identical to SEQ ID NO: 54266

SEQ ID NO: 79794 - DNA, 201 bp, Homo sapiens; identical to SEQ ID NO: 54267

SEQ ID NO: 79795 - DNA, 201 bp, Homo sapiens; identical to SEQ ID NO: 54268

SEQ ID NO: 79796 - DNA, 201 bp, Homo sapiens; identical to SEQ ID NO: 79451

SEQ ID NO: 79797 - DNA, 201 bp, Homo sapiens; identical to SEQ ID NO: 79423

SEQ ID NO: 79798 - DNA, 201 bp, Homo sapiens; identical to SEQ ID NO: 10345

SEQ ID NO: 79799 - DNA, 201 bp, Homo sapiens; identical to SEQ ID NO: 54270

SEQ ID NO: 79800 - DNA, 201 bp, Homo sapiens; identical to SEQ ID NO: 54272

SEQ ID NO: 79801 - DNA, 201 bp, Homo sapiens; identical to SEQ ID NO: 54277

SEQ ID NO: 79802 - DNA, 201 bp, Homo sapiens; identical to SEQ ID NO: 54279

SEQ ID NO: 79803 - DNA, 201 bp, Homo sapiens; identical to SEQ ID NO: 54280

SEQ ID NO: 79804 - DNA, 201 bp, Homo sapiens; identical to SEQ ID NO: 54281

SEQ ID NO: 79805 - DNA, 201 bp, Homo sapiens; identical to SEQ ID NO: 54337

SEQ ID NO: 79806 - DNA, 201 bp, Homo sapiens; identical to SEQ ID NO: 54282

SEQ ID NO: 79807 - DNA, 201 bp, Homo sapiens; identical to SEQ ID NO: 54284

SEQ ID NO: 79808 - DNA, 201 bp, Homo sapiens; identical to SEQ ID NO: 56652

SEQ ID NO: 79809 - DNA, 201 bp, Homo sapiens
atatccacggatccaaccctaagtgactctcaaacctaccctctccctcaatttgtgacccagccccaaactccatcattgctctcctgtccctcaccatrtatcccttcttttgctcagtctgggccggggccctgtgccgctgaagacatggagtttgtgtctggataccgggatgagttccttgatttcactgccctt

SEQ ID NO: 79810 - DNA, 201 bp, Homo sapiens; identical to SEQ ID NO: 56654

SEQ ID NO: 79811 - DNA, 201 bp, Homo sapiens
tggccaggctggtctcgaactcctgacctcaggtgatccgcccgcatcggaaaaggagttagggatgacttactttcccccagacccttttagtcccctcracggctgtcatttctttaactcacagtcagggattgtgaccctccttggtaatcccatggttctcctaattatgtgttggctagtcactttccagccccg

SEQ ID NO: 79812 - DNA, 201 bp, Homo sapiens
atcctcgaaggcccacctctaccctagtccctgctgtcctggggccctcctgcccccagcccagcaacctgccttctctgtccccactactcgtcgccccsatgggaggtctcgacatcccccagcacacccctctttagatctagctcacggaatctccccaacccacaaaagaccccgcgaccctccaacagacccaac

SEQ ID NO: 79813 - DNA, 201 bp, Homo sapiens
cagcactttgggaggccaacttgagcccaggaatttgagatcagcctgggcaacatagactctgtctctacaaaaaatagaaaaaattagtcaggcatggkgcactcgcttgtggtcacaattctcgggagactgaggtgggagaatcgtttgagtccaagaggtcgaggctgtagtgtcccgtgatcacgccactgcact

SEQ ID NO: 79814 - DNA, 201 bp, Homo sapiens; identical to SEQ ID NO: 56658

SEQ ID NO: 79815 - DNA, 201 bp, Homo sapiens; identical to SEQ ID NO: 56660

SEQ ID NO: 79816 - DNA, 201 bp, Homo sapiens
ggaaccacaggcagaggctgaaggaagagtcactgtatagagcctctggaaggtcagcagggcacaaacaccacagcacagcacctaaatccccggaatcrgtgtcacacggggggcagggatccccccatttctcaggggacacagtgtggttttgagaggcattgagaatcccaaggaacccaaaaatgtggctctgta

SEQ ID NO: 79817 - DNA, 201 bp, Homo sapiens; identical to SEQ ID NO: 56662

SEQ ID NO: 79818 - DNA, 201 bp, Homo sapiens; identical to SEQ ID NO: 56663

SEQ ID NO: 79819 - DNA, 201 bp, Homo sapiens; identical to SEQ ID NO: 56664

SEQ ID NO: 79820 - DNA, 201 bp, Homo sapiens; identical to SEQ ID NO: 56666

SEQ ID NO: 79821 - DNA, 201 bp, Homo sapiens; identical to SEQ ID NO: 56669

SEQ ID NO: 79822 - DNA, 201 bp, Homo sapiens
cccctaccaactccacccagaaaccccatccctatgcaaacccccattcctcttactgcggctgtctcagggaatacagcccctttggaaggaagaaagaratgggtcaggtgggggtctccctgaccccaggcccctccttctttcatcctctcaggagacccctaccagcttctccagggagacgggactgccctgatg

SEQ ID NO: 79823 - DNA, 201 bp, Homo sapiens; identical to SEQ ID NO: 56673

SEQ ID NO: 79824 - DNA, 201 bp, Homo sapiens; identical to SEQ ID NO: 56674

SEQ ID NO: 79825 - DNA, 201 bp, Homo sapiens; identical to SEQ ID NO: 56675

SEQ ID NO: 79826 - DNA, 201 bp, Homo sapiens
taaaagcctgggtctcagggttaggcatgtggggaaggtgggagagaagcccaccgtgggagccagcttctccctcctctctgtctgcaggatttaactcygggtttgctctcaaggatacgtggctgaggtctctgccccggttacaggtgggcaatgggggcaaaagggaacttctctcccctcctgcctggcccctcc

SEQ ID NO: 79827 - DNA, 201 bp, Homo sapiens; identical to SEQ ID NO: 56678

SEQ ID NO: 79828 - DNA, 201 bp, Homo sapiens
gaaaaaattagtcaggcatggtgcactcgcttgtggtcacaattctcgggagactgaggtgggagaatcgtttgagtccaagaggtcgaggctgtagtgtyccgtgatcacgccactgcactctagcttgggtgatagagcaagactctgtctcaaaaaaaaaaaaatgtctggggttctagcccagcacctcaactcctc

SEQ ID NO: 79829 - DNA, 201 bp, Homo sapiens
agagggtgtaagacaaacagaccgagtgacatatgggcagctgctgggcagttgaacagcagacaggacctacagaggttaacactaggtgcccaccaccygctgtgtccccagcccccagtgtagtgctgtcttgtattgtggagaggcttgtctccgggctgactggcagcggtgcccagatgatgtgagtcaccgatt

SEQ ID NO: 79830 - DNA, 201 bp, Homo sapiens; identical to SEQ ID NO: 56685

SEQ ID NO: 79831 - DNA, 201 bp, Homo sapiens; identical to SEQ ID NO: 56686

SEQ ID NO: 79832 - DNA, 201 bp, Homo sapiens; identical to SEQ ID NO: 56687

SEQ ID NO: 79833 - DNA, 201 bp, Homo sapiens; identical to SEQ ID NO: 56689

SEQ ID NO: 79834 - DNA, 201 bp, Homo sapiens
attacaggcttgagccaccgtgcccggtctaattttgtatttttagcacagatagggtttcaccatgttgcccaggctagtctcgaactcccgtcctcagsggatccaccctccgtggcctcccaaagtgcttagattacaggcgtgagccacagcgcctggccaatttcaattttttaaaatgtattggggttggtttga

SEQ ID NO: 79835 - DNA, 201 bp, Homo sapiens; identical to SEQ ID NO: 56692

SEQ ID NO: 79836 - DNA, 201 bp, Homo sapiens
tggctctgtatgacttcaatcgtttttcttttttcttttatttttttgagacagagtttcgctcttgtcgcccaggctggagtgcaatggtgcaatctcgkctcactgcaacctccgcctcccgggttcaagcgattcttctgcctcagcctacctagtagctgagattacaggcatgcatcaccacgcctggctaatttt

SEQ ID NO: 79837 - DNA, 201 bp, Homo sapiens; identical to SEQ ID NO: 56693

SEQ ID NO: 79838 - DNA, 201 bp, Homo sapiens
gaacccaggaggcagaggttgcagtgagctgagatcacaccactgcactccagcctgggcaatagagcaagactccatctcaagaaaaaaaaaaaaaaaaagaagtgtggtgggatgggaagggcagcatggatctgtttgggatgctagtctcaacccagcctcatggactgacgtctgagccctgcaagaggaaccaca

SEQ ID NO: 79839 - DNA, 201 bp, Homo sapiens; identical to SEQ ID NO: 56697

SEQ ID NO: 79840 - DNA, 201 bp, Homo sapiens
ctgatgtaaaatgtatttcttactgtggaccatgttcaaagcatctgaaaggctgggtgcagtggcctgtaaacccagcactttgggaggctgacgttgtrggatcacttgaggtcaggagttcaagaccagcctgggcaacatattgagacttcatctctactttttaaaaaaaaaaatctgaaggtgtctggcttagag

SEQ ID NO: 79841 - DNA, 201 bp, Homo sapiens
cgtgctcgaacctgccatgtgtgtcacaggcacagctttgaagcgaagctgacaccttggtgagcagccccaaagctgggggagaggaagaccccaatagrcaaatagaaggaaggcagggtggtggggggcgcctagcagacagaaggagaggcagggacatgagaagatgcagaggaaacaatacagactgttacaggc

SEQ ID NO: 79842 - DNA, 201 bp, Homo sapiens
ggctagagcctagatccctggaacaagggcaggggctgggtgtttggggctggagacagggtctctgaagccgaggcctgagtgtctgggtccctgagagmgtgcagggattgggggacagggattcaaacacttacttgcttcccagctccaccactaactgcagtgtgaccttaaacaaaccactttacttcttgaagc

SEQ ID NO: 79843 - DNA, 201 bp, Homo sapiens
ccgaggcctgagtgtctgggtccctgagagcgtgcagggattgggggacagggattcaaacacttacttgcttcccagctccaccactaactgcagtgtgrccttaaacaaaccactttacttcttgaagcttccgtgtcctcatgagggatacggagaaggcccatggaattgttacaaggattatcttggcttggtgcc

SEQ ID NO: 79844 - DNA, 201 bp, Homo sapiens
acccccattcctcttactgcggctgtctcagggaatacagcccctttggaaggaagaaagagatgggtcaggtgggggtctccctgaccccaggcccctcyttctttcatcctctcaggagacccctaccagcttctccagggagacgggactgccctgatgcctcctgtgcccccacatccaccccggggtgtttttggt

SEQ ID NO: 79845 - DNA, 201 bp, Homo sapiens
tcacccctaccaactccacccagaaaccccatccctatgcaaacccccattcctcttactgcggctgtctcagggaatacagcccctttggaaggaagaargagatgggtcaggtgggggtctccctgaccccaggcccctccttctttcatcctctcaggagacccctaccagcttctccagggagacgggactgccctg

SEQ ID NO: 79846 - DNA, 201 bp, Homo sapiens; identical to SEQ ID NO: 56701

SEQ ID NO: 79847 - DNA, 201 bp, Homo sapiens
cagatgaggttagacacccctctccctattaagccctcatagcaccttgcatatgccctttgatgacctttatcacacaatttcttgtctaccctttcaayggtcaacccagaaggggtgggtgctacctctatcccccagggtctagcctggccgggcatatggcagcatacagtaggagctcgttaactgcttatcaga

SEQ ID NO: 79848 - DNA, 201 bp, Homo sapiens
taggaaaggatgtggttatctcccagtggtggggttactaaggatttgtttattcattttatttagctggactgctcatttttcttccatgaacacaagtrcttttgtaataaaaatgcttaatatacaaattgctctttaataattcacttaccaactattgattgaatacacaaggctttgtgccgaaccttagcgacg

SEQ ID NO: 79849 - DNA, 201 bp, Homo sapiens
agcggtgcccagatgatgtgagtcaccgattttggtgcccaaggcttgcagccttcatggagcgggcaggagaactggcaaccctgccttttacctacacygcaggtaccataaggaggtcagaatggttgggggaaactgggaccaggtctttgagactgggaattagatgtctgggaacagggtcctgcagttgaaggc

SEQ ID NO: 79850 - DNA, 201 bp, Homo sapiens
tggtcccaaggctaggtgtgaagttagccaaaaccccaatgcggacatggggtccccggccaggcttcacctttgcttcccttcgtgctcgaacctgccaygtgtgtcacaggcacagctttgaagcgaagctgacaccttggtgagcagccccaaagctgggggagaggaagaccccaataggcaaatagaaggaaggca

SEQ ID NO: 79851 - DNA, 201 bp, Homo sapiens; identical to SEQ ID NO: 56655

SEQ ID NO: 79852 - DNA, 201 bp, Homo sapiens
ggaaatgaatgctgataccctagtagtccccagctcccaaacactgaaaggaaaacgtgaaaacactcaaggcctagggggaggacaggttggtaaaacaygaaaaggtaaataaaattacttgtttgaaaccactgagtcatggatcttttgattacacgctcataattgggccattaaactgggaacgaagagaaagat

SEQ ID NO: 79853 - DNA, 201 bp, Homo sapiens
tgtagcccaccttttgtttttgcatggctcgtaatctaataatcagatttcacagccgggctcatgcctgtaatcccatcacgcctgtaatcccagcactytgggcgcccgaggcaggcggatcacgagttcaggagatcgagaccatcctggctaacacggtgaaaccccgtctctactaaaaatacaaaaacaaaaaat

SEQ ID NO: 79854 - DNA, 201 bp, Homo sapiens
tggagaacgaaacaagaccccagaagaggaagggacagaggagtggtaagaacccagggctggccctgccctaccccttgcccagccatcctcccttcggragccctcccctgccactagttctgagtgctggccttcaggccaatctggcctgaaaaggtgtttttattgacccacagtggggtttttttttttaattta

SEQ ID NO: 79855 - DNA, 201 bp, Homo sapiens
gcatggctcgtaatctaataatcagatttcacagccgggctcatgcctgtaatcccatcacgcctgtaatcccagcactttgggcgcccgaggcaggcggwtcacgagttcaggagatcgagaccatcctggctaacacggtgaaaccccgtctctactaaaaatacaaaaacaaaaaattagccgggcttggtggcgggt

SEQ ID NO: 79856 - DNA, 201 bp, Homo sapiens
cagccgggctcatgcctgtaatcccatcacgcctgtaatcccagcactttgggcgcccgaggcaggcggatcacgagttcaggagatcgagaccatcctgkctaacacggtgaaaccccgtctctactaaaaatacaaaaacaaaaaattagccgggcttggtggcgggtacctgtagtcccagctacttgggaggctgag

SEQ ID NO: 79857 - DNA, 201 bp, Homo sapiens
gcgccactgcactccagcctgggtgacagagcgagactccgtctcaaaaaaaaaaaaaaagaagatttcacgagaaaattattcgaaattcaaattacagkgtctataaatttatattgaagcagagccacaaccatttctttctgtattgtccgtggttactttctggatgcaaacggcagggtttgagtgccgcaattg

SEQ ID NO: 79858 - DNA, 201 bp, Homo sapiens; identical to SEQ ID NO: 56670

SEQ ID NO: 79859 - DNA, 201 bp, Homo sapiens; identical to SEQ ID NO: 56672

SEQ ID NO: 79860 - DNA, 201 bp, Homo sapiens
accctccactccacctgcgagacctgagcccctacatcagctttgtcagcctagaggatggggaggaaggggaggaggaagaggaggaagatgaagaagargagaagagagaggacgggggtgcaggcagcacagagaaggtggaaccagaggaggaccgggagctagcccctaccagcagggagtccccccaggaaacaa

SEQ ID NO: 79861 - DNA, 201 bp, Homo sapiens
ctcagcatgctgattccaggcccgggcttctccagacacccccgaggcaacacgccatccctcagccttcttcgcggtggtgcgtggggtctctccaggcrtgggccccttggcctagagggaaggactgggaagaagttgtctgggtcccagatgatccctccacatacacactgacccctaccaacagcaccagggcca

SEQ ID NO: 79862 - DNA, 201 bp, Homo sapiens; identical to SEQ ID NO: 56682

SEQ ID NO: 79863 - DNA, 201 bp, Homo sapiens; identical to SEQ ID NO: 56684

SEQ ID NO: 79864 - DNA, 201 bp, Homo sapiens
ctaccggggctgcccgccacgcagatccgagcccagggaaccccctcgctcccactcccataccccacagacgcatccaaaatgcttccctccccaccaarccgttcccgataggattagccctctctcctctctagccttaatttaaactctgcttttgagggtgtgaactctccaattttaagccccaaataccatctc

SEQ ID NO: 79865 - DNA, 201 bp, Homo sapiens
ttttggtgagctggaggggccctgtggaagctaggggtagggccagggactggagaaccagagcctgggtggctgtgaagaagaggtttgttagactagarggggtgggggtccagggccaggtcctctagcaaccctctcctgccaggctcatggcaggattactacacatggcggggcctcagcttggactcccccata

SEQ ID NO: 79866 - DNA, 201 bp, Homo sapiens; identical to SEQ ID NO: 56695

SEQ ID NO: 79867 - DNA, 201 bp, Homo sapiens; identical to SEQ ID NO: 56696

SEQ ID NO: 79868 - DNA, 201 bp, Homo sapiens
agctggaggggccctgtggaagctaggggtagggccagggactggagaaccagagcctgggtggctgtgaagaagaggtttgttagactagagggggtggsggtccagggccaggtcctctagcaaccctctcctgccaggctcatggcaggattactacacatggcggggcctcagcttggactcccccatagccgtgct

SEQ ID NO: 79869 - DNA, 201 bp, Homo sapiens; identical to SEQ ID NO: 56704

SEQ ID NO: 79870 - DNA, 201 bp, Homo sapiens
gttctagcccagcacctcaactcctccccttctccttctccagaggtgaccagtgaaaccttcaacaaagaggccttcctggcctctcggggcctcactcrtggctattggacccagctcagcatgctgattccaggcccgggcttctccagacacccccgaggcaacacgccatccctcagccttcttcgcggtggtgcg

SEQ ID NO: 79871 - DNA, 201 bp, Homo sapiens; identical to SEQ ID NO: 56707

SEQ ID NO: 79872 - DNA, 201 bp, Homo sapiens; identical to SEQ ID NO: 56708

SEQ ID NO: 79873 - DNA, 201 bp, Homo sapiens; identical to SEQ ID NO: 56710

SEQ ID NO: 79874 - DNA, 201 bp, Homo sapiens
caggatttaactccgggtttgctctcaaggatacgtggctgaggtctctgccccggttacaggtgggcaatgggggcaaaagggaacttctctcccctcckgcctggcccctccccatctccttttctgaaagtctctgggctctcctcctcttcaccatcacctgctccacaaacctggggagtgcccacgggtccccct

SEQ ID NO: 79875 - DNA, 201 bp, Homo sapiens; identical to SEQ ID NO: 56712

SEQ ID NO: 79876 - DNA, 201 bp, Homo sapiens
ttagctggactgctcatttttcttccatgaacacaagtgcttttgtaataaaaatgcttaatatacaaattgctctttaataattcacttaccaactattsattgaatacacaaggctttgtgccgaaccttagcgacgcaatggggaaaaaagacacataatggtctctgcctccataaagcttacagtttagggcaggg

SEQ ID NO: 79877 - DNA, 201 bp, Homo sapiens; identical to SEQ ID NO: 57971

SEQ ID NO: 79878 - DNA, 201 bp, Homo sapiens; identical to SEQ ID NO: 57976

SEQ ID NO: 79879 - DNA, 201 bp, Homo sapiens; identical to SEQ ID NO: 57977

SEQ ID NO: 79880 - DNA, 201 bp, Homo sapiens; identical to SEQ ID NO: 57979

SEQ ID NO: 79881 - DNA, 201 bp, Homo sapiens
taaatggatttttttctataaaattggctgtaagccagagtatatcaggtactataaatacatcactaatttgaaacaaataatggctcaggcaatcccctgtctggaatatttccagtggtggaatgggttttgctttgggttgcgtgcacgcgcacgcacgtgtgtgtcttcgctttactgtttttctgttctaatttt

SEQ ID NO: 79882 - DNA, 201 bp, Homo sapiens
aaggtctcttatggtcttgtatgtagtattgaatccccttgaatatattgtttagcagttttgatcattatgtatttgcttcttgctcctcaaaattgtaygttagttagtaggtccttcagcaaaagaagactgaagatagtattttggttttattcttgtttttaatttttttagttgtctccaacttttctgcctcta

SEQ ID NO: 79883 - DNA, 201 bp, Homo sapiens
ccaatcaaaagaattacgtgctcttctagtaagtgtttagagactgtttcacgttctccaggtaacaccgccattactcggcggtccagatggcagtcttrcttcagggagtctactccacttgcaggacctctttgattgagttcactaaacctcacagggccgccttccccgtgttccagttagcaaggggccctcaac

SEQ ID NO: 79884 - DNA, 201 bp, Homo sapiens
ctgattcactggaaatatactacgaccatctggaatgtactttaatcttatcctaataaatcaccttactacaagacactcctttggggatgaacaggttygataaagccggctaaggacagaccaatcaaaagaattacgtgctcttctagtaagtgtttagagactgtttcacgttctccaggtaacaccgccattact

SEQ ID NO: 79885 - DNA, 201 bp, Homo sapiens
cactttttgttttcaatttttgagagctcttgtgatacgagttgcaaagattttctccagaccgatctgattcactggaaatatactacgaccatctggartgtactttaatcttatcctaataaatcaccttactacaagacactcctttggggatgaacaggtttgataaagccggctaaggacagaccaatcaaaaga

SEQ ID NO: 79886 - DNA, 201 bp, Homo sapiens
acactactagagtactgtgttcaaaagctcggaggggccagtggtggtggttcattcctgtaatcccagcactttgggaggccaacctgcaggcggatcamctgaggtcaggagttccagaccagcctggccaacatggtgaaatcccatctctattaaaaatacaaaaatcagcaggggatggtggcgcatgcctgtaat

SEQ ID NO: 79887 - DNA, 201 bp, Homo sapiens
attatatttctcttcaccctttatggcgacatcaaatgatttgaatggctgatcagcttttttacgagggaatttgtaaaaactacccaataactctaatratggaagatgttaacaaaggaagatctgggtacagagtatataggaactctgtaatatctttgccacttttttgtaaatctaaaactattttaaaattgt

SEQ ID NO: 79888 - DNA, 201 bp, Homo sapiens
agattgtataaggatattagctgtgatgagactcactgcattattttttttagtgaattttatgaaatccccgttccattcaacaggcacatgtttaaaaragctttgtcgttggtgttaatgggggaatgtgttccttcattgtatttgggccttttgtattgcactcttgatattaaattaaatgtgccttgaaatagt

SEQ ID NO: 79889 - DNA, 201 bp, Homo sapiens
ttctgtttgaagaaaatagagggagaaacagaagtcttaagtctgtggcacactgtgtcttcagacagtttgaaggaatgaaaacctagagattttaaatyatgaattgaacatgtaaaattccagtaaaatgtaaaaacggaatatgcatcgctcttaaccttgagcatagtgacttagagacactgtgtatcagttttg

SEQ ID NO: 79890 - DNA, 201 bp, Homo sapiens
tcaaaatggccaggacttgattaaaacttgacagcttccctactttttgtcctcacttctagcttatgcccatccagagaaagccaaatatgctcctttarccaagaccataggatgccaacttgtagttagcttccagcttccccatgccaacagcttccaatcaggcatacctgtgaaacctttccttttgtccactgt

SEQ ID NO: 79891 - DNA, 201 bp, Homo sapiens
tacatatagaagtcttcttatgtgttattaaagtcttctaagatagtattctggtcattggagacaccaaaaatctatgggcacagtcctgttcctgtttyttttgccaatagaatgttccttaaggttcagtcacagtccttttacttcccttacagagattgtttaaatttccacaaaagcacgtatttactcttcttt

SEQ ID NO: 79892 - DNA, 201 bp, Homo sapiens
gttcaagaccagcctgggcaacatagcaagaccccatctctaaaaaaacaaaaaagcaagcaaaaacacttagccaggtatggtggcaggcacctgtagtyccagcttctgacgaggcacgaggatcacttgagcccaggaggtcaagactgcagtgagccatgtttgtgccactgcactccagcctggatgacagagcaa

SEQ ID NO: 79893 - DNA, 201 bp, Homo sapiens
ggtgggagcatcacttgagcccaggagttcaagaccagcctgggcaacatagcaagaccccatctctaaaaaaacaaaaaagcaagcaaaaacacttagcmaggtatggtggcaggcacctgtagtcccagcttctgacgaggcacgaggatcacttgagcccaggaggtcaagactgcagtgagccatgtttgtgccact

SEQ ID NO: 79894 - DNA, 201 bp, Homo sapiens
ttgaactcctgacctcatgatctgctagcctcggcctcccaaagtgctgggattacaggcgtaagccaccacacccagcctgtaatttcttttacaattargtaagtagcctgtagagtgatactttgatggcatttcccagcaatctttcatctaaaggttttgaagtccattgatagtccttgtctgagtcaattattt

SEQ ID NO: 79895 - DNA, 201 bp, Homo sapiens
atgtgagtttttgttgtttgtttgtttgagatggagtctctgttgcccaggctggaatgcagtggcgcgccatctcggctcactgcaacctccgcctcccrggttcaggcgattcctgcctcagtctccctagtagctgggattacaggcgtgtgccactacgccgggctaatttttttaattttttggtagagaccgagt

SEQ ID NO: 79896 - DNA, 201 bp, Homo sapiens
tgcttgcatgttttcatttctttgagatacatgtttaagagtgcaactgctgagttatatggcacattcatttttagttgtattaataaaaggaactgccwtacttcttcagataccatttttatattctcacctgcagtgtaggaaacttcagtttctctgaatcctcaccagcgtttggtgttgccactaatttttatt

SEQ ID NO: 79897 - DNA, 201 bp, Homo sapiens
agctttttgttttgaaataattatagattcataggaagttgcaaataaatgtacagagaggttctgtgcaactttcactgagcctgcttcattgttaacaycttgcgtgactagcagacatctctaataactgtgaaaatcagggaattgacattggtacaatccacagagcttattcacatttcacgttatactagcact

SEQ ID NO: 79898 - DNA, 201 bp, Homo sapiens; identical to SEQ ID NO: 57989

SEQ ID NO: 79899 - DNA, 201 bp, Homo sapiens
ataaatggatttttttctataaaattggctgtaagccagagtatatcaggtactataaatacatcactaatttgaaacaaataatggctcaggcaatcccctgtctggaatatttccagtggtggaatgggttttgctttgggttgcgtgcacgcgcacgcacgtgtgtgtcttcgctttactgtttttctgttctaattt

SEQ ID NO: 79900 - DNA, 201 bp, Homo sapiens
taatgggggaatgtgttccttcattgtatttgggccttttgtattgcactcttgatattaaattaaatgtgccttgaaatagttggtttttttttttttttaagttcaaagaatattatgatgattttgttgtactctttaacattttaatttggggcggggagggcctgttgagagcagattcattttggaaatactgtt

SEQ ID NO: 79901 - DNA, 201 bp, Homo sapiens
ttcactatgttgccaggttggtcttgaactcctgacctcatgatctgctagcctcggcctcccaaagtgctgggattacaggcgtaagccaccacacccascctgtaatttcttttacaattaggtaagtagcctgtagagtgatactttgatggcatttcccagcaatctttcatctaaaggttttgaagtccattgata

SEQ ID NO: 79902 - DNA, 201 bp, Homo sapiens
ttaaccatttagtttggggctctatattacttgcttgagccttaatcaatgtggttttattcaatggtttgttctttgaatggttgcaaaaactgtagatmatcttactgaggactgtacaaacatgaaggtgtggtatcaaacttcaggttgaaactgtttgaagcattataaacattcatttcacaactagattgtata

SEQ ID NO: 79903 - DNA, 201 bp, Homo sapiens; identical to SEQ ID NO: 57990

SEQ ID NO: 79904 - DNA, 201 bp, Homo sapiens; identical to SEQ ID NO: 57918

SEQ ID NO: 79905 - DNA, 201 bp, Homo sapiens
atgtttggattgtaaagtaaaatgtatgtagccactttaagtcccagatttggagatgtaatcaaatggcctcaattcctaagtgagtaaccttaaataawgttatttttttaattgacaaataagttttttacatattcaaggactactacatagtgatgtttcaatacatataatgtatagtgatcagatcggggtaat

SEQ ID NO: 79906 - DNA, 201 bp, Homo sapiens
aatgtttggattgtaaagtaaaatgtatgtagccactttaagtcccagatttggagatgtaatcaaatggcctcaattcctaagtgagtaaccttaaataaagttatttttttaattgacaaataagttttttacatattcaaggactactacatagtgatgtttcaatacatataatgtatagtgatcagatcggggtaa

SEQ ID NO: 79907 - DNA, 201 bp, Homo sapiens
ttcaagaacttttctgataaagcgctagattccttagtgtaataatactggtatagccaaggtgtgtgttaattaactggctctgtttccatttcaaatgrtaatttgagatgaaaatagatggatttcagaattgattattgatgtaatagaaacaaggtgtagctgtttgggcactttttgtttagggtttatttttac

SEQ ID NO: 79908 - DNA, 201 bp, Homo sapiens
atacatagatacagatactgatataccggttaaatatgtacagctcaaatagctaaaattgtctttaagattttttaaattaaaaatattattggccgggygcagtagcttacacctgtaatcccaacactttgggaggccaaagcaggtggattacctgaggtgaggagttcgagaccagcctggtcaacatggtgaaac

SEQ ID NO: 79909 - DNA, 201 bp, Homo sapiens
attttcgtttgttttttggtaatgtttggattgtaaagtaaaatgtatgtagccactttaagtcccagatttggagatgtaatcaaatggcctcaattccwaagtgagtaaccttaaataaagttatttttttaattgacaaataagttttttacatattcaaggactactacatagtgatgtttcaatacatataatgta

SEQ ID NO: 79910 - DNA, 201 bp, Homo sapiens
ggttaattgcaaagatgatcagtagccaagtaatttcttctgaactacctaccttttcaaaatcttcaggaattatttcctgtgacttttgtccttttatrtgtaacagtccttggttgagaacatgggcctctttggagtgttatagaggaccacactatccttaaggatcagacttgctatggaactaaggcactggat

SEQ ID NO: 79911 - DNA, 201 bp, Homo sapiens
tttccccaccttcttatgtatgtttcctttgatttggtcgtaattgtttcttttgctttgcacagactcaaatccagtacctcaagcaagtccagcagcckagcgttgcccaactgagatcaacaatggtagacccagcgatcaacttgtttttcctaaaaatgaaaggtgaactggaacagactaaagacaaactggaac

SEQ ID NO: 79912 - DNA, 201 bp, Homo sapiens
ccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggctcat

SEQ ID NO: 79913 - DNA, 201 bp, Homo sapiens
agtcctgttcctgtttcttttgccaatagaatgttccttaaggttcagtcacagtccttttacttcccttacagagattgtttaaatttccacaaaagcaygtatttactcttctttcacttgttactaaatgacttcttcacattttactttgctaaaggctggcttttatcattttctttacttttttttcccactaac

SEQ ID NO: 79914 - DNA, 201 bp, Homo sapiens
ctaatgatgtaactggcctaagagagtctgaagaaaaactaaagcaacaacagcaggagtctgcacgcagggaaaacatccttgtaatgcgactagcaacyaaggaacaagagatgcaagagtgtactgtaagtatttcaagttatataaatgtctttagttgaggaattggtttttagtccacattattacatgttaatt

SEQ ID NO: 79915 - DNA, 201 bp, Homo sapiens
tccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggctca

SEQ ID NO: 79916 - DNA, 201 bp, Homo sapiens
taggctgggtgtggtgactcaggcctgtaatttcagcagtttgggaggccagggtgtgaggatcatttgagctcgggagttcaagaccagcctgggcaacrtagtgagaccccatctctacaaaaaaatgagccatgtgcctttggtcccagctatacaggaagctgaggcagggacatcgcttgagcccagaccctgttt

SEQ ID NO: 79917 - DNA, 201 bp, Homo sapiens
gtccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggctc

SEQ ID NO: 79918 - DNA, 201 bp, Homo sapiens
taatgtgcattttcctaatgatgatgcccattgttaagataccaaatagtttaccttaaaaaaaaaaaacttttgtaataaaatactttttcaaaaaatcrtaatatgtactgagccgtttaaatctcacacttgggagatgtttcataggtctcattatagaactttgtgtcttcaggaagaacactaaattcatattgt

SEQ ID NO: 79919 - DNA, 201 bp, Homo sapiens
agtccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggct

SEQ ID NO: 79920 - DNA, 201 bp, Homo sapiens
ttgatggggagaagaaactattaattaaatgcccattttgtgccagttaccatgctaaagattaatgtctgtcttcagaaatagcacagtatttgggcccyggttgtggtaattctttttgagatggggaaactgaggtgcagagattttgctacttttgtatttgcaaagttgacaacctgtttcagaataccaaggtta

SEQ ID NO: 79921 - DNA, 201 bp, Homo sapiens; identical to SEQ ID NO: 57992

SEQ ID NO: 79922 - DNA, 201 bp, Homo sapiens
aattgttacttcagagtgttatataaatgtaatcatgtagtatgcatctttttgagactattttttttccttccacttagcacagtttccttaaggcttayacaaattgtttcatgtatcagtagtcctgtttctttttattgcttaaagtgttccatggtgtggctgtatgatagttcaatcatttgcctgttaaaggac

SEQ ID NO: 79923 - DNA, 201 bp, Homo sapiens
cagatagaggataaggaaaagatggcctttcagttcctcatcagtaccttgctactacagtgtctgcagattggtgtcttacattcagctatgatttgttygccaaggtaccgtgtcttcttactgaagttgttttggctggcgcttgcctccgttcagagggaactgagttacctaactttatgatgctaagagccagga

SEQ ID NO: 79924 - DNA, 201 bp, Homo sapiens; identical to SEQ ID NO: 57993

SEQ ID NO: 79925 - DNA, 201 bp, Homo sapiens
cccagttttttcttccttgaatattttccttctacagttggttgaattcattgttgcatgtggagggccaactgtatattattttaagtatctgacttccyccaaaacaaactcagtcatattttaagattccaagcaaaatttttaaatgtagtgtgattttagaattgtatttgtttacttgagcgtttattgactccc

SEQ ID NO: 79926 - DNA, 201 bp, Homo sapiens; identical to SEQ ID NO: 57920

SEQ ID NO: 79927 - DNA, 201 bp, Homo sapiens
actagagcccgggaggtcaaggctgctgcagtgagccctgattgtgccactggactcctgcctgggtaacagaataagatcctgcctcaagtttaaaatayaaattgtccagcagttattactattttatttatttatttgtttgtttgagacagggtctcgcactgttgcccaggctggagtgcagtggcacaatctggg

SEQ ID NO: 79928 - DNA, 201 bp, Homo sapiens
tctcaaatctccccctgttgtgcattcctaccttgagtttaattactcttacatacacacacatacacacacacagtggctgttataaaagaggtaacatygtctctaggaggaatttgtgattcaattgggaaagcttactaaacttaatatttaagtgaataatttagatattacagaagtttcctattgtggagtcag

SEQ ID NO: 79929 - DNA, 201 bp, Homo sapiens; identical to SEQ ID NO: 58000

SEQ ID NO: 79930 - DNA, 201 bp, Homo sapiens
ttctgagacagagtctcactctgttgcccatgctggagtgcagtggtacaatcttggctcattgtggcctcataccccagcttatgcgatcctcccacctytgccccccaaagtagctcagactacaggtgtgccactacgcctggctaatttttgtattttttggtagagatggggttttgccatgttacccaggctgat

SEQ ID NO: 79931 - DNA, 201 bp, Homo sapiens; identical to SEQ ID NO: 58001

SEQ ID NO: 79932 - DNA, 201 bp, Homo sapiens; identical to SEQ ID NO: 57925

SEQ ID NO: 79933 - DNA, 201 bp, Homo sapiens; identical to SEQ ID NO: 58002

SEQ ID NO: 79934 - DNA, 201 bp, Homo sapiens
agatttgatatctgggttctaagactttgcagcctaatgcatgtgtcatgctaaaatagaagtagttagacatgtggagttaaatatggtgatggtttctsagatgattaaaatgactgccaccaggttaaggtagttacaaagcagctttctgtaatggcagcagagataataaactgggcaacaagggaggaaccaatt

SEQ ID NO: 79935 - DNA, 201 bp, Homo sapiens
gcttttttccactgggttgtcagcatttttagtaaatataatgttgattttcgtttgttttttggtaatgtttggattgtaaagtaaaatgtatgtagccwctttaagtcccagatttggagatgtaatcaaatggcctcaattcctaagtgagtaaccttaaataaagttatttttttaattgacaaataagttttttac

SEQ ID NO: 79936 - DNA, 201 bp, Homo sapiens
accaagcgcagctaatttcttaatttttgtagagatgaggtcttccctatgttgcccaggctggtcttgaactgctgtactttggcaatccttactccttkgcctcccaaaactgttgggattataggtgtgagccatcgcacctggcccattatcattttctctaccttcttaacacattttgtccttttgtttctatca

SEQ ID NO: 79937 - DNA, 201 bp, Homo sapiens
tgccttagtaactagataaaaggtataccacctagccatagtgataaatatagctgttttcaaactgtcattcacagatctctaccacagtacctgttacrtgaagttcctggttggttctcaaaattttatgttcgtatatacatagatacagatactgatataccggttaaatatgtacagctcaaatagctaaaattg

SEQ ID NO: 79938 - DNA, 201 bp, Homo sapiens; identical to SEQ ID NO: 10880

SEQ ID NO: 79939 - DNA, 201 bp, Homo sapiens
agtcctccaacagctcagaggagagaactggcagaggaggtagtggttacgtaaatcaactcagtgcggggtatgaaagtgtagactctcccacgggcagkgaaaactctctcacacaccaatcaaatgacacagactccagtcatgaccctcaagaggagaaagcagtgagtgggaaaggtaatcgaactgtgggttccc

SEQ ID NO: 79940 - DNA, 201 bp, Homo sapiens
ctcaaatctccccctgttgtgcattcctaccttgagtttaattactcttacatacacacacatacacacacacagtggctgttataaaagaggtaacattrtctctaggaggaatttgtgattcaattgggaaagcttactaaacttaatatttaagtgaataatttagatattacagaagtttcctattgtggagtcaga

SEQ ID NO: 79941 - DNA, 201 bp, Homo sapiens
gctgcgcggtggcccggggggcccgggcggcagggcaagcagcgcggcctcggcctatgcgaccggtggcgccggcgcggcttctgcctggagaggtaggygcgggccggctggcgggagcggacgcgggggacctccggggcctgagggctgatgcgcagccgcccccggcgggtaaggggcgggcagggcccgaaaggc

SEQ ID NO: 79942 - DNA, 201 bp, Homo sapiens
aagacagagagttttgtcttcattttgtgatggatggctctttcctttgcagccaaacagggaaaaagttaatggcgaagtgtcgaatgcttatccaggaraatcaagagcttggaaggcagctgtcccagggacgtattgcacaacttgaagcagagttggctttacagaagaaatacagtgaggagcttaaaagcagtc

SEQ ID NO: 79943 - DNA, 201 bp, Homo sapiens
tttttatatttttctgtacttctaaaataaatcgttcttttatagcctccactgaagatctttctctatacatccccaaatatttggtaaactacgtgtcytaggttgtaagtgccgtaaaaataaagcatggccttggctgaacatcagtgtttacatagaaagtggattagtttggtattaggaaggtttttttttttt

SEQ ID NO: 79944 - DNA, 201 bp, Homo sapiens
attactcggcggtccagatggcagtcttacttcagggagtctactccacttgcaggacctctttgattgagttcactaaacctcacagggccgccttcccmgtgttccagttagcaaggggccctcaacgccgcggacacagcgcaacctccgacgccagagaacaatagctcctcgatgcgtctccagagatgtcaagga

SEQ ID NO: 79945 - DNA, 201 bp, Homo sapiens
tttgggaggccaaggcagttggattgcttgcgcccaggagttcgagaccagcctgggcagcatggcgaaaccctgtctctaccaaaaaaaattacaaaaaattaactgggtgtggtggcacatgcctgtagtcccaggtactcgggaggctgaggtgggaggatcacttgagcctgggaggtcaagattgcagtgagccat

SEQ ID NO: 79946 - DNA, 201 bp, Homo sapiens
ggaacacttccgccgcttcgaggccattttatctccgtcctccgtccccaaggcccgggttgagaggggtgctctggcggccggagagaccggccactcasggaggccggaggatgccctccccgggctgagcggcggcgctcgttttttcctcgcctcggggtcgcccccttcacctcccttgggcctctcctgaggacc

SEQ ID NO: 79947 - DNA, 201 bp, Homo sapiens
taatttatctccatttgtataattgttacttcagagtgttatataaatgtaatcatgtagtatgcatctttttgagactattttttttccttccacttagsacagtttccttaaggcttatacaaattgtttcatgtatcagtagtcctgtttctttttattgcttaaagtgttccatggtgtggctgtatgatagttcaa

SEQ ID NO: 79948 - DNA, 201 bp, Homo sapiens
ccttggcctcccaaagtgctgggattacaggcatgggccaccatgcctggccatgattttttttttccctgtctctggcattgtatactttttttaatgcyttcttacataattgctctggttagtctgtgcagtcatttttttgatttaactgtaggaggggaaaaatcagtaatcttaataaagaatcatagaaatgtt

SEQ ID NO: 79949 - DNA, 201 bp, Homo sapiens
accacgactggctaattttgtatttttagtagagacggtgtttcaccgtgttggttaggctggtctgaaactcctgacctcaggtgatctacctgcctcarcctcccaaagtgctgggattacaggcgtgagcctctgtgcccagacagcatttttatattaaataggttaaaacatactaatcaggattttgtgaatact

SEQ ID NO: 79950 - DNA, 201 bp, Homo sapiens
ctgtggtaggtactaccttactttaacaacataatgctataaaaggaaagacttaaactggtattacccttttatagtcccttagcaacatgcgtaggatrctacttgaggtcattatatttctcttcaccctttatggcgacatcaaatgatttgaatggctgatcagcttttttacgagggaatttgtaaaaactaccc

SEQ ID NO: 79951 - DNA, 201 bp, Homo sapiens
gtgattgttaaattacagtcttgaaaaatgttatattctccccctgtgtttacaggcagaaattgatactaccttgagaagagtcacatggtattttcccraaagagccaagataaagaaccttcaattctacataatgaggcacatttctaatatgccttttgttctaagtggacaacatatgaaagcagcagtgggatt

SEQ ID NO: 79952 - DNA, 201 bp, Homo sapiens
ttggtattaggaaggttttttttttttcttttttctttcttttttttttttttaagacagagtctcgctctgtcaccaggctggaatgcagttgcgcgatytcggctcactgcaaccgccgcctcccggtcaagcggttctcctgcctcagcctcccaagtagctgggactacgggcatgcgccaccatgccctgctaatt

SEQ ID NO: 79953 - DNA, 201 bp, Homo sapiens
cagattttgttgtttcctagagtgtgacaatttcctactttcacctttggacagctactgtattatgaacacactttttaccttttttttttttttttttyttttttttttttttgccataatctcatacataggacagtttccattgcatacctttgtctttctgcacataaaatttaaatttttgttattctaaaacac

SEQ ID NO: 79954 - DNA, 201 bp, Homo sapiens; identical to SEQ ID NO: 57938

SEQ ID NO: 79955 - DNA, 201 bp, Homo sapiens
ctaacacagattttgttgtttcctagagtgtgacaatttcctactttcacctttggacagctactgtattatgaacacactttttaccttttttttttttkttttttttttttttttttttgccataatctcatacataggacagtttccattgcatacctttgtctttctgcacataaaatttaaatttttgttattcta

SEQ ID NO: 79956 - DNA, 201 bp, Homo sapiens; identical to SEQ ID NO: 10875

SEQ ID NO: 79957 - DNA, 201 bp, Homo sapiens
ataagctggaatttatattgaacagcatccatgatactttagtattacaactaaagttgtacatactgagtaggtaggatgccttagtaactagataaaasgtataccacctagccatagtgataaatatagctgttttcaaactgtcattcacagatctctaccacagtacctgttacatgaagttcctggttggttctc

SEQ ID NO: 79958 - DNA, 201 bp, Homo sapiens
tgtgagataggctaacacagattttgttgtttcctagagtgtgacaatttcctactttcacctttggacagctactgtattatgaacacactttttacctktttttttttttttttttttttttttttttttgccataatctcatacataggacagtttccattgcatacctttgtctttctgcacataaaatttaaattt

SEQ ID NO: 79959 - DNA, 201 bp, Homo sapiens
acatcctcattctcttctccaagagcagtaactgctattactttttcttgggtatcatcaagataatttctatgcatatacagttattttatgtatattgwtttaaacaaatgtgatcataccataaacacagatgagttgcaccttgtttttttttacttggtctctttggcatttttccattttttaatgtatctagac

SEQ ID NO: 79960 - DNA, 201 bp, Homo sapiens; identical to SEQ ID NO: 57940

SEQ ID NO: 79961 - DNA, 201 bp, Homo sapiens
ttgtgagataggctaacacagattttgttgtttcctagagtgtgacaatttcctactttcacctttggacagctactgtattatgaacacactttttaccyttttttttttttttttttttttttttttttttgccataatctcatacataggacagtttccattgcatacctttgtctttctgcacataaaatttaaatt

SEQ ID NO: 79962 - DNA, 201 bp, Homo sapiens
atatgctcgcagaaggtcctaaatccaatctcctgcatataaggaaagactacactatcacaacacagatacactactagagtactgtgttcaaaagctcrgaggggccagtggtggtggttcattcctgtaatcccagcactttgggaggccaacctgcaggcggatcacctgaggtcaggagttccagaccagcctggc

SEQ ID NO: 79963 - DNA, 201 bp, Homo sapiens; identical to SEQ ID NO: 57943

SEQ ID NO: 79964 - DNA, 201 bp, Homo sapiens
tagataaaaataaaataagtattttaacaggctgaaagcggaggagagaaaagatgttttgtgagataggctaacacagattttgttgtttcctagagtgkgacaatttcctactttcacctttggacagctactgtattatgaacacactttttacctttttttttttttttttttttttttttttttttgccataatct

SEQ ID NO: 79965 - DNA, 201 bp, Homo sapiens
taacttagataaaaataaaataagtattttaacaggctgaaagcggaggagagaaaagatgttttgtgagataggctaacacagattttgttgtttcctaragtgtgacaatttcctactttcacctttggacagctactgtattatgaacacactttttacctttttttttttttttttttttttttttttttttgccat

SEQ ID NO: 79966 - DNA, 201 bp, Homo sapiens; identical to SEQ ID NO: 57947

SEQ ID NO: 79967 - DNA, 201 bp, Homo sapiens
ttctttctgtattttattgctatggttagtaagtttcttgataacttagataaaaataaaataagtattttaacaggctgaaagcggaggagagaaaagakgttttgtgagataggctaacacagattttgttgtttcctagagtgtgacaatttcctactttcacctttggacagctactgtattatgaacacacttttt

SEQ ID NO: 79968 - DNA, 201 bp, Homo sapiens
cattttcatcctggaaaatgggaactaactttgactttgaaaagtgctgttattaaatgtgtgattcataagaactgaacatattttctttattattttcsttcaggattcaactttaattgactccaaatgatgttatggtcattctgtttttctgatacgagaatagattgttctgagaacctagaatattcattgcct

SEQ ID NO: 79969 - DNA, 201 bp, Homo sapiens
tactagatttttgctcagtgaaacaaatatattcccaaaccacttagtatatttgttccttttactaaatttatattagaaaattttaactgtaatcctayttaagccttagtatggagttagatcttgggccagatctactttgagtatgaagaaaatgatgaatttaatgctaataactatatttcatattttagaaat

SEQ ID NO: 79970 - DNA, 201 bp, Homo sapiens; identical to SEQ ID NO: 57949

SEQ ID NO: 79971 - DNA, 201 bp, Homo sapiens; identical to SEQ ID NO: 57952

SEQ ID NO: 79972 - DNA, 201 bp, Homo sapiens; identical to SEQ ID NO: 57957

SEQ ID NO: 79973 - DNA, 201 bp, Homo sapiens
gcagtgagctgagattgcaccactgcactccagcctgggcaacacagtgagactgtctcaaaaaaaaaaaaaaaaacccaaagaataattattttttctgkgtatcttagttatattagttaacagttaagttcatttgtttcaatttgctttcaaccttaggatttactttgtttccttttttatttacttttttggcta

SEQ ID NO: 79974 - DNA, 201 bp, Homo sapiens
cgcttgaacccaggagacagaggttgcagtgagctgagattgcaccactgcactccagcctgggcaacacagtgagactgtctcaaaaaaaaaaaaaaaaacccaaagaataattattttttctgtgtatcttagttatattagttaacagttaagttcatttgtttcaatttgctttcaaccttaggatttactttgttt

SEQ ID NO: 79975 - DNA, 201 bp, Homo sapiens
gttatactagcactgttattgggggaagtggggaagagctatatgcactattatcatgtctagctttgtgtaaccatcattaatcaagatacatatctgarctatcaccataaagcttcatcgagttattcttttatagccacatctaccccgtccctctccatgcctgacccctggcaaccactaatttatctccatttg

SEQ ID NO: 79976 - DNA, 201 bp, Homo sapiens; identical to SEQ ID NO: 58022

SEQ ID NO: 79977 - DNA, 201 bp, Homo sapiens
tttactgtattgtttgggggataatgacaagaaaaaaaatctgtacatgttcagtatagacccagttttttcttccttgaatattttccttctacagttgsttgaattcattgttgcatgtggagggccaactgtatattattttaagtatctgacttcccccaaaacaaactcagtcatattttaagattccaagcaaaa

SEQ ID NO: 79978 - DNA, 201 bp, Homo sapiens; identical to SEQ ID NO: 58024

SEQ ID NO: 79979 - DNA, 201 bp, Homo sapiens
gaagatggtaattatggggaagcatctgctgtgatatagttatgtttgtatgtgttacatctatcactgtaataattgtaagcaaagacagagagttttgkcttcattttgtgatggatggctctttcctttgcagccaaacagggaaaaagttaatggcgaagtgtcgaatgcttatccaggagaatcaagagcttggaa

SEQ ID NO: 79980 - DNA, 201 bp, Homo sapiens
gataatttgagatgaaaatagatggatttcagaattgattattgatgtaatagaaacaaggtgtagctgtttgggcactttttgtttagggtttatttttrctgctgtgttggcaaaatactgaaatgcagaagatggatgtgtcccagaaaagaagatggtaattatggggaagcatctgctgtgatatagttatgtttg

SEQ ID NO: 79981 - DNA, 201 bp, Homo sapiens
ggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaa

SEQ ID NO: 79982 - DNA, 201 bp, Homo sapiens
tccaggctggagtgcagtggtgtaatcacacctcacttcagcttcccgagtaactgatttcaggtgtgcgccaccaagcgcagctaatttcttaatttttstagagatgaggtcttccctatgttgcccaggctggtcttgaactgctgtactttggcaatccttactccttggcctcccaaaactgttgggattataggt

SEQ ID NO: 79983 - DNA, 201 bp, Homo sapiens
ggagtgcagtggtgcaatcttggcttactgcagtctccgcctcctgggctcaagcgatcatcccacctcggcctcctgagtatctgggggctacaagtacrtgccaccacgcccagctaatttttgtatttcttgtagagatggggttttaccatgttgcccaggctggtctcgaactcccgggctcaagagatagccacc

SEQ ID NO: 79984 - DNA, 201 bp, Homo sapiens
atttctgcggttatcttgtaaatgtcttacaaaagcagattgtcaagtacaacgtataatctttttagattgtgtaagaaatcaggaagtaggatgttctstgttttgtaatttaaatatattctttctgtattttattgctatggttagtaagtttcttgataacttagataaaaataaaataagtattttaacaggctg

SEQ ID NO: 79985 - DNA, 201 bp, Homo sapiens
ctgcctttgaagatgtagttaatagaatttaatcttttctaagtgcacattgaagttgccttttatgttcatattatgttcatattttatttgaaaaatckatagcatttttattgtgctgaaagcattaatatttgcagcactttgtgagacaggcaaaattatctttttgctgacttggaaactgcaagagttaaaaga

SEQ ID NO: 79986 - DNA, 201 bp, Homo sapiens
taccttaaaaaaaaaaaacttttgtaataaaatactttttcaaaaaatcataatatgtactgagccgtttaaatctcacacttgggagatgtttcataggyctcattatagaactttgtgtcttcaggaagaacactaaattcatattgtaattctctttataggttcgattgagtgaaacagacttcaaagttatggcaa

SEQ ID NO: 79987 - DNA, 201 bp, Homo sapiens
ttgagaggaacaggactttaagcaggaaaaccaattgtgaggctgttaaaatagttcagatgaaatacatgaagccactggtggtagcagacaggacagartaggtgttttggaggcacaatcaataggacttgtttagtttggatgctgttgtggaaggaatgaaaaaaatctagggaggaatcacagcttcaggtttgt

SEQ ID NO: 79988 - DNA, 201 bp, Homo sapiens
agcacagtttccttaaggcttatacaaattgtttcatgtatcagtagtcctgtttctttttattgcttaaagtgttccatggtgtggctgtatgatagttyaatcatttgcctgttaaaggacatttggatagttttcagttttttagcttttacaagtaaagctgcttgcatgttttcatttctttgagatacatgttta

SEQ ID NO: 79989 - DNA, 201 bp, Homo sapiens
ccttgccaaaatcctggcataggaatttgaaccctggtgtatgaaaagtctgccctttgcatactcaggtttcgcatcccgtgaatgctgtatttttgatycgagtactgtattttttaatctgagtttgattgaaaaaaatccaaatataaatggacccatgcagctaaaacctgggttggtcaaggaccaactataata

SEQ ID NO: 79990 - DNA, 201 bp, Homo sapiens
agcactttgggaggccaaggcggacgggttgcaatgtcaggagttcgagaccagcctgaccaacacggtgaaaccccgtctctactaaaaatacaaaaatkagccaggtgtggtggcacgcacctgtagtcccagctatttagggggctgaggcaggagaattgcttgaaccctggaggcggaggttgcagtgacctgaga

SEQ ID NO: 79991 - DNA, 201 bp, Homo sapiens
tcctcccgctttggcctatcaaagtgctgggattacaggcatcagccacccggcccttttctgaacttctttgatcttgtgtttgtatctcattctctcayacactgcacatctttgtatatagtaacattaaaatacttatgttatcctaccatatacagtacagagttttaaaaccacagtaacaatgttaccattaat

SEQ ID NO: 79992 - DNA, 201 bp, Homo sapiens
ccgggctcggttcaaactcctaggctcaagcagctctcctgcctcagcctcccaaagtgctgggattacaagtgtgagccaccacaccagcctcaagtagytttcgagatgatgccacagcactccagcctggcaacagagtgagactccatctcaaaaaaaaaaaaaaaattcagtttaacataccaagcttttggtcaa

SEQ ID NO: 79993 - DNA, 201 bp, Homo sapiens
tgcattctttacagtgacacaatttgatgaattttgacaaacgtatacattcccactaaccatgacacagaacatttccatcacccccaaaagttctcccrttttcctttccagtcaattccttctctcttcccctcctaaccaaccactgatctgctatctaccactatggattagtgttgtttgttctcctaactacag

SEQ ID NO: 79994 - DNA, 201 bp, Homo sapiens
atgtaactggcctaagagagtctgaagaaaaactaaagcaacaacagcaggagtctgcacgcagggaaaacatccttgtaatgcgactagcaaccaaggamcaagagatgcaagagtgtactgtaagtatttcaagttatataaatgtctttagttgaggaattggtttttagtccacattattacatgttaattttaaac

SEQ ID NO: 79995 - DNA, 201 bp, Homo sapiens
cggccacgcctgaaaggcgactctcctgtgagtgggccagaaggcgaacatggcggagcggggaggctggcgggaggcgggaggcgggaggcgggaggcaktggcgctggcctgcggcgcgttcggaccggctgtggggcggggcagggcggagcggagccgtgcggcggggcggggccgggcggcggggcctggtttcct

SEQ ID NO: 79996 - DNA, 201 bp, Homo sapiens
actaaatgacttcttcacattttactttgctaaaggctggcttttatcattttctttacttttttttcccactaacccccccgcccttttcttgagacagrgcctctctctcatccaggctggagtgcagtggtgtaatcacacctcacttcagcttcccgagtaactgatttcaggtgtgcgccaccaagcgcagctaat

SEQ ID NO: 79997 - DNA, 201 bp, Homo sapiens
tgtgcctcgaggccccgatcgggctaggccgacggcctccctcccttcacctttcctctcctggcggggttcggcggcgggcgagtgactgcggccacgcytgaaaggcgactctcctgtgagtgggccagaaggcgaacatggcggagcggggaggctggcgggaggcgggaggcgggaggcgggaggcagtggcgctgg

SEQ ID NO: 79998 - DNA, 201 bp, Homo sapiens
gaaaggccacacgggcctggtgcggcaccggtctctcgtgagccgctctaccttcccgcctgcggggaacacttccgccgcttcgaggccattttatctcygtcctccgtccccaaggcccgggttgagaggggtgctctggcggccggagagaccggccactcacggaggccggaggatgccctccccgggctgagcggc

SEQ ID NO: 79999 - DNA, 201 bp, Homo sapiens
aaaagaattacgtgctcttctagtaagtgtttagagactgtttcacgttctccaggtaacaccgccattactcggcggtccagatggcagtcttacttcarggagtctactccacttgcaggacctctttgattgagttcactaaacctcacagggccgccttccccgtgttccagttagcaaggggccctcaacgccgcg

SEQ ID NO: 80000 - DNA, 201 bp, Homo sapiens
atggtggcgcatgcctgtaatcccagctattcaggaggctgagctgagagaatcgcttgaacccaggagacagaggttgcagtgagctgagattgcaccamtgcactccagcctgggcaacacagtgagactgtctcaaaaaaaaaaaaaaaaacccaaagaataattattttttctgtgtatcttagttatattagttaa

SEQ ID NO: 80001 - DNA, 201 bp, Homo sapiens
tttggttcgaggaagacaaccaccctttttaaggagaaaactgcatcttgccctgccttattcctacgcggtgcccaggtggggtgtgtgtggaccagtcratgaccgcccaagctctccgagtagaaaacccaaacatggttttgtggggtgtgtgcctttgaccccggacttaagcaacaagcgtggtcttgggcgtag

SEQ ID NO: 80002 - DNA, 201 bp, Homo sapiens
accctgtccctaaacaaagcgagcctatttggcacagctttgatgcggggtggaatctgatggcggggaaaaaaaaaaaaagtaataaccaccaatttcaygctctgccacttcgtacagctataccagccttttccttcagattctgcaagttttttgctcattaaaactctctttatctgtgaggagagaaatcggtag

SEQ ID NO: 80003 - DNA, 201 bp, Homo sapiens
gttttttgctcattaaaactctctttatctgtgaggagagaaatcggtagtcaacggggaaggtggtgactttcagatttgtttacgaaaaaaattaggartctatcaagaaacagtaagctctgtaggtatccaaaggcctgacagcaaacgctctgctaagttagcgctgccgtctcctggggtcaatgcactcgagtg

SEQ ID NO: 80004 - DNA, 201 bp, Homo sapiens
gggtgggacggggcagtttttccagcgggccatacgggaaaatttttggttcgaggaagacaaccaccctttttaaggagaaaactgcatcttgccctgcsttattcctacgcggtgcccaggtggggtgtgtgtggaccagtcaatgaccgcccaagctctccgagtagaaaacccaaacatggttttgtggggtgtgtg

SEQ ID NO: 80005 - DNA, 201 bp, Homo sapiens
cttggagctggggtgtaactggaggggcgggcccttctccaagttagagttggggttctgagcgagtcgtgcgttttaggtttagtgtcttttccttgtcyctgctcggggagcgtgaggcagatcggccggctttgctccaggcctcaggagtgtaagtttaagggcgcgaacctgggtgggacggggcagtttttccag

SEQ ID NO: 80006 - DNA, 201 bp, Homo sapiens
tactagcacgtcagcctcctgagtaaactgggactacaggctcaccaccacacctagctaatttttaaattttttgttcagatgggttttcgtcatgttgsccaggctggtcttgacttcctgggctcgagcaatctttctgcctctgcctctcaaagtgatggaattataagcgtgagcaaccacacctggcctgtgatt

SEQ ID NO: 80007 - DNA, 201 bp, Homo sapiens
gcatacacataaacatctcaatgctttacaaagcagtattgctgcccgcatgtcccacctccagccctaaggcggtttttccctaactcagtagatggaaygtacaatcgggttttataccgagacagtgcattgcccagggacaggcaggagacagatgctttcctcttgtctcaagtgcaagaggcatgccttcctctt

SEQ ID NO: 80008 - DNA, 201 bp, Homo sapiens; identical to SEQ ID NO: 57980

SEQ ID NO: 80009 - DNA, 201 bp, Homo sapiens
agccagcttggaagttttacagcaataatgttgcagtggaatattatttgtagttaaggtcatcctcctcccctttctgtttttttaaatcaagaactacrttctgcccctctcttgggcttcagaagcatctaagaaaagcagtcatcaattataattaactttcaaagggcaagtcagaagttgtttataaattacaaa

SEQ ID NO: 80010 - DNA, 201 bp, Homo sapiens
cttcatggtctaccaaccaaccccgtgggaggcagcctcagactcggtatttttgttttcatgtacttattgaaaaggtattgtgttaattcttggcattrgataacttacataataataacagtttttacttaccaaatactttccatgtgtcagaccctttggtgagtactcaacagtgttacttcatttaatcctcac

SEQ ID NO: 80011 - DNA, 201 bp, Homo sapiens
catcttgacggcagcgatacacgtcgaattctgcttacaccgcgggcaaccagtatcgcggcccctcggccgaccggcgaccacagcagtggctgcgacgrcgtggagcgtacccgagcgatgtcccaggagctactgggtaacacaccaccccacccgcttcccggctgccccggcccggccgcggggcacggcgggaag

SEQ ID NO: 80012 - DNA, 201 bp, Homo sapiens
tgatacttgaactatttagtttgttattattgaggatattctcataaaggcggaggaaaaatacttttcccaagcaaaatccaagttaaatatgttaaatkaaccaaacactggattgttgaaaaatatttagtcatttattcacctcaattaatgtaactttaggatacagattcttctgtgattttattatcttctcac

SEQ ID NO: 80013 - DNA, 201 bp, Homo sapiens
ctcgcaatattaaaagtagagaatttcagaatattatagtaggaaatgacctttgacataatgaatcgggcccttcattgaacaaatggttcaagtgtcascaaactacggcccgtgggccaaaggtagattgtgagctaaaaacttgtttttactttttttaagttaaaaaaaaaatcaaaagaatattttgtggcttgg

SEQ ID NO: 80014 - DNA, 201 bp, Homo sapiens
agccgatgggaagggcgcgaaagcggagaacggaagtcggatgttggaccgctgggaagaggttgaaccttcgcctcaaacgatgttgcgcagacgcagtsggccattctagtgccttctagaaaaggttgtaagaagggtggagcttggagctggggtgtaactggaggggcgggcccttctccaagttagagttggggt

SEQ ID NO: 80015 - DNA, 201 bp, Homo sapiens
gctggagtgcagtggtacagtatcagctggctgcaacctctgcctcccaggctcaaacgattctcccatctcagcttcctgagcatctgggactgcaggcwcacactaccatggccggctaatttttttctttttctttttttttttttctggtattttttgtagagatggggttttgctgctgcccaggctggtctcgag

SEQ ID NO: 80016 - DNA, 201 bp, Homo sapiens
caatcttcccacctcagcctcctgagtggctgggactagaggcgcatgccattactcccagctaatttgttttgttttgtttgagacaagctctggctctrtcacccaggctggagtgcagtggtacagtatcagctggctgcaacctctgcctcccaggctcaaacgattctcccatctcagcttcctgagcatctggga

SEQ ID NO: 80017 - DNA, 201 bp, Homo sapiens
gcttcggtcgcagttttgggggttctcggtttgcaggaaccctggtaattagtcttgccccccttctcccagctcactcgcctgggcttgcacagtacatkggaacgtgcgggttctattttgtattcgacgtgccggatcgaaatagagctcgcggcactgcgaagaccacagtaggaagttaaggacggggtcagtgct

SEQ ID NO: 80018 - DNA, 201 bp, Homo sapiens
tgcggtcaccgaacacggacaaaggcccctccatcttgacggcagcgatacacgtcgaattctgcttacaccgcgggcaaccagtatcgcggcccctcggscgaccggcgaccacagcagtggctgcgacggcgtggagcgtacccgagcgatgtcccaggagctactgggtaacacaccaccccacccgcttcccggctg

SEQ ID NO: 80019 - DNA, 201 bp, Homo sapiens
agtactgttatgatttcagtttttgcatttaaatttttgttccgtcttatatttattttggtgctagctataaataaaagcaaagagtaagtatatccatrtcatgcatatgttcagtaacttagctctgtctcttcaaatctctttgaagtagatctgtaaataaaactcagctcttcagaaacaaatttcttcatgata

SEQ ID NO: 80020 - DNA, 201 bp, Homo sapiens
gcgtgtaatcccagcactacagaggccgagaagggaggatcacttgaggccaggagttcaagaccagcctgggcaacatagcgagaccctgtctcttaaaraaaaaaaaaagaggtttttaattagttgcttgtggtggcacatgcctgcaatcccaagcactctgggaggctaaggcaggaggattgcttgaacccagga

SEQ ID NO: 80021 - DNA, 201 bp, Homo sapiens
accctgtctcttaaaaaaaaaaaaaagaggtttttaattagttgcttgtggtggcacatgcctgcaatcccaagcactctgggaggctaaggcaggaggaytgcttgaacccaggagttccaggctgcagtgagatatgacagcactgcagcacttcagactgtgctacagatggtctcttaaaaataataatataaaaac

SEQ ID NO: 80022 - DNA, 201 bp, Homo sapiens
tgttattattgaggatattctcataaaggcggaggaaaaatacttttcccaagcaaaatccaagttaaatatgttaaattaaccaaacactggattgttgraaaatatttagtcatttattcacctcaattaatgtaactttaggatacagattcttctgtgattttattatcttctcaccccatttaggttgcgagttat

SEQ ID NO: 80023 - DNA, 201 bp, Homo sapiens
gaccccggacttaagcaacaagcgtggtcttgggcgtagctacgaggtggttggtgggctccagggcctgcgtgcccctcgacgtgagcgatgattggcgrtgcaggataacagatcgccttcttggccactcagtggcaggggacttgctacttccgggtcggcggcgtctggcgtggagagtttggggatctacagcag

SEQ ID NO: 80024 - DNA, 201 bp, Homo sapiens
ggggtgtgtgtggaccagtcaatgaccgcccaagctctccgagtagaaaacccaaacatggttttgtggggtgtgtgcctttgaccccggacttaagcaamaagcgtggtcttgggcgtagctacgaggtggttggtgggctccagggcctgcgtgcccctcgacgtgagcgatgattggcggtgcaggataacagatcgc

SEQ ID NO: 80025 - DNA, 201 bp, Homo sapiens; identical to SEQ ID NO: 57916

SEQ ID NO: 80026 - DNA, 201 bp, Homo sapiens
tctgcttgtgattgacaagggcagtgcaccctacagactattttcattcattcaactccaggcactctcccaggtagctgccatgcggcgggtagaggcarggttcgcggaggggctggaacaaacaacaaataggtgtgatgggggctatttaaagaggatgttacagtagcggacaggatacctgcctgtctgaggtga

SEQ ID NO: 80027 - DNA, 201 bp, Homo sapiens
gcttttccgagatcgtctcagcgatggcgcttcggtcgcagttttgggggttctcggtttgcaggaaccctggtaattagtcttgccccccttctcccagstcactcgcctgggcttgcacagtacattggaacgtgcgggttctattttgtattcgacgtgccggatcgaaatagagctcgcggcactgcgaagaccaca

SEQ ID NO: 80028 - DNA, 201 bp, Homo sapiens
agacgaactggcttatacagcccgtctcctttcccctttctacctgtcctcgtgaaatcaggcacagaggatccctctgacttgtctccttgttctgtttsttgttctgtttctgtcttaagtttctcaaaaacggaatcccatatatgaatgaagaacaggagaagaaaattagacacgatatcctgactgggaactgga

SEQ ID NO: 80029 - DNA, 201 bp, Homo sapiens
cttcggagcaaaccaaatttagcagcattgtttccgtgcttaaataagtcagtattaaggaacactcactgttactctttcaagtaaaactgtgtgtgtgygatttttattttattttttgagacagggtcttgctctgtcaccaagactggagtgcagtagcatagtcttagctcactgcagcctagacttcctgggctc

SEQ ID NO: 80030 - DNA, 201 bp, Homo sapiens
tggccagaccagcactgtttctggccagcagcctgttggcatttggggggcaggacgttttgtgtggcttgctcctacgtgttggaggaccttgcttttttctgtccactaaatgatggtagtgctccctagttgttgtaacaaggaaaaaatcctccccggttgcgagtggtggtcctgccgcggaggccatagtgccgg

SEQ ID NO: 80031 - DNA, 201 bp, Homo sapiens
ctggccagaccagcactgtttctggccagcagcctgttggcatttggggggcaggacgttttgtgtggcttgctcctacgtgttggaggaccttgcttttttctgtccactaaatgatggtagtgctccctagttgttgtaacaaggaaaaaatcctccccggttgcgagtggtggtcctgccgcggaggccatagtgccg

SEQ ID NO: 80032 - DNA, 201 bp, Homo sapiens
atcttgacggcagcgatacacgtcgaattctgcttacaccgcgggcaaccagtatcgcggcccctcggccgaccggcgaccacagcagtggctgcgacggygtggagcgtacccgagcgatgtcccaggagctactgggtaacacaccaccccacccgcttcccggctgccccggcccggccgcggggcacggcgggaagg

SEQ ID NO: 80033 - DNA, 201 bp, Homo sapiens
cctggccagaccagcactgtttctggccagcagcctgttggcatttggggggcaggacgttttgtgtggcttgctcctacgtgttggaggaccttgcttttttctgtccactaaatgatggtagtgctccctagttgttgtaacaaggaaaaaatcctccccggttgcgagtggtggtcctgccgcggaggccatagtgcc

SEQ ID NO: 80034 - DNA, 201 bp, Homo sapiens
ggttttttttttgttcgtttgtttgtttttaattataagacctctttgagaagtataggaaacagttgtagttatgtttccattgttgtacccaaatttgkttggggggaagggggacagagtcttgctctgttgcccaggctggagtgcaggggcacgatcttggctccctgcaacacccttgcctcccaggcccaagca

SEQ ID NO: 80035 - DNA, 201 bp, Homo sapiens
gtcagtattaaggaacactcactgttactctttcaagtaaaactgtgtgtgtgcgatttttattttattttttgagacagggtcttgctctgtcaccaagrctggagtgcagtagcatagtcttagctcactgcagcctagacttcctgggctcaagtgatactagcacgtcagcctcctgagtaaactgggactacaggc

SEQ ID NO: 80036 - DNA, 201 bp, Homo sapiens
ccccgggcgagcttggggagggggtggcgggacggttgccaggccacagggcctcagagagggcctcgggaaggacaggggggcttccttctccagccccrgggcggtgggactttgagcagcaagtacactccgagccccacgtcccttgttggccagagccccgtgcgcccaggtgcctggctgctccttgccttggtt

SEQ ID NO: 80037 - DNA, 201 bp, Homo sapiens
tgaggagccaggtaaacaggctttgattgcaattgcaatcaaacctctgtagcaaatcgtacaattaaaacacccgcaggcaggtgtgggcgacgccagcrgcacacggggaagctgggcacgtggggcggaggcagctgcctggtttccatgtgtgcgccctttaagacccggcggcgcgacggaagcgcgtgggcagca

SEQ ID NO: 80038 - DNA, 201 bp, Homo sapiens
gctgggtgacagtgagaccctgtttctgaaaaataataaaagccatatgacatggtttgatgtcatatttaaatatgcataccttgagattataaaaaaawttctcatgttttcttctagtactgttatgatttcagtttttgcatttaaatttttgttccgtcttatatttattttggtgctagctataaataaaagcaa

SEQ ID NO: 80039 - DNA, 201 bp, Homo sapiens
gaagaccgtgagccgcagcaaaggatctgcttattgcagttgcgtccggtgttgttcctgctccgcttttctgatttcaccctttctggactctgtcttcstctcctgccacgcctcttaacattctaagtccatgtaaatgacattctcacgttaagggctgcaaagaaattgctgaggagccaggtaaacaggctttga

SEQ ID NO: 80040 - DNA, 201 bp, Homo sapiens
ccattacttactagttttaatctttttcaagttacttaacctttctgtgttagtttctgcagctaaaaaaaaatatagaaaaaataatagaattgagacayaagctttatctataaaccgttaagacaggcctggcatatactaagtgctcagtaaatgttaactattatcttcatcattataaagcattatttcattcat

SEQ ID NO: 80041 - DNA, 201 bp, Homo sapiens
aaaccctgtctctacaaaaaaatacaaaaattagctgggtgcagtggcatgcgcctgtagtcccagccacttgggaggttgaggtggaaggatgacttgawcccaggaggcagaggctgctgtgagccaagttcgtgcctctgtactctagcctgagagacagaggcagaccctgtctcaaaaaaaaaaaaaaatggccat

SEQ ID NO: 80042 - DNA, 201 bp, Homo sapiens
cctcctgagtagctgggattacaggtgcgcgccaccacacctagctaatttttgtatttttagtagagacagggtttcaccatgttggtcaggctggtctygaattcctgacctcaagtgatccacctgcctaggtctcccaaagtgttgggattacaggcataagccaccgcacctggcctgaagtctttttttttttta

SEQ ID NO: 80043 - DNA, 201 bp, Homo sapiens
tgtcccggagaggcatttaaaagtataattgaagatcggatgcagtgcctcacacctctaatcccaccactttaggaggctgaagcaggtggatcacttgwggccaggaattcgagaccagcctggccaatacggtttaaccctatctctactaaaaacaaaaatgagttgggcgtggtggtgcatgcctgtaatcccagc

SEQ ID NO: 80044 - DNA, 201 bp, Homo sapiens
gaagcctagaattcaagggaggacactgtaaggaagaccatggactagttgcactggaaacagtaacaaaagtaaaaattaagctcacatgtatgtgatgrtgtaggtagggatttccgcaaggagtgagtgcacgagataatccctggggaccaaggattccttcaatttaatgggcagttcttgaggctttgcaaagtt

SEQ ID NO: 80045 - DNA, 201 bp, Homo sapiens
tgatgactcttaacgagcatgctgccttcaagcatctgtttaacaaagcacatcttgcacaacccttaatccatttaaccctgagtttgacacagcacgtrtttcagagagcagggggttgggggtaaggtcatagattaacagaatctcaaggcagaagaatttttcttagtacagaacaaaatggagtctcctatgtct

SEQ ID NO: 80046 - DNA, 201 bp, Homo sapiens
agctactagggaggctgagacaggagagtggcgtgaacctgggaggcggagcttgcagtgagccgagatcgcgccactgcactccagcctgggcaacagastgagactccgtctcaaaaaaaaaaaaagagattgtgattttttactagagccaccaggaaaaccaggagtagactccatatttccaaatctaatgcctct

SEQ ID NO: 80047 - DNA, 201 bp, Homo sapiens
ggatcacgaggtcaggagatcaagaccatcctggctaacacggtgaaaccccgtctctactaaaaatacacaaaaaaattagccaggcgtggtggcaggcrcctgtagtcccagctactagggaggctgagacaggagagtggcgtgaacctgggaggcggagcttgcagtgagccgagatcgcgccactgcactccagcc

SEQ ID NO: 80048 - DNA, 201 bp, Homo sapiens
tgtttttactttttttaagttaaaaaaaaaatcaaaagaatattttgtggcttgggaaaattaaatgaaaatcaaatttcgttgcccaggttcttagaacmtagctgtacctactctcatttgtttacgcatcacctggctgttctagcactacaatggctgagtcgaacagtttcaacagaagctattggacctagaaag

SEQ ID NO: 80049 - DNA, 201 bp, Homo sapiens
gtagagatggggttttgctgctgcccaggctggtctcgagctcttgagctcgagagatctgcctgattcagcctcccaaggtgctgggattacagacgtgrgccactgcactcggccccaacgcattactttgatttaatatttggatcattaaaaataactaaagatgtatttcctcattttttctctgtctgccttact

SEQ ID NO: 80050 - DNA, 201 bp, Homo sapiens
tttttgtagagatggggttttgctgctgcccaggctggtctcgagctcttgagctcgagagatctgcctgattcagcctcccaaggtgctgggattacagrcgtgagccactgcactcggccccaacgcattactttgatttaatatttggatcattaaaaataactaaagatgtatttcctcattttttctctgtctgcc

SEQ ID NO: 80051 - DNA, 201 bp, Homo sapiens
tcgtctgggcgacaggtgggaccctgtccctaaacaaagcgagcctatttggcacagctttgatgcggggtggaatctgatggcggggaaaaaaaaaaaaagtaataaccaccaatttcatgctctgccacttcgtacagctataccagccttttccttcagattctgcaagttttttgctcattaaaactctctttatct

SEQ ID NO: 80052 - DNA, 201 bp, Homo sapiens
ctgactttatatggctgcgcctggcgagcgactgagtcgtccgtgaggaaaaagaggcgaggcttttccgagatcgtctcagcgatggcgcttcggtcgcrgttttgggggttctcggtttgcaggaaccctggtaattagtcttgccccccttctcccagctcactcgcctgggcttgcacagtacattggaacgtgcgg

SEQ ID NO: 80053 - DNA, 201 bp, Homo sapiens
gaaaaagaggcagggacaacagggagagaaacaggactgtgacggaagtgaggctccggggaaggggcggggtcggcatttttgtccaattagatagccgrtgggaagggcgcgaaagcggagaacggaagtcggatgttggaccgctgggaagaggttgaaccttcgcctcaaacgatgttgcgcagacgcagtgggcca

SEQ ID NO: 80054 - DNA, 201 bp, Homo sapiens
tgacatcttgtccatataatattttgaaatgctgctgaaccttgacatctctacatttcctttttacttacatcattattaagatcactttctgaaaaacygttgtaggctgggaagttagcaagaacaaatcaatttatttctgtcttttggaaggtgaaagtattttcagcctactcgtgctgctgacttaatcttttc

SEQ ID NO: 80055 - DNA, 201 bp, Homo sapiens
cgagtgatctcagtgaatgacagttgtttgctgctcggagtgtggggtgttttttaaaataggaaatgtcagtatcaatctaatattatagaacagtcagwatgtgaaaatgaaaggaccaaatgccaacctcacttggactcttggttcccaacagtaagagaaacaaatttgaaagaggaaggaggtggcatcaggagc

SEQ ID NO: 80056 - DNA, 201 bp, Homo sapiens
ttatatttattttggtgctagctataaataaaagcaaagagtaagtatatccatgtcatgcatatgttcagtaacttagctctgtctcttcaaatctctttgaagtagatctgtaaataaaactcagctcttcagaaacaaatttcttcatgatacttgaactatttagtttgttattattgaggatattctcataaaggc

SEQ ID NO: 80057 - DNA, 201 bp, Homo sapiens
ggaattcgagaccagcctggccaatacggtttaaccctatctctactaaaaacaaaaatgagttgggcgtggtggtgcatgcctgtaatcccagctgttcrgaggctgaggcgggagaatcgcttgaactcaggaggtggagattgcagagagccgagatggcaccactgcactccagcctgggtgacagagtgagactgt

SEQ ID NO: 80058 - DNA, 201 bp, Homo sapiens
gtgtctagttcatggcgagtgatctcagtgaatgacagttgtttgctgctcggagtgtggggtgttttttaaaataggaaatgtcagtatcaatctaataytatagaacagtcagtatgtgaaaatgaaaggaccaaatgccaacctcacttggactcttggttcccaacagtaagagaaacaaatttgaaagaggaagga

SEQ ID NO: 80059 - DNA, 201 bp, Homo sapiens
tcagggggtcgccctgaaacaaaagggggtgcgaggcgtggcccgcacgtgcgagcccgggaggcccgctttcccgcggagggcgcgtttccaacgccgcmccggacaccacatccacgcgttgccggtctcaaaaccctgccgcgcgcggcggggctcctcctcgctgtgggaaaagtggggccacagcgccctgcccca

SEQ ID NO: 80060 - DNA, 201 bp, Homo sapiens; identical to SEQ ID NO: 58009

SEQ ID NO: 80061 - DNA, 201 bp, Homo sapiens
ggccggctaatttttttctttttctttttttttttttctggtattttttgtagagatggggttttgctgctgcccaggctggtctcgagctcttgagctcragagatctgcctgattcagcctcccaaggtgctgggattacagacgtgagccactgcactcggccccaacgcattactttgatttaatatttggatcatt

SEQ ID NO: 80062 - DNA, 201 bp, Homo sapiens
gaggcttttccgagatcgtctcagcgatggcgcttcggtcgcagttttgggggttctcggtttgcaggaaccctggtaattagtcttgccccccttctccyagctcactcgcctgggcttgcacagtacattggaacgtgcgggttctattttgtattcgacgtgccggatcgaaatagagctcgcggcactgcgaagacc

SEQ ID NO: 80063 - DNA, 201 bp, Homo sapiens
tctcaaaaggaaaaaataaaaaagtataacggtaatgttttctccgctaaccttaaagattgatttgagcacctcactttgaggaccatagttccaaaacsctgttcaagtagaagcctagaattcaagggaggacactgtaaggaagaccatggactagttgcactggaaacagtaacaaaagtaaaaattaagctcaca

SEQ ID NO: 80064 - DNA, 201 bp, Homo sapiens
acttcttaagtactatgtaaagttgtaagagtaaattggaaatcattactgtgtgatgtattatttatttattgaacaagcatcatacctgtatcacttgmtaggcattgcgttagaggcaggagttacaaagataaagtagatgttatccctgtcatcaaaagtcttaagtttcatagtggaaagtggaatggggataat

SEQ ID NO: 80065 - DNA, 201 bp, Homo sapiens
attaaatttttgagggagcaggacttgaagaaagaccagttaggagtctagtatgacttgagatactttgttataaaggtggttgtttaatgaacacttayatttgccaggaattatgctacttgctttatatgttttttctcatttaatccttaaaattacatcatgaagcagttataatttcccccattttacaggatc

SEQ ID NO: 80066 - DNA, 201 bp, Homo sapiens
ctggccaacatggtgaaaccccgtctctactaaaaatataaaaattagaggggcgtggtggtgcacgcctgtaatcccagctactccagtggctgaggcaygagaatcacttgaacccaggaggcggaggttgcagtgagctgagcgcctgggcgacagagcaaaattctgtctcaaaaaaaaaaaaatcattttagctgc

SEQ ID NO: 80067 - DNA, 201 bp, Homo sapiens
atttaaagcttgagcccgaattggtttttcaagatcattctggctgggcgcattgtctcatgcctgtaatcccagcactttagggagccagccgaagaagscggatcatctgaggtcaggagtttgagaccaacctggccaacatggtgaaaccccgtctctactaaaaatataaaaattagaggggcgtggtggtgcacg

SEQ ID NO: 80068 - DNA, 201 bp, Homo sapiens
gacgcccgacctcgactgcagctgcgggcggacagggcaccgggctcatccgagggcgcgcggatggacctactctttttctggtaaatggtcctaaaatraaacctggcgtttaacatggacactcagggggtcgccctgaaacaaaagggggtgcgaggcgtggcccgcacgtgcgagcccgggaggcccgctttcccg
